United States Patent 7,745,391 (HUMAN THROMBOSPONDIN POLYPEPTIDE) - sequence listing, part 202

SEQ ID NO: 478008 - DNA, 1559 bp, Homo sapiens
gtaaaacctagcactggatggcccccgcagccccacactccaagcagcaccaggtcagcactcctggactcaggcaccaggccaccatctgcaaacatcagttccaggcctgccaagtgccaggccagtccctgcaggcccatgctccagcagacccaggatccaagtatgacccagtagagcccagcgctggactagccctcatggactcaagctccaggactgcccctgtgtctccaagcaccaagttcagctcagtgcctggctggcccctgcagactcaggctgaaggtctaccccagagccaggtcagcccagtggacccaggctccagactggtccctgcaaacaacagctccaggcccatcatcttggattcaatcaactggtctaccacagcagatctaggttccaggcgcgactccagagccccaggcaccaggcctccttaactgctgacccagtagagcccagagctggactagccctcatggcctgcctgtctgaagactccagcagcaagtctgccactgatcacggcagatagcctgccccaaacctctgggtggtctgactggtgaagggctttcccagacaaagccagtctgaaaagactagaataactctcctccgcttcttcaaatccacagactgacatcaacataaggcaagaaacatgaaaaatcaaagagagatgacaccaccaaattttcctttcttgaaatgcccatgacagttttttttaaatcaaaattataaattgatctgggaaatgtttcctgatcttctattttctgaaacttttcataaagattgctgttatttatttcttaaatattctgaagaattcaccagtaaagccatcttggtttggatggtggaaacaattttactgcaatcaacttgtttagaaaatactaaacatcttcaggttttccatttttttttttttgtcagttgtagtaatgtgtgtttttcacatcttatttaattttttaaataattgtcataaaatattaaataataccctcagtcctttaacaattacaggattcttagtaatgtttttaaaaatatgttgatatttgtaatttttagattccctcatttttctgaagtactctgcaagtggtttataaatatcattagtgtaaagcatctacttttggctttgttgatattctctgtaagatcattacttgtcttccagattttttcaagatctattttttgtctctggttttctgcagcttgaatttggtatgcctagatatcctttttgtggggctgttggttgagggactgtgttttttctagcctttctgtatgccttgtaattttttgttgaaagctgaacataatgtacctgatagtaggactggagctttctcttgatttaagtaaaggatgagaacttctagtctctttacctgtcagagctgaaaccagaagcctctattttttttttaacatgttctgacttatggatcccactgtctgactaataatttttaaaattatatttcaggtattgcatataaataaatctcaggtgctct

SEQ ID NO: 478009 - DNA, 663 bp, Homo sapiens
tccctgaagaaactaattttcttctgaaaagagctcgattgggaaagtcctacagtttctgttttcctagaggaaatgaccaacagtatgacgatgctttgtcttctctgccttcaggccttcatcagtagaaagaaacctttccttagaagagcctgtgccttgcagcagtctcagctccaagccagtcctgatgccctggaaccctgttgccatggagctactgggtctgagatgctgtttctgctgtttgaagcttactgtctccatgttacagacaacagcctgcagccccagggatgccaagggaggagtcatcaccgcttctctgttgatgaacatgtcttccggttcagactacttaaaaattcattctcagttgctaatgaatatccattggcaaaatatgaagaatcctatgacaacattctttctgtacagaagaaaagcttggggagtctgtatacactttcattaaagcaacaattgaggtgtcaagtcacaggtctttgcttcattaactttcatattcagcagctagtgagactggaagaacggatattcctttggaggtaaacagtggcggacaaattagataggactcctccctcacagaggcagagacagacactgaataattacacaaaatgacatattttcata

SEQ ID NO: 478010 - DNA, 625 bp, Homo sapiens
gcacgcactcagctggatgctgagcagagatcagcaaggaaatttacctttgctggcttggtcaagagatcctgagatctcagctgcagccttcagagttaaattcagtgacaaaagtgttgtttctcatttatattctctgtatttgaattcaggtatctgtgaacctcgggaaatctttgctttttttctcccaccttccttctggtcttacagtcagagaggaaagggatataatgtttattgtctaagtgataaacataaattgaatcatttaatgggctcagacctaaagaaaagaaacagacttcccaaaagaaaggagtcatattgtttctctccaagaacaaaatggcttgtactctattcattgggtattctactccatttgaaaaggcagtcagcagttgagatttgccttgtgattgtcttaaagggcaaacttcataaagaaagaccaatgcacaagtaaaggcttgagctctataataataatagcaagccctcagatggaacttgctgtctgtcaggcactttacatatagcaatttatttaatcttcataacacccctaagagataaatattctttctatttcattttactgttatggaaattgacacat

SEQ ID NO: 478011 - DNA, 799 bp, Homo sapiens
acacataattacctttgccctgaaagcaatgcagtcggatgctttggcagcacactcaggacagccagggctgcagacatggcctccaaattcagtctcagttaccccaggcagaacacgggaattgacccttccaactcctccacctgcctctcgatcccagaatcttgccacctgctccagtgatggttatttgatgagcctgaaggatactgtgattcctatgtttgtctttcttgatgttatcttgtgttctcatcactccttacacatggcaccattggccaattgctgtcttttcaactacgtttattcgttcactgagggccctgcaaaccctcctattgggacagcttgtttgggtgaaaatgattttcgcttcccttggctgtggagacttgctctgtaccagtagtcatgaatagattacaacgcttttgggaagtaaaggattatttgctgtttttaacattatatttcttatttatctgactatgtatttgtagtacaacagaaaaataatttctttcctcgaagtcctagaataagcggtgaatatttccttgatccattcccagcctggtggtcttcggtactgtcagtttgttgcaaatagactgtgtagaagacattgcatgacccagttcttttcatttattccaggtcattggtaactagatgaattctagttctgtagaaagtttagtatttgtgtagacatgggttatgcttcaggtctatagctttgtttgaaagtattaagtttctcagcaaagtaggtgaaggcttgagggttata

SEQ ID NO: 478012 - DNA, 860 bp, Homo sapiens
acagcagccgtacatgatcccatttttatcaacagctttatcttatattatgagctatatttccacgtgcagatgacttctcaatctaatgtcatatccttggaatcatatagtacgtggccttttcgactggcttctttcacttaatgccatgcatctatactgcaatagagaagggaaggatgaatacccagaaatgaagaagaatgagcatggagaaactcctaccagctgggagaggcagtggaaagatcccctggctccagaagataaaggggagggtgagagccagagaaagagaagctgtcttttgagggctactttcaacaagacaccaagcagtaggttagaaaaagccaagaaagatgaccttcaaaaaagcttccctgagctctgtgcacttcaggctgcggcagtgaagactacaatgactgctgttacagtccggtgccgctacctccattcatacgaaggtaacagcgtgattgcttttccaccgtcagttccaatgtcaacacagtagaaagacaaatggcttcataatattattatgaaaacagtgtttagtttgtggatccttgggaaagtcttggaaatccctccaagtctgcaactccagcgtggagaactgctactttaaaaatacaaaacaattttgttgttttcaaaaacactttaaagagcaggtagataaaataaaaaatatcaatatttctatgtatgtaataactaatggactagatctaaaaatgttcttaaatgtttatcacccagctgttttctccttttcacaagattcccttatttagcacctctttgggttgtggtgtcaccttctcatttgctcttctcttgcacat

SEQ ID NO: 478013 - DNA, 548 bp, Homo sapiens
ctgagtgcagcctgctaggggtttcagctgagatatctgctgttagcctgatgaagttcccttttgcaagggtggcaagggcagtagcagagaggctttcagttgcccctgaaggctctgtccagggagttggtgagtttgctgctggctcaatagctctggcagggggcggctggaggcctaggcctggaggacctgcgtgggaggtgcaaagctgctaccagtggctggctagaattgcacgccagtgggtcttatcctgtgaggtactgtcaaagtggggcctgccaggtgttcctactcaggcccctggattcagtctctttcctagggattattctaaaatttatatggaaattcgagggaccctgaatagtcaaaacaattttgaaaacaaaaaagaaagttgggagaatcccacatctcactttcaaatcttactacaaggctacattcattaagacagtgaggtagtggcataatgacacactcacagacccatgggatagaactgagagtccaaaactaaatccgtatgtccatagtca

SEQ ID NO: 478014 - DNA, 591 bp, Homo sapiens
acttccttgcaactcagtcagctcctgccagtacatcctgtggcaaaatatcagctctccatcaggtcatgtatgctcctctccatgatggttagtactgagtgtcaacttgattggattgaaggatgcaaagtattgatcctgggtgtgtctgcaccaggcagcggcagtgatggtgaccacacccccgcccccaaccctggggagctcagtagtcttaggcagcaggcagccgaagtgatggcgaccgcctatgcccctgggagctcagtcatcttagttccaaatgttatcatgttttctttgatggatcattcaactaacaggttgtttggtcctgttgaaataaggttgtttggtccacttcctgtaatcagctggcaaactatacccacatccattaaccccctccccactcaggacctactgctgactccagaccactggattatgccaccccttttctttgatgagttccttctcattgttccctttcctttgtcctctgagatcactctctgccacctccaaaacatcagatatggctgaacctttctggtgagtgggttgaagtctttcctttcttctctt

SEQ ID NO: 478015 - DNA, 765 bp, Homo sapiens
ctggctcttttccaggatgagggcatggttgggagcttcttccttttcttctggaaacatttgttgctttctttggactggcttattaaattacagtgtcttagtcggcttcttgctgctacaacagactactacagacagagtaacttacaaaagctagaagcttatttgactcacagttctggaggctggaaagtccaagatccaggggccacatctggaaaaacaagctatcaagttgtgaatagccctatggaggaaccacataacatggcagtaaaatctggagataaccttgagcatttgagggctgccaaagtgacacaaaactatagcaagtggcacactgtggaaaagggaggcatgcacaaaactggaccaggtgtgtatggtctgtttgagtggacaatggttcaggccctggattctcttacacagatgccaacaagaacaaaggtagtgcctgagaacactgatagaatatttgatgtgtccaaaaagacacatccttggaacaaaaatgatcttcgctggtgtgcagtaaagaattaattttgtccaaagaaagatttggccttttccctgggctcctgggagaacttaagaccatattcaatccttctatgtagcactgagaagggggggtctttaaggaaattggttacaaggaaagtagagctttggtgtttttcacatttttatttatttgcaaagatgcacatgccttaaagctttataaagatgccatataaagtaatacatata

SEQ ID NO: 478016 - DNA, 1081 bp, Homo sapiens
tgaagacttctgacatgcccttccactgacaccacagggcaggagtggaagtggcctcacccttctgcgggcagcggggagagtttggactctccactaggcctcctctgacgccactaaagggtggaggggaagatgctttagtgccacagcatgagggtagaatctgatgattatgtgtcttgggaacgattctggtgcctggctggaattccaagccaatgggtcttaccctgtgaggtcccatggaagtgggccctgcaggctgttgctactcagccccctggattcagcctctatcttgagagcatgtatgggggtctaccatcctgctttggtgaagttgccactagtttagctgggaagcatggaaaaccagagtatctaaagctcctgggtctcttcacatgcctgagtggctgctctgttgagactccatgtagctctgcgtgctttgtgaggttggaggtaactgctattgaagaaatgcttcaggccctggtcaacacaacgaaagacaatgaacagaaatcgccatttgatgtgaagagtgactttaagtccatagtgagtaaacaagaaagcaggggatacagagagccaagtggacggtgattatcattcatagaattgatctgtctgtaggcgtcgtatctctattagtgatctctctccacaacaacagaacatggggttcctggcttagcaaggactgaaggaaacactttaccgtgacacttgagtgaggacagacaggtgagttggaaaggggcaaaagggcagttataggacacgatggagaaaatcaatcttcaaagcttcatgataaaatttcaatatttagtttgaattatttccagaataatagacgtgctcaaaataacgacactaaaaatagtctttaaagacatgtaattcttggattgtctgcaagttgggttaataagaactgttgtgtcctttgataagcactgataattttattccattgtttaatctaattctcatgttggtgtcccatcattaagattttgtaacatcaccttgaatcttaaaagcaaaagtattcaagatgggtctt

SEQ ID NO: 478017 - DNA, 868 bp, Homo sapiens
gaaacaatttgatgggctcagcagaagacaggaagatgtgggaaagtttggaacttcctagagacttgttgaatgcttttgaccaaaatgctgatagtgacatggacaatgaagtccaggctggggtggtctcagatggagatgaggaacttattgggaactggagtaaatgtcactgttgctgtgctttagcaaagagactggtggcattttgcccctgtcctggagatctgtggagctttgaacttgagagaactgaattagggtatctggtggaagaaatttctaaacatccaggcattcaagatgtggcctggctgctcctaacatcatacagtcatatgtatttacaaagagattatcagaaattggaacttatgtttaaaagagaagcagagtataaaagtttggaaaatttgcagcctgatcatgcagtagaaaagaaaatccaggccttgaggcctaggatgaaaaaatggtttcatgtgcacggcccagggccctgctgttctgtgcagcctcaggacatggcaccctgtgtcccagctgctccagctccaaccatggctaaaagaggccaaggtacagctcaggccattgcttcagagggtaaaagctccaagccttggcagcttccacatggtgttgttcttgcaagtgtgcagaagacaagaactgagctccagtgtcagatttctgtacttgtgacagactatggccctcaaagcatcaactatgtcctatctgtcccttcgcagaaacaaattggcctcccgttgtaaagtctaaaatctgcaaattatttaaactgtctaacctaaaccctttattctatacatgcatcagctaagttataatagcagcagcc

SEQ ID NO: 478018 - DNA, 631 bp, Homo sapiens
acctacggacaaataaactgtgaatgaatgttggagtggagtggctgcctggagctgatggaaaggtggaaccagcacacctgtggccaccaccactaggactgcattgtgggagaactgaagctagcacaataatgggtcttgctcacagcctacaggaaccactccctggctactggttatgtttagtcaaggcccgagggttctgcaatctgcaggtggcaaagccaatcaggcttgtgggcttcccttcaaggtggcgagttacccccagttccagcagaggagtctctcaccatggccaccactgccccagggccatggacaagtactgcttggctactggtaatgttcactcaaggcccaagggctcttctgtcagctttggtgaatgcttccaggactgggactctcccttcaggacaccaggctcccctttggccccaggcaggtctagaaatgccatctaagagccaaggcctgcaatcaaatatcccaagagcctgcttggtgctctacttccttgtagccaaaccatacttaagcttcaagacagaattccctttactctcccctctcctttactcaagcagaaggagtctcttcccagagccaccacagctgggaatgt

SEQ ID NO: 478019 - DNA, 558 bp, Homo sapiens
tcgtacattgccaaataagtaatttgaaaactctaggcccatatgggccctctatctttgttaaactcggtggataaagaattgagaatcacattcctgtattgtatgaggaatttcactttatcaacatctgacataacttcagaaaatgctgatggttttgaaacagtttgttgctcaatctaccttctgagagctcaggctttctggctggaacctgagccagaccaagcttcttctgttctggaatgcaactgctgtgctcctaaaacacaaaccagttttataatttttagtgatttccatgacagtgagattgttaagtttcctgaagccttcccagccacgtggaactgtgagtcaattaaatctctttcctttataaataacccagtctcaggacaccgatggatatactaaacgtattcagaatatatttagtcaaattattttctcattcaatatttgaaaactcactgtcatcattattctttttgatatttacattagccaaaaattaactagtgagcctctttcaaactggttcctgcatctttt

SEQ ID NO: 478020 - DNA, 858 bp, Homo sapiens
gcatgttgctgcctccttctcccagctgcccgacgtaactagaaaaaactattttaaaatttatatgaaattgagggcccagggcccagatgggccagaagtggccagatgcaggcagggtgggcacctggacacctgccttgggtgccttgctgcccagatggtggcagtggtggccacacatgcggcccagcttctgtcctcacgttcctccagctcccagcccccacaccatgtcaccgcctgtgctgcccaccgagttggtgccttcagagtgcattgtggtgctgctgtcctgtgcattctttgtgctcagctcaggcctgctggtggccatgtgcaccctgtggcccgacctgtgaagccaggcacagtgcctgctgctcttcctgtcactggccaacctgctctcagctgcctcctacttctatgggatgctgcaggacttcgcaggctgtcatggaactgcatgctgcaaggtgtgctgtccaccctcaccaacaccagctcattcttctggactgtggccatcatactatacctgtacctcaggatcactagcaccgtgcaggccctgcaccaaccatctgctctgagccttccatgtcatcaggtgatcttgactttccagagttcagctgttctgagattgaagtcaggggtggagggctggtctgggggtctgggagtccacctggagtctctctgagagtgaggaaaaaccaagaccttacccagcagttcaagcatctttcaagtaagcctcactgaagagggtcagcccttccctggggaatgtcaggttttgagaatctcatggcattatgtgctgaactgtgggcaagaatcctagggctg

SEQ ID NO: 478021 - DNA, 1218 bp, Homo sapiens
aggtttgagatgaacggtaggctgatgagaggattaaaccctccaagttcctctgtgactcagtggccctcatttgttccacccaaagtgtggctgtcccagactgtcacaacaacaaatctatctgcttccttctggaagctgcttctgcttggtcatgggagtggctacggttacggctactttgacttgttgggttgccaatcctacttctttgttatctctgtaaagctgtcctggaccgtcctcatcttgggaatggtaaaaggctggagctacacagtctgtatgtcagtggggagaagaatacatttcaaattaaccaccatcgaggaaagttataattttctagtattcaataaacatgaacgaaatcattggcttatagagatgaaatatgtgaggagtaatataacatttaagaataaagtaactcgcacatacagtgaagaatggaaataccagcttatggatacagtaatatgtgaaggcagagaaacaaaacctttccatattacattaaaaaaagctcaatgaagcataacattttctcaaagcagattgcatcagcgccatgcaagcaacttaaaaacataaggtggcccttatttagtgaattacattgactgtaatgcagcatcttccaactttcttgtccatctcataaacaaatatttaaaacacaaacagtgcaaaacactgcactgtgaggaggggttgaagagaggcaaggaggctttcagaaaagtgaaccagtgtggtgtggttcagagaataatgatgggggttggggattaggatgctgtgggaaccttcacaaagcctcttacttgatcccaagggaacaggtaaggcctccaggaggaagaagcatatcaaggttgggctgtagagctgaactggtaaagttgctttgctgtcttaatttatcctagcttcctaaaatgaacgctctaataaactgtcgcttggactaaaaataaattgctgtaacaaaaggataacgaccatgctttgcaaatttgctaattactatttgttcttgtagtaaggattctctttttgtctcagaggactgtgacattattgcctctcaaaacaatgaatcatttttcactaagaagatttctccaagtgttcacttcaccttgtctttgaaattgccagccatctattctccaaggctgattagtaatgaatagaggaggacctttttaa

SEQ ID NO: 478022 - DNA, 634 bp, Homo sapiens
ccctgtaaaaccacaggggcagggatgcccaaggctttgggaggccaccccttacaccagtataacctgaatctgacaccagtgacgaaacagggacctcagtcctgcagactgaaggcactggattctaccaacacaggaaacagccaagacagttcagacctccaaactacagaacttctctggatggaagatcaaaccagccacaacattcccttatgccaaagcctaatccagagcaagcccctaactctcttcaattctaccaaggctgagagagatgccattagaaacattcgcaattcacaggagaaaggtaaaatatcaacattaatagaagtttggaagaagccgattccaactatcatgaatgactttgagggattcaagaattcagtggaggaagtaactgcagatggggtagaaatagcaagagaattagaattagaagtggaccctgaagatgtggctgaattgcttgaagatgctacgaacattgttgaaatgacaacatagaatttagaatattacataaacttagtgataaagcagcagcagggtttgagaagatggacttgcattttgaaagaagttctacggatgctataacagaatactatagactgtgtggctt

SEQ ID NO: 478023 - DNA, 756 bp, Homo sapiens
aaaatcacaaagttttccagcgcttatataccttgtaagctatatgtctacattcagtaccgaagcaggtgttatggaagactgcattagtgagacctggcctgccacaggaccaatacctggaaatagtggggtatttttgtgctcctcagaatattcacaaataggccctctggtctttgcctacaatgctgtctaccgttcttcacctctaccatatctacaaggtgctatgaagataggagacaagtacatttgcttggaaaactggtcacctaattcccaaaaggacagagctaacattatatgtctcagcatccagtccatcctagatggatttcgattctatctagggaatctcatcaaacaaccagggaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttcttttattaatgtgc

SEQ ID NO: 478024 - DNA, 1550 bp, Homo sapiens
gagggccttgcacagggacacgcctcgagtggtgagggggtgtccccaccacagacaccaggtgagggggtgtccccactagagagacagcaggtgagggtgtgtccccaccacagacatcaggtgagggggtgtccccaccacagacaccaggtgagggggtgtccccaccacagacatcaggtgagggggtgtccccaccacagacaccaggtgagggggtgtccccaccacagacaccaggtgagggggtgtccccaccagagagacagcaggtgagggggtgtccccaccacagagacaccaggtgagggtgtgtccccaccagagagacagcaggtgagggggtgtccccagcacacagacaccaggtgaggggtgtccccagcacagagacagcaggtgagggggtgtccccaccacagagacatcagatgagggggtgtccccaccacagagacagcaggtgagtgggtgtccccaccacagagacagcaggtgagggggtgtccccaccatagagacagcaggtgaggggtgtccccagcacagagacagcaggtgaggaggtgtccccaccacagagacagcaggtgaggggtgtccccagcacagagacagcaggtgaggaggtgtccccagcacagtgacagcaggtgaggggtgtccccagcacagagacagcaggtgaggaggtgtccccactacagacaccagggcccaccaagtagcccgaagtccttagcttagaactcaagcctctgtgatcccgcccagttttgtttaacccgcatggcaggcacacggggagagaggggaactggccatctgtgggccctcgcagctggtgtggcagaggcaggcagcgaagacgctctgtgtccgtgcagtgaacccgctgggtccgttctggcggccatcacacgtgctcataggctgggggctcataagcaacagaaacctgtttctcactgttctggttcactgttgtggagctggacacccgcggtcaaggcgcccccagattcagtgtctgtctgctttctggttcatcgatggcaccttctggctgtatccacgtgcggcagaaggagcaaaggaactctctggggtccctttcataagggcgctaatcccattcgcaagggctccacctccccagagccccacctcctcacgccagcacactgggggagagacttcaatatctgaatttagcgggatacactgagaccacagcaaaaccccagagacccaggctctgccctcccagtacttcctgacagcggctgcagtgtgtgctgcactggaccgcccgagggccggaggggaggcagagctcagggaaggggcgggcaccatctaacacaggagggggcccaagggctgccttgcagcagccttggctgccagcctctgctgttggtaaggacccagctccccactcctggactcccccacttggcatggggtgcatcctgggacttctgcagctccggccgctccctgcagcgggggctgataagctcctcctctccccaccacacccc

SEQ ID NO: 478025 - DNA, 1544 bp, Homo sapiens
cagccccagggcccagtcccacagggcttacttaagcgcgtgtccactccatggccgcacccgtgcatctgctgcggaacctggcgggcacaatgctaggggactctgtggacctggaggccagccaggcaggcaaggacagctcgcctctgcacagtgatttctgcgaagagttgaaggctgggcgtgacctgaagcctggggccatgggcattggcaaggcagccgctgtggctttactctgccggggccctgggcagccttgtgcagttcgacgccggccctccttctaccgcctgggggcctggctgccttcgcacgagggctccgaggcatgctcatcctacgtgactgcccgagtgtgcacacgcctggccgtgtgtgggcgtgtgcctggggcccgagctcaggagcaaggcctgcgggctgaacaggagctgggggaggagcaaggggccgttcccctgccccacagcacagcacacgaccccgccttggaacctggggcccggggtgaatcgagggtcctggagcaagaggggctgctccacaggagagcctgtcccgccacccctcagccaccagattcggggctgctggacttgttctcaaacctgcacagcagagcccggcccggcctggagagctcaggacagcgcggcttcgggccggccctgcaggagtgccgggggctgctgacggtaactcacgtggccgtggctatccctgagctgctctgggacttcctgggtttccgtcagccccctcttgaccccggagctgcccaaggacacgagcctggagacacgtgtctgatgttccgcagtgactgctgcatgctggagtctgatgtggcgggacaggcccggcgtatgcttggcgccacggtgtcctttctcagccactcggcactggcaggcagggtgtttggaacagcattgcagatgggtgtcaatgataagtcctcaatctggtccggagtcaagtcccacctcctacctccatggtttctacctgaaaaagcactgagaagactccgcagcatggctggtgtccttataaagagaggacaggtggacagagacaggcacagaggggcgcccatgaggacgcggggagaagacggtcacctgaaagccaaggggaggagctcagaggaactggccctgccacgccttgaccttggatttcggcctccagaacaagagaagatccgcgtctgctgctggagcctccggctggggtcctttgtggtggccaccccggtgaactcacacaggacgtgtgaactcacacaggacacgcaaaagtttccccagtgtctcctctggaacttcctggtgttttgaagaaggcactccatttctgaagggcactggcagcatatttctgtgtttagaacttttcccatgcatatttttgaacaagtattttaggaagataaatatcagcacgttttgctgctgttgagagggtctgtggggtctgtttagaaaatacgtgatggttctgaccacagagccccgggcatcaccggccacacc

SEQ ID NO: 478026 - DNA, 1557 bp, Homo sapiens
caccaccaccatcaccaccaccaccatcaccaccaccatcaccaccaccaacaccaccaccatcaccatcaccatcaccatcatgaccatcaccatcaccatcaccatcaccaccatcaccatcaccaccaccaacaccaccaccaaccccaccaccaccaccatcaccatcaccaccaccaccaccatcaccatcaccaccatcatcaccaccactatcaccaccatcagcatcaccaccatcaccatcaccaccatcaccaccatcaccaccaccaacaccaccaccatcaccaccatcaccaccaccaccatcaccaccaccaccaccaccaccatcaccaccaccatcaccaccaccaacaccgccaccatcaccatcaccaccatcaccatcatgaccatcaccatcaccaccaccatcaccatcaccaccaccaacaccaccacgacaatcaccaccaccaccaccaccatcaccaccaccaccaccatcaccatcaccaccaccatcaccatcaccaccatcatcaccaccaccatcaccaccatcatcaccaccatcatcaccaccatcaccaccaccatcaccaccaccaccaccaccatcaccatcatcaccatcaccatcaccaccatcaccaccaccatcaccaccaccaccatcaccaccaccatcaccaacaccaacaccaccatcaccaccaccatcaccatcaccatcagcagcatcatcaccaccatcatcaccaccatcaacatcaccaccatcaccatcagcatcatcatcaccaccaccaccatcaccaccaccaccaacaccaccaccatcaccatcaccaccatcaccatcatgaccatcaccatcaccaccaccatcaccatcaccaccaccaacaccaccacaacaatcaccaccaccaacaccaccaccaccaccatcaccatcaccaccaccaccactaccaccaccatcaccatcaccatcatcatcaccaccaccatcaccaccatcatcaccaccatcaccaccaccaccaccatcaccaccaacaccaccatcaccaccaccatcaccatcaccatcagcagcatcatcaccaccatcatcaccaccatcaccatcaccaccatcaccatcagcagcatcatcaccaccatcatcaccaccatcaccatcaccaccatcaccaccaccaccatcaccatcaccaccaccaccatcaacatcaccaccaccatcaccaccaccaccatcaccatcactaccaccacctagctactactctcgggggtctggatccttggcacgacagcagcctcagtcactcttccttcctgccgcctctgcagctgcctcctgctgcctcctacctctttctctcctgttcttctccgtagtaacactggtagctgccacccccagcccctgctggacacggctaacttcccagggcaggggagcagccccttcccacaggcatctctccctgcagagaagacgccccagaaacccacactgcagcgagggccagcgtggccccctgcctccctggc

SEQ ID NO: 478027 - DNA, 489 bp, Homo sapiens
cacccacttttccacatctgtggatgcttctgcactttgagggcagagaccgcaaggccccttccggagacggggtgccgaccagaggcccctccaagagacgggtgtttctcattcagccggctcaggctgactacgaattcagcctctgccaaaaatgccagaatccttcgtcgtggcaggcggtggtcacactcctgacccgggacttggaattcctggatggtgtgtgccgtgggggcacccgcacagacgaggccctccagggacagtggctgcccctccccaagcagccaggccaggcgggcctgccgtccacagacgctcacttcaagctgcctctgcccttgggagccctctggaatgaggggatgcagggggaggcctggcaggaggctgcctggtccttggggcaggtgaaaaacatgtcttctgcaggaggagggggtggtggagcctcagcaggcccttgagcggggcctccctgac

SEQ ID NO: 478028 - DNA, 864 bp, Homo sapiens
ggtgtctgccctgtcagaggggctcgtgctctgagagatggagcgaaaagtaaactttgcccaccaagaaaacctggtatcccaacagttgtggagctgctgtgacaccgactgctggctgccctggctccagctctgggctgacagtgacgtcatcctccagcactcctctccccagcactcctcccagtcatcccccagctgtgcttccggccctgagatcggtgccagttccccacagctgctgcaacagacggccacaaatggggtcatttacaacagcagaaacgtgtcccggctccggctggaggccagacgcctgcgatcaagggacctcacacttgggcactgcttggtcttcaggtccggaggtgaggcccagctgggctctcctggccagcagccaggagcaggagactttgctgcctgtcgggacttctgggcgccaaagccgcaggctaatgccgcctggcttcgtcagcacggggtaccttctcgagccacactaataggaaactcaccacaggactcacgcgttggccctgagaacaatggcttgtgccgccgtaaaaggttgtaatggacaaaaaaataagaagagtgtgtgacaaaggctgcaggaggcccttaaagtccaagggcagtataaccccccagggccggtgtggggctcaaacacaaccatggagctgtccactcctaaacggggcctgacaatcacaggatggcagatgcacgtgtgcttcgcctctttctgctgtaaaaatgcccctttgagtcagtttctagccggttacactgtagtatcagacacaggatctcatgtcccaccttccccagggtttcctgctcgagcggcatgtc

SEQ ID NO: 478029 - DNA, 712 bp, Homo sapiens
agcctcctgtccctgacgccgggcagggcgtgggagagctttcagtgcctgcgtcaccgtcaccgtagggacttaatgacgtttagcagctcccgggcgggtggcttctcgcgctctgcaggggtgacggctcgggggagggggggcggggccacggtcactgaatggggctcccacctgccagaggcgctgggccctggacaggaagtgttctggcagctggtgggaacagagctgcctccacccccaaattcctggtgggatttcctgtggagtctccaaggacctctgaagtggaaagctgtggagagcgaggcgtctcttcctctggggaaaaaggccttcagcgagcagaggcaggccatgggtccagggggcaagtctgtgtgtccgtgccagccgtgcacctctccctctggccaggccataggtccagggggcagacagggcctcgaaaggcagaaatcggcacagaaggagggagacaggaggatggcccaggaagagcggatggtgttggagaagctgctctgtggacgggaagagccctgtgggcccaggcctgaggacgacggagccccagggtcctggcatctcacgggcatcagtccttggatacatctcacaggaacttcggatcttcactgaaagcccctcctcccccaaccacttccgtccccagcaaacaccaccatttgtcaaggctcttaaa

SEQ ID NO: 478030 - DNA, 904 bp, Homo sapiens
attacccctgcccccagctccgcatgtcaggtttgctgccctgtcctgcctagaacgctccgcaggctgctgtctctgtaccccctcctgccgaataacgactgttggcggctctgtgggttcatgtgcttcggaattaaaccacagggcctgcttctcattgccactgatgctcggcttccaagcccccatcgccacccaccaatggctattcagtgtccgcaatgacaagaacaccctggatactcccagatcggctggctgtgatggtgctcacaggcccaggcaagagccagccccagatgggcccatagtgctgctctgcttagagccaatgcctgcaccaggcagctaccctggaggtgcccctgtgagtgggcataggcaggtacacccccagcagtggcaggtgcagcatctcgggcagtcggggggcatccgcacaggcctgggtgcaaactgcggcaaatcccatgattctgcatacaagaagggtggggacgtgtgttttccaggggaaatggtccctgtcgtgcatcagattctcaaaggggtccagcacccaaacaagtgcaggggtcactgggggacactggtgcaacagaagcagccctggactgggagtcggggccccactgccgaccagctccaccctaaaaactcatcactcaccctcgtgtttcctagcagatagtgggaagagatgcaggcccatcgtgtgcacagaggttcagagtgagcgcacttgagggcctgactagaacaaaaaaggcagaggaagggagagctggctctgagagctgagacttcatctcctcctgggatcagacagcagcgctcagctctcaggcctgctgccgtggatggaattacaccccaggcagaggaagggagagctggctct

SEQ ID NO: 478031 - DNA, 924 bp, Homo sapiens
tgaggcagacgcgggctcctgggcagcctgtggtgcatacggtcagtatgcgcagggcagccagcttatccaggacgaggcagcttcggcttttgctggataatgaaccacccctcaactcagaggtttcaaacaacacgtgtctgggtgggtctggctctcagctggtctctgcggatgggcatttggccagaagactcaatgcctcactcaactgtcctttgcttcactttcattttttccacatattccctcgagatcctaacagacacgcaggccccccagttggacctggtctcactctagatcctaacagacacgcaggccccccagctggacctggtctcactctagatcccaacggacacgcaggccacccagctagatctggtctcactctagatcccaacagacacacgggccccccagctggacctggtcttactctagatcctaacggacacgggccccccagctggacctggtctcactctagatcctaacagacacacagaccacccagctggaccggtctcactctagatcctaacagacactcaggcccccagctggacctggtctcactctagatcccaacggacacgcaggccacccagctagatctggtctcactctagatcccaacagacacacgggccccccagctggacctggtcttactctagatcctaacggacacgggccccccagctggacctggtctcactctagatcctaacagacacacagaccacccagctggaccggtctcactctagatcctaacagacacgcaggcccccagctggacctggtctcactctagatcctaacggacatgcaggccctgcagctggacctggtgtcttcttctccaacatcccatagaaagtggtcttgggctggtgccgagggaatctgtgc

SEQ ID NO: 478032 - DNA, 2542 bp, Homo sapiens
ggtgaagcgcttccggtccccgtgctggtgggactgaggagagcgccgtgctgccgttccggccacgccgtgaagcgcttccggtctccgtgctggtgggactgagaagaacgccgtgctgccgttccggccacgccggtgaagtgcttccggtccccgtgctggtgggactgagaagaacgccgtgctgccgttctggccacgccgtgaagcgcttccggtctccgtgctggtgggactgagaagaacgccgtgctgccgttccggccacaccagagaagtgcttccggtctccgtgctggtgggactgaggagaacgccgtgctgccgttccggccacgccgtgaagcgcttccggtccccgtgctggtgggactgagaagaacgccgtgctgccgttccggccacgccggtgaagtgcttccggtccccgtgctggtgggactgaggagaacgccgtgctgccgttctggccacgccgtgaagcgcttccggtctccgtgctggtgggactgagaagaacgccgtgctgccgttccggccacaccagagaagtgcttccggtctccgtgctggtgggactgaggagaacgccgtgctgccgttccggccacgccgtgaagcgcttccggtctccgtgctggtgggactgagaagaacgccgtgctgccgttccggccacgccggtgaagcgcttccggtctccctgctggtgggactgaggagagcgccgtgctgccgttccggccacgccgtgaagcgcttccggtctccgtgctggtgggactgagaagaacgccgtgctgccgttccggccacgccggtgaagtgcttccggtccccgtgctggtgggactgagaagaacgccgtgctgccgttctggccacgccgtgaagcgcttccggtctccgtgctggtgggactgagaagaacgccgtgctgccgttccggccacaccagagaagtgcttccggtctccgtgctggtgggactgaggagaacgccgtgctgccgttccggccacgccgtgaagcgcttccggtctccgtgctggtgggactgagaagaacgccgtgctgccgttccggccacgccggtgaagcgcttccggtctccctgctggtgggactgaggagagcgccgtgctgccgttccggccacgccgtgaagcgcttccggtccccgtgctggtgggactgagaagaacgccgtgaaaaaaaaaagcttggcccccagcagccagcagggactgctctcctctgggcccccacacacacgcagtggcgccccagctccacacctctttcctgcattcacgctgccccctcgcagccctcccaaagggccgccaggcacagggccatgggcatgctggtgaccgggcacagcttctccagcctggagccttcccgtccttggtgccgtcctgcacccgcagtctgtgccggggagctcagcgccctgccactccgtgtgtccagtagcccccggaccgcggtgctggcatgctgctgctccaccgtggttgtggtttggacaggactgctcacaggatcagcacagcatgctctgcctgccgcagagggatagcgacccgagagagaaggaacagcagtagcatcgtgcgtgggtgcagcagtggagcctgctggggtggagttgaagctgctctctggcaggccctctttgagcagctgacaagcaccctccgtgtagtgtccataccagcagagtgagtgccaccagctcctttgggggcctttaggccagaggtgtgcaagggtagacctgctgagctccaggagagagcctgtgtgggccagggctgctgacacggcagccacagagctggcggttagtggggcagctgtggcatgcggtggggccgaccccacagagcctccctagctggagcggcctggagcacccctggctctccacgatggccggccccgggactcgggagtggacaagctggagcgcccctggctctccacgatggccggccccgggactcgggagtggacaagctggagcgcccctggctctccacgatggccggccccgggactcgggagtggacaagctggagcgcccctggctctccacgatggccggccccgggactcgggagtggacaagctggagcgcccctggctctccacgatggccggccccgggactcgggagtggacaagctggagcgcccctggctctccacgatggccggccccgggactcgggagtggacaagctggagcgcccctggctctccacgatggccggccccgggactcgggagtggacaagcagactcctccacctccacctgtcctttcagtatttaagtggggacccgcaacgggcgggaaaggagagaccagtgctgacggagctagggacgccaacagatgtgagagccacgtctgtgcatttccaggaggccccatcatctggatgtcaggcagggaggaagggaacctgccgtggcaacccacctgctgggtgcatcctgttctctgggtgtgggacttctgactc

SEQ ID NO: 478033 - DNA, 899 bp, Homo sapiens
ccatgaggggaagtccaggcctctccacccaggagtctcttctgagtcattgctgcctccagggttatcactgggcagagagcaggtgtgatgtgtctgaggaccagcagctctgcacagagtgtggaagaccccagcaaagccacccggctgcagaatcgcagaatcaccctcgtggcaggcttggtgcggacaagtggctgtactcccgtgctggatggaacggcggcctttccgccctttggccaagtgcatgcagagactcgagcagggtgggagctgagggctgctgccagctacccctcactgcacagaaagggaagtggaggtgaggccaggagacgtgttcttcctggagtacagggccaagtcctcctttcttctcagatccactggcacataaccgcaccctggctcaatgtggccctggatgccttcagaacaatatggccaatgcagtcctcctacttttctctgtccccttttcttatctcgtatttttactctagaattatgctgggaaaataaggcttgaagttctctcatttgtgtagcactttgcaaattacagagtacttttcacaaccttgaaaggtgggtatttcatcgttcttttttagaatgaggagctgagtcatggggaccagccagggcctctctagtgaagagtcctccacaaagcagaccccaaagggccagggacccaggccgcagagtccccacaccccacggaacatctctttggggccaaggagcagcctgcattcagaattccacttctggtcccctcacccagagcactgaggcactgggctctgccctctccagatgccggcctccctgccttgctcttgttctttctcatcagatgctccgagctccttgtcattggctcctgt

SEQ ID NO: 478034 - DNA, 3621 bp, Homo sapiens
tcctcttgagagtgagtgggacctgctgtggtgagtgagtggtgagtggtgactgagtgatgagtggtgagtggtgagtggtgagtgatgagtggtgagtgagtgatgagtggtgagtgagtggtgagtggtgagtgatgagtggtgagtgagtgatgagtggtgagtgagtggtgagtgatgagtgatgagtggtgagtggtgagtgatgagtggtgagtgagtgatgagtggtgagtggtgagtgatgagtggtgagtggtgagtgagtggtgagtgagtggtgagtgatgagtggtgagtggtgagtgagtggtgagtgatgagtggtgagtgatgagtgagtggtgagtggtgagtgagtggtgagtgatgagtgagtggtgagtggtgagtggtgagtgatgagtggtgagtgagtggtgagtggtgagtgagtggtgagtggtgagtgagtggtgaatgatgagtgagtggtgagtgatgagtggtgactggtgagtgagtggtgagtgatgagtggtgagtgagtggtgagtgatgagtgagtggtgagtagtgagtgatgagtggtgagtgagtggtgagtggtgagtgatgagtgagtggtgagtgagtggtgagtgagtggtgagtgatgagtgagtggtgagtgagtgatgagtggtgagtggtgagtgttgagtgagtgatgagtgatgggtgagtggtgagtgatgagtgagtggtgagtggtgagtgagtggtgagtggtgagtgagtggtgagtggtgagtgagtggtgagtagtgagtggtgagtggtgagtgagtggtgagtggtgagtgagtgatgagtgagtggtgagtgatgagtggtgagtgatgagtgagtggtgagtgagtggtgagtgagtggtgagtagtgagtgatgagtggtgagtggtgagtgagtggtgagtggtgagtgagtgatgagtgagtggtgagtgatgagtggtgagtggtgagtgatgagtgagtggtgagtgagtggtgagtggtgagtgagtggtgagtgatgagtgagtggtgagtggtgagtcagtggtgagtggtgagtggtgagtgagtgatgagtgatgggtgagtggtgagtgatgagtgagtggtgagtgagtggtgagtgatgagtgagtggtgagtagtgagtgatgagtggtgagtggtgagtgagtggtgagtggtgagtgagtggtgagtgatgagtgagtggtgagtagtgagtgatgagtggtgagtggtgagtgagtggtgagtggtgagtggtgagtgatgagtgagtggtgagtgagtggtgagtgagtggtgagtagtgagtgatgagtggtgagtggtgagtgagtggtgagtggtgagtgagtgatgagtgagtggtgagtgatgagtggtgagtggtgagtgatgagtgagtggtgagtgagtggtgagtggtgagtgagtggtgagtgatgagtgagtggtgagtggtgagtcagtggtgagtggtgagtgagtgatgagtgatgggtgagtggtgagtgatgagtgagtggtgagtgagtggtgagtgatgagtgagtggtgagtagtgagtgatgagtggtgagtggtgagtgagtggtgagtggtgagtgagtggtgagtagtgagtggtgagtggtgagtgagtggtgagtggtgagtgagtgatgagtgagtggtgagtgatgagtggtgagtggtgagtgagtggtgagtggtgagtgagtggtgagtggtggatggactcgggccaagctccgtctgtcatgttaattgtgggtccatgatggtgtctgagtcccctggagtgggcaggagctcaggccccagacccagccattgtctgaaggtccagggcctggccactcactctgcccatcatgctgtcactccaggcagttactcaggcccgctggggaagccactggctctgacccatggaccagctcagacctcatctcctctgaagggagtggcgctggccttttcctggctctcggctatgtgtgggatgatgctggccttctcccggctgtcaggtgtttttggtgtgtccatgtcaagtgtatccgtcctgggaacacccagtccggctgccatggcagtgggcaccacgggccagcacacctttgctgcctgtgaggataggacaggtggcttgggttctgcgggccacacggtctgcagtgtgcgtggccttgacctggtgctggaaggcagctgcagaccacgagtcaaggagggggtgagactgtgctccggggaaacgtggattgtggatatgggcagccagcggggcctgcagacccctgggttagagccaagccccagaggcaccttggtttctgagaagccagaggagggagttcctgggacctgggggatgaccatggacctctgctgccacctcgtggcagggctgacgtatctgagccacgtccttttctcccggtttagaaatatcctggtgggaggcgctttttcatccttgcagcagacaggcagctctgttggccacacgatctgggctgtgtgccccgccttcagcagaggccctcaggaccctgcgggatacagcctcgagaggacagagcctcagactctgaaggccacagcagtgatagcacacctgtgtctgaggagtgcgttctgagaggagacccggcccctcgtccttgtccatccatgtggcttctgcaaagcacccttgtcttgcagagccagcgagcctggcgttgtgacctgggctaacttggtaccttttctctttttagaggcagaatcctttcttgagaacagcatctttcaactcttgacctgctcccccttcccggttcccactttttgcctggcaggctgggagggaccccctctcctgtgcagcctctccctaatcctggattccgcaggggctccaagaccctcagggtcgccagtgactcctgggtcacactggcccagcacacactgagctccagcctgatgtccagcccaggaggtcctcaactgaggtccagtacccccctgcaccacgctgtgggccccgcaccctcccccaactcttttctacaacactcttccccctgcaccgtgctgtgggccccgcaccttcccccaactcttttctagaacactcttccccctgcaccacgctgtgggccctgtgccttcccctaactcatttctagaatactcttccctgcctgcaccctgctgtgggccccgccccctcccctaactcatttctagaactctcttcctcacctgtctccctggttcttgttctggcttctccacgggaccctcctgtcctcccgtgtgatgctgactgctcgtgacatgttgcagcctgtctctgctcccttccctgctcttgtcacttcttgctggtgctctgtggctgtcatgcagactggggttggggttctgttccctctactgtactggagctccaggatctccttcccatttgggcatcagctgagggacaaggagcccttcccatctgggcatcagctgaggccaggggcggaacctagatgcctcttctaacctggcggcaatgaggcagcacacctctgcccccgctgcgatggtgtc

SEQ ID NO: 478035 - DNA, 1852 bp, Homo sapiens
acagagcttctcctgttacgtacatcttgcctcaagtgtggtgtttttggtgtgtccatgtcaagtgtatccgtcctgggaacacccagtccggctgccatggcagtgggcaccacgggccagcacacctttgctgcctgtcaggataggacaggtggcttgggttctgcgggccacacggtctgcagtgtgcgtggccttgacctggtgctggaaggcagctgcagaccacgagtcaaggagggggtgagactgtgctccggggaaacgtggattgtggatatgggcagccagcggggcctgcagacccctgggctgggagggaccccctctcctgtgcagcctctccctaatcctggattccgcaggggctccaagaccctcagggtcgccagtgactcctgggtcacactggcccagcacacactgagctccagcctgatgtccagcccaggaggcacaggcaccggcaccgtcatcctgggagccatcggggtcctcagcccccactgcagcctgagcctttcctctggccgcactgtccatttctttagctcctcttttgccttttctggggccttctccggtgttctgcgttcttttaaatgtttcatggactaatcaggcatttttcaggctatccctctgctgggatctgtctgatgcttttctcatgggtacaggaaggggctatgagtttgaggaggaagcccccagaggacatcggtctgtgcaacctaagggtgagataagattgtagttttattcaactcttacttttaaaattttacaaggactcacattgacgtagtgggtgagattagaattagactttttaactttctggcctaaaactgattgtactggcaccttttgtgaaatgacctctgcagtccccatgacccctcagggctctggatgggccccacgtggtgggggccttcagattctctgagattcaaagctctttggagagaggacactttgctggggagaaggccgctcctctgagcccctccatgggaggatcgtgaacacatagcctttcagaggcctctataatgcgccgagcagttgtgtcactgaacgtgaagaggagacctgccagactatggacagcaggctcgctgggagagcagggtggagtgaggccactgacgcgggagccctgctgtggggggtgtgtgcgcatgctcagcacagcctagggcagggcttctagtgcaggcagcgcagcacctggctctggaggccagtgaagggagggaagaaagcctggaccaggaggacaccaaggactgcccctgggacagcagccgcccctttccaccccttccccactgcctgggttggtgaaatggtagaagctcttctctaattaaatgctcatccttacgtaaatcatagctttaataaattaatcaatggtttgggaattgggtatacgaacatttataagccagtattatgatgccgaaaatgtttcatgatgaggccttcccagaaaggcggggaatcgagagtgacgtagtcaccctccacctttgtccctgctgtctatgaagaaggagtgctgtgccctctgccctcctctcccgggctcttggcagcttcccggccggcagcagtccccacgctgcccaggcggagcagcccctctgccccccactctggagctgaagccagttttctcaacgagtgtctctggagtctgtcctgccctcctgctggcttgttcttctctcctggcctcaaggaaaggcctcctgacttgcctccctgcagctggctctgctccgagggccctgatcacaggctcactgaggtgtctgtccaggccatgaggctggct

SEQ ID NO: 478036 - DNA, 858 bp, Homo sapiens
tgagaaagctatgctccgcagctcacgttacatgcacagggacttgcagaggggctccttaaggtgctccaggtcagtgccggctgcggccaggagctgacggccggcagggaggtgtagagacccggggccagtgttaaagcacgaggacctctttggcgggcacggggacaagctatgctgggcagtggcgaggaggcagctggcccctcccaaagcacaagctgcatggggacgccacccctagacagtcacagcacatgctgtgccttggaaatggacatcctagctaatcacaaatttcggacacgacactgccaggaaaagaagctgccagccgggctccaggcactgtgcggcatcttcctgagaggcctgcttggcctggccttgcttggagtctgggcccttgacaacttccacgtagacccagactcctgggccccgtggactcataacatccacgccatcctcagaggtggtgacaagcacagcacctcggcagttggctggaaccagacagtctttgtgaataagctgccaggggccaacgtgggaaagttctgagcctggcatgcacaagtagcatgctggattttttaggttctaaggttgtgctgttgtgaggcctgggaagcaaccctcagcttggcattgccttctttacagagatgcctggggggccacaggctttctctcagctttccatctgatggcattaagtaacccgcaagcaaagtccaaaactgtgaacataaaaatgctacatattgatgaatgaaagccctactgccccacagttactatgtaacatagttatttaataaccgcgaggtgggggtatctcctgcctgccca

SEQ ID NO: 478037 - DNA, 1334 bp, Homo sapiens
ctttccatccttccttccctttttctcccaagctgagggacaaggagcccttcccatctgggcatcagctgaggccaggggcggaacctagatgcctcttctaacctggcggcaatgaggcagcacacctctgcccccgctgcgatggtgtcggaggaggccggtgaaaatgagataaaagaagatctggacatgatcatcacgtcacatcacatggccaggtttcaactgcaggtcctcacacacgccaagaaccaggaagactccagttcagctgacaaaaggcaatcgacagacaccaacaccaacacccagatgacatgggcaccgaagttacccaacagggcttttaaaaaagacatcataaagatgcttcaggctctggatgggccccacgtggtgggggccttcagattctctgagattcaaagctctttggagagaggacactttgctggggagaagaccccacctgaagagcaaagttctgaaggacaagtggctgttaatgccgtgcagctggctacacccgaggcctctataatgcgccgagcagttgtgtcactgaacgtgaagaggagacctgccagactatggacagcaggctcgctgggagagcagggtggagtgaggccactgacgcgggagccctgctgtggggggtgtgtgcgcatgctcagcacagcctagggcagggcttctagtgcaggcagcgcagcacctggctctggaggccagtgaagggagggaagaaagcctggaccaggaggacaccaaggactgcccctgggacagcagccgcccctttccaccccttccccactgcctgggttggtgaaatggtagaagctcttctctaattaaatgctcatccttacgtaaatcatagctttaataaattaatcaatggtttgggaattgggtatacgaacatttataagccagtattatgatgccgaaaatgtttcatgatgaggccttcccagaaaggcggggaatcgagagtgacgtagtcaccctccacctttgtccctgctgtctatgaagaaggagtgctgtgccctctgccctcctctcccgggctcttggcagcttcccggccggcagcagtccccacgctgcccaggcggagcagcccctctgccccccactctggagctgaagccagttttctcaacgagtgtctctggagtctgtcctgccctcctgctggcttgttcttctctcctggcctcaaggaaaggcctcctgacttgcctccctgcagctggctctgctccgagggccctgatcacaggctcactgaggtgtctgtccaggccatgaggctggct

SEQ ID NO: 478038 - DNA, 1293 bp, Homo sapiens
tggagacactcatgaccaccgcctgcagccttgtgcggccagacccggttgggagcagctctggttggctggaagctcctggggtctgaagtgatgaggcctggccctgcaccccgggctcttcctgtgcacagcagggttgactgggaggaccagaggagggttgggagagcgtccgttcgtgctggcggcagctgtgtgctgatgctccaacatgctccgcctgggcatccagcacgccttaagtgagctggagaggggtgtggacgaggatgagggctctcctgggcttctacagtggagcagcctgctcagtgtccaggccccggagcccgcgttggggctgcggtcccagtgcccctgccactgtgtggctgtcggcatggtccagctggcctgtggcttcggtgcttggagggctgtggcaagggctgtctgtgcctggcgcgtggtagaagctggaattgctgggtcacagcatgcgcccaccatcaaccttcctgggtggcaccgagtggctttcctcggtgatacgggcgagcggggcgggtcatctggtgtcatgtgctctcccacgcttcctggagcaatttttgttgggctgtgtctttacctctgggggctgtggggtgtgtgctgcgactttctcctgcctctacctcctggctgatgcgctcactccactgccctttggatcacggattggccatgagggtgtccctctgggatgtgccttttcaagacctctgcccactcctctgtgagcaacccagaaatattctctgcataggaaccccttgtcattaaacaactgcatgtaccttgtctcacttgtggcctgtatttctgtcccctcacagtgtcagttgacccaaacaaaatcttaattctaacgtggtttatcatttcagcctttttcttaacagtcagagctttctggtgtctgaaaactctgcccttctcccccgcctcccagctctgtgtaaatctcccctgcctcccagctctgtgtaaatggtgtcctgtgctgtctttcagacgctgtgtcgtttatgcttccccttgagacgcacagcacccaagtccccgtgagggtggattgatgagggggttcaggtttcattttattcacctgcccgtgcaggggaccacgcgctgggtactgaaaggccttccgctctgcccatgtctgtgcgcacctgtttttcatgaccttctgttgaattattccatggtctacatgtctggtttttgttgttgttgtcgttgggttttcttgtttgtttgtttttt

SEQ ID NO: 478039 - DNA, 992 bp, Homo sapiens
gcctcctgctgtgattaggagacacagagattgttctctctctgcaagtggacagagaagaggccatgtgaagaaatgagaaggcagctgtacgcaagccagggagggaggcctcaccagaaaccaaccctgacagcaccttgaccttgaacttctagcttccggaactatgaaaaaattagtttctgttatggaagcctcccacgggcccccagcactactgtggaattccggccggaacacacagcctggacctggtcatgagaaacggccccacaagcccaacttgagatgcattttacagaataagtggcttaaacgtctcaaaaacgtcaaggtcaggaaaggtcaaattaaaggagacaaagaggtctctgctgaaaacaacgaccacggaggccctgatgcctcctacctgggctgtgaccctggcctagggctcctcgcacctcctgcaccccacagcctccgggccaggctccggctcccacccagtccctgcagccaagggaagccgctgcctgcaggcctggagggctccctgttccagctgctccctcactggcctccggcagggtcaggacagagagggggtggcaaatccactgaccccagcggaagcctcgccagagtctcccaggcaccggtggacccaggcatctggggccagcggggaggccacggaaaggggacagtgctggctctgggcccctcgggggaccgtcctgcactggtgcccatgggcagcagagggcgcccctgaccatccctccatggcgtccgcaggagcctcaccagcctcagggtccaggggcacccacccagctgtcaacctagctgtctggagtgagcttcagtgggaggggaggagggggcctgcgattgtgcagggacgaggctgggggagcagagactccagaaaccgtgtcccacaccccgcactgcccctcactgtgcagccccagcctccctcctagagccccccagctgct

SEQ ID NO: 478040 - DNA, 573 bp, Homo sapiens
tgtcacttccccaggagacctatgggaagggatggtcgacgtgcaaaccagccatcaaaggagctgcccccactccgcagctgcaccaacgtgccatctcgccggctctgtggtcagacgcctggtcacggctcagctggggcctgtgctggggtctcagcggcaccaacgtgccatctcgccggctctgtggtcagacgcctggtcacggctcagctggggcctgtgctggggtctcagcggcaccaacgtgccatctcgcctgctctgtggtcagacgcctggtcacggctcagctggggcctgtgctggggtctcagcggcaccaacgtgccatctcgccggctctgtggtcagacgcctggtcacggctcagctggggcctgtgctggggtctcagcggcaccaacgtgccatctcgccggctctgtgcataaaaaatgcgttgaaaaggccaaatatcatttgtctgaaatatgaatgtgtttaacttttccataaagagcaaagatgattggattgggtttggaaactgtgcagcccaggggtgacccggagaggtccgtgaaggac

SEQ ID NO: 478041 - DNA, 1177 bp, Homo sapiens
cctcactgcctcatctgcgacacatgggaaggcagaggatccacttcagaaggtggctgaaccaggacattgaggcgtgtgaggtaacagcctgcaacaccgtccacacgggtgtgggtgatgccatcacccccgattccccagaggagggggcagacgcagacgactccaagctgggaccaaccacctgctcagtggagtcatcaacaccgccggctgtggacccggtgctgcgtttggatcccggccctgtgcctcagttaccccatgggtccagtgagagcaggcacagcctgtctggccagccgctggggactacacagccccagctgtgcaaaccgccaccagcgggcccaggaccccaggggaacaagcgtggaagcgggagcccaggctccgagggcggggtttctggggacgccgaggctactgagttcaccgctggctggagcagaacggacggcagcagccagaaccccacccttgagggccttcgagctctggggcctgttgcaggttttgaaagctcctcctgctccagggtgaatgccgaagtgcttttcattttccgggaagctggtttgggagacattgttacattgcaagtattgccaatccgagtcctccagaaaggccgcgaggaagctcatctccctcacggaaggaatgttcgtgcgcagctgcgagtggccctcatcctccgccatgtggtgtttgaacaaagtgttttgtttggtttttgtagcttccagatcacagatgagcaaatggaggccctgacggctgagatctgagtctatgcaggaccagggtctgtatgctgtaggcagtcctgccctatattcacctgggtgcagaactctacaatgtggcactcctcaaaagctttctgctacatggggtgctggcggagggtattcatgttgtgaaacactaagatgtacctggacttctgaagtccactttgctatcccccagacttaacccctccacagcctcagcattttctcttccctcccacatttcccctagtgactgtaaactcttcagttcatttaatttagggaccatagcacctactctgtacttgtgaagaattgtcagtgatttctggtttagggagctgggtgaagccccctgtctcactaccctcacacccaaggatatgaaccacaac

SEQ ID NO: 478042 - DNA, 1305 bp, Homo sapiens
gacacgcactggggcctgtcagggtgtggggttgggggagggagagcattaggaaaagagctaatgtgtgctgggcttcatacctaggtgatgggttgcttctgtgtgtgtttctgtgtgtctgtatcgtctcctcttcttacatggacaccagccattagattagggccacctaatcccatagagctacaggacacaggacgtcctggttcctggagcattgactgttctgccctcgtggccaccagcctcccagcagatgaccaggaagtcgctgtgagcatctcacggggatggagaagcacattcagtgagtgtcaggaggatgtcagcctagactggcaactgcagcctggtcccgggcccggggggacggccgtctccaagctcactcggctgacagccaacctgttcccggttcccggcagctttgggactgtgtcttctggggactgtggccaggctcagccctcacccttggcaacagtcccccagcccctcacaggagtccccaggtgcttccaaccctacaacttctcttctggccccactcgaggacctcctcccgagctcagacacagaaggcctgctctgcagaaaacatgggtgtctgaccattaccagtcactcactaatagcccaaattccttcctgataaatgtgccgtgacacattcacctggacctagccaccttcggaacattttctccgagtgacaaatatgactgcacggcccgggctctggaaagtgtgtcatgtacaggaacggccgaggtcgtttagctggcgtgggggtgggcacggccctgcatccccccagcagtgaggcagggacagactgtgaagcctcccccaggccccactgaagaccccccggtccccaaccctagggactgaggggtgggcccagagcagggacaggggagcctcagggtctctgcagctggggcctcccagcgctccccctggcaggtggcctgggccagggcagctgactcagagccccggatggcagggaggcccgaaccagctgtggcacccacggccgcacccgacagccatggaaacttcccgacagcagtcgctgtttcacagctgaggaggagaggggagcagcccaggggccctgcagcaggtgccatgtggactcggcccagccgtccaggaccggaagagcaggcgcagccactggagggctacggattccagggcttagaaggaggtgccggcggctcccagggagcaggccatttgcttgttctcagcagcccctaccacgggacagtgagaaccttcacaccacac

SEQ ID NO: 478043 - DNA, 782 bp, Homo sapiens
cccgccccgccgccaggaagcgctgcggccccgcggatgggaggagggggccgggggcacgggagggggatgggagggaagcggggaccctcgagggcgggaggctggaggaggtggagagggtggggacccccctgcagcccgggccgagctcccccgccagcccctgcccgctgctgctcggacttcgcgtcccgggcccggccgcccgtcgcccccgccccatttcccggacgacctggctggggctgtgtccgcctccggggccctgggtgttggggaccgcgccccgcacgcagggccgacgggggccctgggactcgccccttggtagcagctgccctggggggtgcagggttccccccatcagccccccgacccctcccctaccccgtgtcctgtgtccggcttgctcaggcctcccgcgagaggccccgggtcaggagctcctgcagaaactgccgctcctggggcctgagggtggggagccgggagggcagggacagcagagcctgggcgcggaggttggggcagagcctgggcatgcggcgagccacccctgccacccctttcccgctggaaaccacagagcttgcagaggggcccctcctgcccttggaagccagcacttcctctgtgctggaagatgctccaggggcctcccctaccagagcagcaggtgccctcactgggggctgctccaccttgtctcttggctgccagcagtgactagggagaaagtccagggtaacctggatggggacctgctaggcctgaccagg

SEQ ID NO: 478044 - DNA, 1894 bp, Homo sapiens
atcccacctccgcttcacccagaagctcagtacgtaggagtcagtccctgccacctgacattctgggacatggctaaggaacttgatgaagaaaccaaacagtcccgtgacgtcttagcaagctagcaacgtggcctgagctttgctttgctgttggatgtgagctcttccactgcaggcggcctgcacctgggctgggcaggaacaagtccaaccgcaggtaccctggacgtgagccttgatcgtcccacgtgtggccagggggcctgtgagggtgcacgtgcacacacatgcacacacagacacacacgtgcacgtacaccagcaggtgcatgccctgccgctgaacccctgggggagggacaggcccagtcacaggggcaggcaccagaggacaaggccacggagggctccgcatggcttcggctgctgccctgcagtcggtcccagcctcatagcacttgccaggtggagccgctccgaagtcttaggatccagggatgggaaatgccagcaagaccagtgggaggtcattagacccgcaggagcgcacgtgactccgggaagtgggatgggaccgtgttgccggaaaagccggatgagcaaaggcgggcaagcccaaggtgttcagacccggccggagaggtgggagacggggaacacggcagctgcacagctctcccggggagagtccgcgtgtggtgggagggacccagcccgactccctaggagctggttttcatgtttggggcccacgaagaccttgagctgccttcaggaaggattgtcacgcggggcaggaacaaacaggaaggtggctgccacttccagcggcttcacggcagagcttgtgcaatcgcaggacacagcctggatggccgaagacagcagggcagctgtgaacggggccctgccacaccctgcctccgagtgtgtggggtctgtacctgctttgcccccactggccgctttctccaggacagccatgaacatctccagtgtcctcggagcaaggaaggaatgcttcctggagcagaagtggccacaatgacgctaggtcagcagatggccgcagaggcctgggcagccggtttccacgggagtcttggcagtgacccgtgcacggaggagacgcgtgccttcctggccccccagtttggattcctggtgcctctaaggtctgctgatggcagagctgcacccggggtgggcctgtccacacccgcccccgaggtggctcttccgtctctcccgcaggtgcaggacttggtacaaaattgcgagggatctttgaaactcccaacagcagcccacatgctacccgatgaggaagccggggaccagaccaaggacactgaccatgcccaagccggggaccagaccaaggacactgaccatgcccaagccagggaccagaccaaggacactgaccatgcccaagccgtccagctagttcagagtcaagtggaaataaccagggcgggagcacagagagccacatcccagtggctccagatcctggtgtcggacagctgggtgcttggggaactgccgttcattcacagggctttgcggctgagctcagaacttgatcttgactttgatgggtggaaggaatgggtcatgctaatcttctctatcatttccactttaggatattgccacggtttctacaggactgaacaaagggggaccaacgcagaaatgaaaacttaaaacaaaagtaagtattttaaaggaaggggccaggggaagaagaagagcactcgcagcttccggttttgctgaatttcttgatctgtaaatcagtatttttcaccacgtgtttggatttggagccatcattttgcaaaaatgtttccttcctagactcatactctccttctggagctcc

SEQ ID NO: 478045 - DNA, 783 bp, Homo sapiens
tgaggtctcgtgctatctgcttgtgtaaagcatgtgacacctccccctctctcttgctcccactgtcaccatgggaagtgcctgttcccactttgccatccaccgtgatcgctcaccctgggcaggaagagcccccgaccctgggcaggaagagccccccacaccgaggagaagcctgtgctcagaggggccccaggagccttctacgctggcagccgcccatggcccttggcaccagaaaggaaggcaccgcacccttggtcccctcctggcccagcccagcacctgctcttcctccagaccccagcgcagcttgacttcccagcccctcattgctggccttttgccgggcagccagtccctgttccctgccatggaggaaccctccctctgcccagcaggcctgccttctggcctcacccctgtatctctgcagggtcccctggctatcccaggttcccaaagaacccgccctagcccacttggcctcggggccgcagccctgcctggtgggtccacttttcccagagacttggctggctttctcccagcgtctgcccagggcctgccctggagcaggtctggacacacccactgcatggacaagagaaacaacatggctccctcagcctctccacccggccagagacaaggggagcaggccccagatgtgctgatgggttagtgctggggaaaggtgccaacccttgagtgatagtaacgtgtgcagaaaacacacagggagtctccaggtcagagggcctctgcaggcacccccattcc

SEQ ID NO: 478046 - DNA, 536 bp, Homo sapiens
tcaaggtaatgtcatcagttaaggccattttcacttcttttgtgattcttcagttacttccgaccatctggatgtatacgtgcagtttgccgacacctggtctagagcagggcttcaggctgagggaacagacatgtttcttttcatctctggagtccacagagtcatctgcattctggaaatatacagcagaactgttcttaaaatgtgaaaggacagcgatggatgccacgccagggcctggctctgacctgccacaggaatctgaaccatctgcagcaccagccggtggggaggtcctcggagttccaaagtttgcctcagggatgtggtgtggagcccagagcctccagggtggaccaggttctgcccctgagtcgtaccaggaggctgagcccagccatgcagctcagctgctccagatgcctgagcctcagaaaccgggagacagcgatgtctattgccctcccaatcctgacgagattaactgagagtctagcaccttttaaaggtgtgaataggaaacattcgtcatc

SEQ ID NO: 478047 - DNA, 1134 bp, Homo sapiens
tctgcagcaggaggtggtgcagcaagccggctgacagctagactgctggcagcatgaagtggaagccccagagcagacgggcacacagcagatgggtttgcagcagacaggcttgcaacagacaggcacgtagcaggactgctggcagggggaggaggtgcagcaagtcggctggcagctagaatgctggcagcatgaagaggaatcctcagaacaggtgggcacacagcacacgggcttgcagcagacaggcacacagcaggactgctggcaggaggaagaggcacagcaagttggctggcagctagactgctggcagcatgaagaggaatccttagagcaggtgggcaggcagcacacaggcttgcagcagacgggcacgcagcaggcctgctggcagggggaggaggcgcagcaagccggctggcagcacgagggcgtgcaggagctggtgcagcctgattggcaggggctgggctcacaggccgcctggcagcaggggctggacacacagctcactggggtgcagaccagggtcaggcagggggcggtgccgcaggggggctcacagcagctctctgggcagtcgtccactcgccaggagtcagagcaagcgctggagcagacggacatggtgcacgcggccatgctggggtggggaagacgtgagctgggagctgggggaggtgtgagaaatgacaggaaagccaggaaggctaggatgacgtcatatcagcgggtgtgctacagacatgcacggcgcagcaaaatcaacatacaagggacatacctcaatgtaataaaagccatctatgacaaacccacagccaacataacactgaatggggagaagttgaaagcactccctctgagaactgcaaaaatacaagagaaagaaataaaaggcatccaaatcggtacagaggaagtcaaactgtcgctgtttgctgatgatatgatcgtacacctagaaaaccccaaagattcctacaaaaagctcctagaactgataaaagaattcagcaaagtttccagatgcaaaattaatgtacacaaatcagtagctctcctatacaccaacagcgactaagctgagaatcaaatcaagaactcaatcccttttacaatagctgc

SEQ ID NO: 478048 - DNA, 2194 bp, Homo sapiens
tttattagaactagagggggtgctgcccagggtggaaccaggcctgctggggacaaagagcctgccccatcttctgagggtgtcaaagccagagagggcagagcttgctggggcagctgggaggtcagcccctggtgggaagggactccggatcacatccagggctgtcagcagctggacttctggccagagcagaggctgtagcaggcagggcgggagcacatggggcggcagaggagggaaacacaggaggccgtgcggcagcagctgggctggcaggaggaggcagaggcaccacaggaggggacgggcacgcagcaggtggacttgcacacagggtggcagaggagggacacggaggaggaggatctgcagcaggaggcggtgcagcaagccggctggcagctagactgctggcagcatgatgtggaagccccagagcagacgggcacacagcaggcgtgctggcagggggaggaggtgcagcaagctggctggcagctagactgctggcagcatgaagaggaatcctcagagcaggtgggcacacagcacacaggcacgcagcagacgggcacgcagcaggcctgctggcagggggaggaggtgcagcaagttggctggcagctagactgctggcagcatgagggtgtgcaggagctggtgcagcctgattggcaggggctgggctcacagaccgcctggcagcaggggctggacacacagctcacacagctagactgctggcagcacgaagaggaaatcccagagcagacaggcttgcagcagacgggcacacagcaggcctgctggcagggggaggaggtgcagcaagctgactggcagctagactgctggcagcatgaagaatccccacagcagacggacacacagcacacaggcttgcagcagacagtcttgcagcagacgggcacgcagcaggcctgctggcagggggaggaggcacagcaagccagctggcagctagactgctggcagcacgagggcgtgcaggagctggtgcagcctgattggcaggggctgggctcacaggtcactgggcagcaggggctggacacacggctcactggggtgcagaccaggctcaggcagggggccggggcgcagcaggggggctcacagcagctctctgggcagtcgtccacctgccaggagtcggagcaagagtcacaggaaccaggaaggcagacgcggctgccgtagctcaggtcgctggagcagacggacatggtggacgcggccatgctggggttgaactggtggagggtgagggagtgagcctgtgaggtgctgaggctctcgggcttttattccacctggccttgttgtccccgggcccacagcttccccttccgtgttgccgagagctggagtctgccgggattaggggtgtttgttcgcccgtgatgtgggccagctcataaatctcccatcacatctgggctgtgtcccatcccatgtggatccctggcggcaggaattgggcggggcctggtcccagctgggttcggggagctgggagagccacaggtcgcggcatcgtccacccctggccccagcagccccgggacacagagtccctctgcaggaagccggcctcaggaagtgtccttgtggtgaaaacccctcatccagcgtggtccttcccccatcaccggacacaggactgtggccatcttctgagggacaacctggggcccatgagccttcattgacctgccctgggccatggcatggtgggggtggggggcagctgtaactgtgcccagacctcttggctttgagctctggacgacttctcatccccacagcctcttcacctccggccctgtttcgtgtccacctcgtctttgtgttttggaggcagcaggacctgtgtgttccagggcaaggacggtgggcttggcccctccctgcttggacagcatgacagccttctgggctgtggttttgggttctgaacctgcagagtaaccgtgctgagcagcgggcggtcagcagccctcgtccccgcctggggtggctcctctgtgtgctctgcttctccgaggctgcccgtcagcccccacccagcctcctgctgggcccatttcccagccctgtcttccaagccctgtgccaggcctcttagtgtcaccaccttaaaattaagggacatctgtccaaagaaccc

SEQ ID NO: 478049 - DNA, 1368 bp, Homo sapiens
cccagttggtacctgtctaccctcatttctccccacaccgggctatggcctgggagcacccgctggccttgctggggtcactgcccacctgttgctggggaagcagggctggggtaaagaatccaggggtgcaggtggcagtgagcactcaggctttggatgatcttaaggagatcactcagcagctggacttctgggttgaggtggggccacagcaggccgggcgggagcatgcggggcggcaaaggagagacacacaggaggctgggcggcagcagctggcctggcaggaggaggtgggggcgcagcaggaggggacgggcacgcagcaggcgggcctgcacacggggcggcagaggagggacacggaggaggagggtctgcagcaggaggtggtgcagcaagccggctggcagctagactgctggcagcatgaagtggaagccccagagcagacgggcacacagcacacaggcttacagcagacgggcacgcagcagccctgctggctttgggaggaggtgcagcaagctggctggcagcatgaaccggaatcatcagagcaggtgggcacacagcagacgggcttgcagcagacaggcacacagcaggcctgctggcaaggggaggaggtgcagcaagccggcttgcagctagactgctggcagcacgagggcgtgcaggagctgatgcagcctgattggcaggggctgggctcacagaccgcctggcagcagggactggacacacagctcacacagctagactgctggcagcacgaagaggaaatcccagagcagacaggcttgcagcagatgggcacacagcaggcctgctggcagggggaggaggtgcagcaagctgactggcagctagactgctggcagcatgaagaatccccactgcagacaggcacacagtacacaggcttgcagcagacagtcttgcagcagacgggcacgcagcaggcctgctggcagggggaggaggcacagcaagccagctggcagctagactgctggcagcacgagggcgtgcaggagctggtgcagcctgattggcaggggctgggctcacagctcaggtcgctggagcagacagacatagtggacgcagccatgctggggattgaactggaggagatgggaaacacctcctccgcaaaaagcacagccactctcaacagcactgccgtgtgaaaagcagcaagcactgctttcgcttgcagtgtgttttcttgattgccagctaagtccttggtcaccccagctagacatctgatctaagtctccatttcttctgcaaataatatccaattggccaccacatctttttggttgtttctgctaaatgtttccaattgtatcc

SEQ ID NO: 478050 - DNA, 1252 bp, Homo sapiens
ctgagccttcctgggagtgaccgtgagtcccacctggtgaccccctggaggagttaggccactgtcccttgtgacttctaggttaagtaactcactcctagaaacggtcatggctggaggagaccaatgtcagctcaaaaccgtgtgtcctcccaggagaacaacaggaaaagagaatcaggtgaccaaggagagtttattggggagaccggagccggctggccctgggggacgtgcccatcagcagctggactcctggcctgagcagaggcctcagcaggccaggcgggagcacgcggggcggcagaggaaggacaggcaggaggccgggtggcagcagctgggctggcaggaggaggcagggacacaacaggaggggacaggcacacagcaggcaggccggcacacagggcggcagaggagggacacggaggaggagggtctgcagcaggaggtggtgcagcaagccggctggcagctagacttctggcagcacagagaggaagccccagagcagacaggcacacagcagatgggcttgcagcagatgggcacacagcaggcctgttggcatggggagaaggtgcagcaagctgactggcagctagactgctggcagcatggggaggaagctccagagcagatggacacgcagcacacgggcttgcagcagttggacttgcagcacacaggcacacagcaggcctgttggcagggggaggaggtgcagcaagccggctggcagctagactgctggcagcatgaaggtgtgcaggagtcggtgcagcctgattggcaggggctgggctcacagctcactggggcacagaccagggccaggcagggggctggggcacagcagctaggggtacagcagctggaggcacaggagcggggctcgcagcagctttcctggcaattgtccacctgccaggaggagccagtgcaggtgctgggggaggagactcggctgacacggcccacgtcactggagcagacagacatggtggatgcagcaatcacatacgtcctggtgcagcaggcgtcagccatggtgggtgctggactgggtggtgtgagtgctggtgtgaggtgtgtggactattttggggaagatgtggaacattaccagagtcctaaatgatcccttatgctatctctttgttagtccctcctccctaagtattagttgctgttctaccttctctcctcattggttagctttgcgtgttctatggaactcttttgtttt

SEQ ID NO: 478051 - DNA, 1170 bp, Homo sapiens
gtccttgcctccagaacccagctgggatcaggcccaccccaactcctgcccctgaggttccacatgcaacagactatagcccaggtgtgacaggagatttgtgagctgggcaatgtcaccagcaaacaaacatccctaatcatggcagacgccgcctctcagcaacaaggaaggggaagctgtgggccctggaacaacaaggccaggagggctcacctcctccccaccccagcatggccgcgtccaccatgtccatccgctccagcgcttactccgactcctggcaggtggacgactgcccagagagctgctgtgagcccccctgctgcgccaccagctgctgcgccccggccccctgcctgaccctggtctgcaccccagtgagccgtgtatccagcccctgctgccaggtgacctgtgagcccagcccctgccaatcaggctgcaccagctcctgcacgccctcgtgctgccagcagtctagctgccagccggcttactgcacctcctccccctgccagcaggcctgctgcgtgcccgtctgctgcaagcctgtgtgctgcgtgcccgtctgctgtggggcttcttcgtgctgccaacagtctagctaccagccagcttgctgtgcctcttcctcctgccagccggcctgctgtgtgcccgtctgctgcaaacctgtgtgctgtgcgcccacctgctctgaggattcctattcatgctgccaacagtctagctgccagccagcttgctgcacttcctccccctgccagcagtcctactgtgtgcctgtctgctgtaagcctgtctgctgcaaacccatctgctgtgtgcctgtctgctctggggcttcctctttgtgctgccagcagtctggctgccagccggcttgctgcaccacctcctgctgcagaccctcctcctctgtgtccctcctctgccgccctgtgtgcaggcccgcctgctgcgtgcccgtctcctcctgctgtgcccccacctcctcccgccagcccagctattgccgccaggcctcctgtgtgtcccttctctgccgccctgtgtgctcccgcccggcctgctacagcttctcctcaggccagaagtccagctgctgacggtcatgtcccccagggccagccgggctcaggccccacctccctgccagtccttgga

SEQ ID NO: 478052 - DNA, 613 bp, Homo sapiens
gcagtcatggaatatgtggtctttgtgtctagctttgttcactcagcatgttttcaagagcctgcagttcagccagaggatgcccctgcccacagaatgtgactggaaagcccctcatcaaggtctccaagaactcccattcctaaatcctgagttggtttctatcactgtgagtgtgtgtaccacggcccctgaagccctaggtcactctccataccactcaggaagcctgtgcaagatgctcctgacccccgcgacagccctgtggcccccactttccctgcacccatccctgtgtggcctgtctcttccagcacagctgcctggcctgcgctccatccccaccttccccttctggaagcgagccgtgcctcctgcggtgggaccagtgtgggggtcctttgtgcccacagggtatggccgaggcccccaaacccgactatgctctcctaaggcgagaagagtgggcggcatcgcagccccgggtcaccagtgtggggggtgtggaaactacccccaggaggcctccttcctgctgtctggtctggacacattcccacactgtcctgggactcctctgtcatcgccgccctgagaccttcctgttcccacc

SEQ ID NO: 478053 - DNA, 997 bp, Homo sapiens
tcacatttgctttcaaagcctgctgtcttccaagtgtttgatctcggaatgagagacactgtcctgtctgcctttaacaagacagccaggcgggagcttgcggggcggcagaggagggacacgcaggaggccgggcagcagcagctggactggcaggaggaggtgggggcacagcaggaggagacgggcacacagcaggtggacctgcacacggggtggcagaggagggacacagaggaggagggtctgcagcaggaggaggaggaggtgcagcaagctggctggcagctagactgctggcagcatgaagaggaatcctcagagcaggtggacacacagcacacaggcttgcagcagacgggcacacagcaggccggctggcaggaggaagaggcacagcaagctggctggcagctagactgccggcagcacgaagaagcagccccacagcagacaggcacacagcacacaggcttgcagcagacagtcttgcagcagacaggcacacagcaggcctgctggcagggggaggaggtgcagcaagccggctggcagctagactgctggcagcatgacggcgtgcaggagctggtgcagcctgattggcaggcgctgggctcacaggccgcctggcagcaggggctggacacacagctcactggggtgcagaccaggctcagggagggggccggggcgcagcagctgggggcgctgcaggggggctcacagcagctctctgggcagtcgtccacctgccaggagtcggagtaagcgctggagcagacagacatggtggacgcggccatgctggggtggggaggaggtgagctgggggaggtcaccctgttcttgtttcatggagtgacagcctctttgtttcctcacatctgcatcatcgcttgttcagactttgcttctctgtcatgctgtgatttcctcacatgtctgaggacccttagttgtcattcacatttttaagtgagggtctagattgttt

SEQ ID NO: 478054 - DNA, 691 bp, Homo sapiens
gttaccactgtgccaaattatactagggcttgaaggttcaataagtgactcatcctgaagtcctgaaccagctcggacagagaagatggacgaaaacatcagccacaagaaactaacctcaaggccgaagctatttatggtggagcatgacgcgggaaagtacacgcgggaaaataagatgttgggaaacacagtggaaacaaccacaaggaagacaacagttgtgtttttgtgttacccagatgacaggacccagctgctccccagcctgccagccaacctgctgcatacacagcccctgccaggcatcctgctatgtgcccgtgagctgccagtcctccgtgtgcatgcccgtgagctgcacgcgcattgtgtgcgtggctccctcctgccagccctccgtgtgcgtgcccgtgagctgcaggcccatcatatatgtgactccctcttgccaatcttcggggtgctgccagcccccctgcaccactgccctctgcagacccatctcctgcagcaccccttcctgctgctgaccagctgctcctggtacacgggggtacacacctgtatccctccgtgaataagcatctggtggacccccagattgcacacatagggcagatgaaaagcatgcccaaggaaacctctgaactctggggtgagaacgtggaaaaatgattcagaccttcca

SEQ ID NO: 478055 - DNA, 1032 bp, Homo sapiens
gaagagctagaagatacgccattccacccggagtgtcctcagcaggtttattcgatcttcatgctgcaccggctcacgggaagctcttcctccgtccactgtgaccatgccgccgatactctacttcaggcagctctgtggttgactactggcaacattgctggagctggccttttgttttttggtggaggtattggtggcactatcctatatgccaaatgggcttcccatttccgagaaagagtagagaaaaccataccttactcagacaaactcttcgaggtggttcttggttctgcaccttataatgttccattgccaaagaaatcaactcagtctggtccactaaaaatctctagtgtatcagaagtaacaaaagaatttaaacagcctgcctcacaactccaaaaacaaaagggagatactccagcttcagcaaccgcaggtgatacagtgttggtccctggggttcagcatgaggaatctttaaaaactgatcaccctgcaattgatgaaggaaaacccacacctgcactttcagaagaagcatcctcatcttctataagggaacgaccatgtgaagaaattgcagcttgccttgcacaagaggaaaaacaagaacaagttaaaactgagtctctagccaagagctttgaagatgctctgaggcaaactgcaaatgtcactctgcaggcgattgcagctcagaacactgtggtccaggctgtcaatgcacactccaacatattgaaagccgccatggacaattctgagattgagggcaagaagaagtctgctaagtgccacacagtgcaagaaacgaaacagataatggaaatcctgacagcatatgccagcgccgtaggcacaagaaccactcaagtacagccagaggactccaattacatccataaatgaggatttgatgttttgctcttgtctccctccacccttctctttctctttctctttgtgttttaatttggtcaatttacatttacacgttttcaaattcaaagcttccacacctgg

SEQ ID NO: 478056 - DNA, 992 bp, Homo sapiens
acaccaagtgggtcatcgtggcggggcaggaccagtgctatgaactcgctgcgcggcgcgggggggctcctgctctccagccccctccctatgcggacacccagggcgggccccagcggggtctgtgctctgtctgggagcagggatgtggccagtccaggccctgtgtccgcagatcccaaagggtccagggagcctggccgggggcagaccagggcatctccatcctgcttcaggcgctgggggagcacgggcagggcggggtcgccgtcccacgccatcgcccctgagccaggcttccttctgcgccctgactctgcagggactgggcgggagaggtgcgcccgcctcccttccctagttctgggtgattcacatcaaacaggaggcgtctttgttcctccctggctcttcgctcccacgcgggcctttccttgctcctcggaggccgcgaggcgtgagcaggcccaccagaaagcctcgccaactgaacgtcggcttcctttccctaacgagctaagaaaactcggtcgaatgcttgcaccgatgcagatgttggtggaaatctgtatggtggtgtctggtccaggggaaaaacagaatatctaagggcttggtaaaacataattttaacatacatctagaaaacttgggtattcaaaagactcatagataaactcatgagaaaaggaagaaggacagaacacaaaaatatgcaacattaaatatgagaaaacagaattgcagatgcagaagagatttattttaaggacattttatgttaattatttgttaataaatttgaaaatttggaggaagtaggtgattttccagaaaactatgtcatcactattatctcatgaaagagtaaaaaaccagaataaaccaataatcataacagaaatatgaaagtttaaagcatttaccacctgaagagtccccagctggaattgaaatgtagagtgtatattagctatttttatgggatcaac

SEQ ID NO: 478057 - DNA, 803 bp, Homo sapiens
gtgtgagcatgagtgcacgtgcatgtgttttcaagtgtaaaacacgaggagatgtcagtcgggtgccactgctaatgaggcagcccacaactggtctcgacgtgcgtctgtgcctgtaaaagatgaaagtgcagcagcaccctgagaaatcacacatcttcgccgtcagtaccgctcagggccccagctacctgttctgcgtgtctgtggctgggctgtgtagtagaatcccgtgtcaaagcacccaccctcagaggctcctgggggaggcccggttctgtccagcagcatgggagagagatggtgctgatgaagaggacaacacggggctgtctgcagagcacctgccacgcgccaggctctgtgtccacaagcacggcggctgctcccacatgacggagctcgtgcggcagctccaggactgtctggtgccagagccccagctctccgccagccccaggccactgtgcgaggccctcagtgaagagggggccgtggctttgactgcaggatgcacgggctcggggtcggtttcagtcaatccttgatttctcatcgttgcagcttctcagaggagtcagttcacaacgagcagaacagcttcctggagaatcctccacacaggaggtaaccatggaaaaagtgtctacatatggctctgatatgaaaaactaagctctggacttaaaacagtgtagcagtccataaaccagagaggtgaagtgaagagacccacctgagtgtgtgcagcagcagcccaggccgtctgtgccctcctcatgctgaagacctttccagagctc

SEQ ID NO: 478058 - DNA, 995 bp, Homo sapiens
tggacccctctggagtgggctgaatggtgacccctcaagatgtccacaccgtaaccctggaacctgtcaatgtggcttatttggaaatagggtttttgcagaggcacctccagaagccagaagaggcaggcggcccctccacaggaccctgtgacccccagacagacggtccctccgcaggaccctgtgacccccagacagacggtccctctgcaggacgctgtgacccccagacagacggtcactcctcaggacgctgtgacccccagacagacggtccctccgcaggacgctgtgacccccagacagacggtcactccgcaggacgctgtgacccccagacagacggtccctcctcaggaccctgtgacccccagacagacggtccctccgcaggacgctgtgacccccagacagacggtcactccgcaggacgctgtgacccccagacagacggtcactccgcaggacgctgtgacccccagacagacggtccctccgcaggacgctgtgacccccagacagacggtcactccgcaggacgctgtgacccccagacagacggtccctcctcaggaccctgtgacccccagacagacggtccctccgcaggacgctgtgacccccagacagacggtcactccgcaggacgctgtgacccccagacagacggacgctgtgacccccagacagacggtccctccgcaggacgctgtgacccccagacagacggtccctccgcaggaccctgtgacccccagacagacggtccctcctcaggaccctgtgacccccagacagacggtccctccgcaggacgctgtgacccccagacagacgggggcaaggaccctccacaaagatgaggtgaggtgttgacacagtattaggggcacatatcttaatggataggtatcccaggccttgtacagtgtggactagaatgatgacagtgggcaccctgccttgctcctgatcttaaggggaatgcttct

SEQ ID NO: 478059 - DNA, 732 bp, Homo sapiens
tgggcctcaccccacagcagcagcagcagcatggctggcactgaagggtccacagaggacggtggcccccccgccaccctctctcctgcctgtagccatagccccatgcctgtgcctgaccttggcctaagggggccctcaggggcactccaggaactcccagcgggagcaacctccagatgcccccaggagcgtctctgggagcacccctctcaagagaaccccacagagtgtcctcccatcatcccccaagagcatcccccactcatggccttccctgtgcagagcccagcatcgcccagggaccccccaggcccccaggacactgcccccagcacacccagggctacagggctcctgcatgaggtggaccatcctggggcacagaaggtcccttcccagtcaccaaggccccatgaacccttcaggggcacaggcacccctgggggcttcccccagcccctgataacaacggaccctctgcccacccgccagattttgtctgtcttcccaggggaactgtgtgcacgcgtctcttccctcttttcttgggtgctggccctgggcatttggcggtttccagccagcctcacaggcacatctggtgggctctgcagcaaagacccttagaaggccacactcgaggtccagggttctgtgttgggggatgtcgatgtcttccatggggcagatgtgtccctgtcattgtctttctccctcttcccattggtc

SEQ ID NO: 478060 - DNA, 535 bp, Homo sapiens
agcttttggatacaaaattaaaaagaccagcctggaagggatgatgtctatactggcaatatttcttactgtcatcacgttttgtgtaaaacaaatacctactattttgagaacaactttggatatgtttattttggttacaaaatttaaacgatcgttttctgagtttgatgctgttttattctcctatttactgagccccatctttacccagtcacccactgaagaatatcttgcttgcttccaagttttggcaactataaataaagctgctataaatgttagtgtcgacatacgtgttcagctcatctgggtaaatgccaaggagtgtgattgctggatcctatgcagcaatgatgagcgttcctgttgctccacaccctggccagcatttggtggtgttggtggccgtgttttggccattctaataggtgtgtagtggtatctattgttgtttaatttgcatttccctaatgatgtataatgtgtcttcagagagcaaaagtttttaactttaatattctgctgatctatg

SEQ ID NO: 478061 - DNA, 892 bp, Homo sapiens
ttggaatcaaccacattagaaactaatggaatggaatggaatggaatggaatggaatggaatggaatggaatggaatctacccgagtggaacggaatagaatggaatttaatggaatggaatggaatggaatggaatggaataaaatggaatgcaatggaatggaaaaaaaaccgagtggaatggaacggaattgaatggaataaccggagaggaatggaatggaatggagtggaatggaatggaatagaatggaatggaatggaatggaatggaatggaatggaatggaatggaaaggaatggaatggaaacaacacgagtggaatggaatggaatggaatggaaaggaatggaatggaatggaatggaatggaatggaatggaatggaatggaatcaacccgagtggaatggaatggattggaatggaatggaatggaatggaatataatggaatgcaatggaatcatcccgagtggaatggaatggtatggaatgcaatggaatggaatggaacagaacggaatgaaatgcaatggaatagattgaatgcgagtggatttgaatggaatggaatggattggaatggaatggaatggattgcagtggaatggaatagaatcatcacgaatggaatggaacggaatggaatggaatggaatggaatggaatggcaaggaacggaatggaatcaaccggagaggaatggaatggaatggaatggaatggaatccacctgataggaatgaagtggaatgtaatccaatgtaacggagtggaatcaactcgagtggaatggaatggaatggaacggaattgaatccaatggattcaactggaaagcaatgcaatgaatttaaatggaatggaatggaaaggaatggaatcatcc

SEQ ID NO: 478062 - DNA, 2206 bp, Homo sapiens
aaaccattttgctggtgaggatgaaagctgtgtggaagagggcaataagatcagctggagcattagattctcatagcagtgcgaaccctattgtgaactgtgcatgcaaggaatttaggttatgcactccttatgagagtctaattcttgatgatgtaaagtgtaacagttttatcccaaaaccagccccccaggaccccccaccacttcatcccccggcacggtccttggaaaaattgtcttccatgaaactggtccctggtcccaaaaagaaagttctagctcatgtaaaggtcccagaggaatttcttgacttttgtatggaagccatacaggagagactcatgaggggaatggaaaggagttgtaagggccctgatgtttggagcctaacaaatttcctggtggctgagtggacttggaaggagagaattctatgaacaacaaagctacttattctccaaaatacctagacttgggcaaggttcatctccttagtagtcattatagaagcagggacagaatttgtttccaattttcatgacttttaagcccctagacctctaaaataatctaaggaaagaagaggaaaactcaaaatattactgagactgaactttctaccaggcagaagagaaaaagaaagaaagaaagtttcattgcctccactgttgtgaaacaaattcattcctgttcccaaaatgatttattatatgtatgtgtgtgtgtatgcatgtgtgtttatagaaatggtattctatttactgaataacataacattttcttctatgccttttttttttaacttaacaaaatatattggacatcttgcattttttcaacacttgcaaagtgtttaactatatggatatatgctgtcttgttcttgataaggtgcttttggaaaaaataagtactaagagatccagaaagtattacattgactttctagaagcagagtttgcagctggttatgctgttctaagaaagttttagctctaggaaagtgtgcattcatgtttttcataaagaaaataattgcacagtattctttgtattttttcaacactgacagatggtaagtgaacagcctgggaggaggagaagtgacccaacttgcttctgcagtattagaaaagatatcaaagtaagaggcagacactcccagtgccaaagattttgttttctttcttactcatctcattcaaactgatcacaaattgctttattgcattctactgtgtcacttcataataaagtaattcctttctacctttacataaaggagtgtcttagcctatgatgaaatgattttctcagttcacctgaggttgagagtaattggtaatgaaaattattcagaaatctgtcataatcatagcaatagtatatagaaacacagaatatataaatttattattcggcatgaaaagacaaaaggaaactttctaatgagcattatcctgtgggttgcaggaagcacaagaagtcaggacaaattttgatgctattccctcccaccaaatgtttatgagaattgtaatgctttgcacaatgctagacttaggttgtcagttgaataaacaataatattgagagtattttctgtattgcaggtgaaaattactttatcaacttttcctttgtgtttagcatatttgtagaatcggcctaacagtctctaaagtaaaactctgagacatccaatttgcatatattcttgaaaaaaaaaaaggtttgttaactcatcgaaaaaggcttttgtctaatgaggctgggggtggtggggaaatatgaataaaaaatagtccatatgcttaatttatgttttcaaatatatcgcatatccaaaatagcagattatatattaatgtatgtgattattgggttaaaatttatctttcctctaataataatgataataatgatgatggtgatataatatatattgagacctaaccatgcttcaggcattgctctacttgcttgtactgaacataaactcttctcacacctgaaaactgagaagcaaaggtatagatgttcctacctcagaccaacagggaaatgctaatcaacagtggaaattggattgggggatggaaaaataaatcgtcaattcattcacaacgtaagatatgagaatgggactgagaatctaaaagtggatgttaggaacacaggcaaaggcaaatacaaagtatac

SEQ ID NO: 478063 - DNA, 572 bp, Homo sapiens
aaaaagaaacaaatgggagcagtgagggaagcatttcatgtatttttagagctactagggaaacatacacctctacacaaatctgcacacttaaacagcaatgcacacacagtacaaatacagatgtcattcctttcctttttaaatgcagagacttctctgttctctcatctgaaagaaaaagatgaggagttacttcttgtaaatgaacaaagaaagtggtttcttgaaatggaatctactcctggcaaagatgctgtgaacactgttgagatgacagcaaaggactcaaaatattatataaactcagttgaaaaagcagtagctggatttgagaggattgactccagttttgtgagaagttctactgtggaagttgtcaccaccactccaaccttcagcaaccaccaccctgatcagtcagcagccatcagtattgaggcaagaccctccaccagcaaaatgactatgactcactgaaggctcagatgattgttagcattttttagcaataagatatttgtaaacaatgtatgcattatttttagacataatgctattgcacacttaat

SEQ ID NO: 478064 - DNA, 699 bp, Homo sapiens
gaaatacactctaaaatggctttgaacggttggggacggtcctttaatcttcctctggatcaccatttctgtgcaagaatgggaccccaacatcagcctattgttacagtaggtagtcaggcccacctgagcagggcgggaaagggcacccgccacacaccaagaatgtcaggccaggttctgagaaaagtgaccatgaacacagtaggcaaaggcctgaccttatacggaaatgaaaaggataatgaaacggcccctctgattaagtgctgtaaagtaatgaatgacagcagacatacaggtgcagtgggaatcatggcaagaactcctgaactggactggaggaatggttgggatccagaaggacttcctggaggaaggggaatgaaagagcagtttgagtttggcatgtggataagctttgtgcatgttgaactggagatacctgtgagccttctaagtagtgatgtacagaaacagctgaatctgtggatctggagctcaggagcagaacccaaaggagatgaagatatgggcatcatcagattatggttggtgattgaaatctcaggcatgagtgatgctcccaagaaaaatgtgtgctgtgagaagatagctgaccttggaataaccctacagagcactgtaaatgtgtgatgatcagagaaagatggtcctgtgtctaagcccagacttcct

SEQ ID NO: 478065 - DNA, 766 bp, Homo sapiens
aaccttgctatggccactgttgagtgcccagtctaccagcagaagagaccaacactgagtgctttatatggactcattcgttaagaagagtgaacatcacccgaggactttgcattgtcttctggggaaagggccttcagggcagagttgaggctttccagaaggagaagagattctgccagtgggcagccattcaattcatgcccaagaggtccagcctgcccttcattagggcttgccctgcagacttcagacttgtccaaccaaccccacaattgtgtaagccagtcatttgcaataaatctaaaggtgcccaaaaatacagtgttgtcatagagaagaggaacccaggcttccacagatcttccatttatggagttggagatgatctgaagagagctaatttggccttaaaagctggccctggtgcagacaagttcaagtccctaggtgtccgaagggccccaggattcccagttccatttctagagtttgtcagctttaggacttccaaccaagtagctaccatcacgctgctgaaccctggagagtctggtcatttggcatctcacaccccactgagcactggctctctgaaagataccacatcagggcctatgagcagggcaggagaggacaaaatatataatattgttgttcaaagagctaaaatcaatttacaccaataaaatgtgcacacaaataacagtacggatcagcttgtaaaatttgccatgtccaaatttaactgatgaatttggttaca

SEQ ID NO: 478066 - DNA, 978 bp, Homo sapiens
ctagaggtttagattttgctcatagataagaaatgaattttcagcctcaaccaaggaaaatgttttaattctgagtccacagtatctcccaggccttcattgatgacaggtcagagaaaaatggccagaggctttgtgactgtcccagccactccagctgtggctgaaaggctccaacgtacagctcagactgtggcttcagaaggtggaagctccaagccttggcaacttccacgtggtgttgagcctataggtgcacagaagtcaagaattgaggtttgggaacctccgcctagatttcagaagatgtatggaaacgcctggatgcccaggcaaaagtttgctgcagggacagggccctcatggagaacctctgctagggcagtgcagaagggaaatgtggggtcagagcccccacacagagtccatactgggtcactgcctagtggagctgtgagaagactgctaccatcctctagaccccagaatggtagatccactgacagcttgcactgtgcacctggaaaagccgcagacactcaatatcagcccgtgaaagcagctgggagggaggctgtaccctgcaaagccacagggatgcagctgcccaaaaccatgggaacccacctcttgcatcagagtgacctggatatgagacctggagtcaaaggagataattctggagctttaaaatttgactgccccactcgaattcagacttgcatgggccctgtaaccccgctgttttggccaatttctcccatttgaaatggctgtatttacccaatacctgtaccctcattgtatctaagaagtaactagcttacttttgattttacaggctcttaggtagaagggacttgccttgtctcagatgagactttggactgtggacttttgggttaatgctgaaatgagttaaggctttgggggactgttgggaaaacatgattggttctgaaatgtgagggcatgaaa

SEQ ID NO: 478067 - DNA, 860 bp, Homo sapiens
ctcagatgtttatcatagataaggaatgactctctggaaacctacccatcacgtgagtgcttctgagggtcgtcaaggaggcgtctgcttaagcggtacctcagtgtgctcacagcagcagagggctactgttcagaaggcattgctccattatccactagcttcaagaatttctgttgagaagcccaatgccattaagatttccagtcatggagagacatctttcaatattctgcctgagcaggggcaagggatgggtataaacctgaccattagtgtccttgaagccaacagacagatgaaaaacaaatggtccgtgctttcatcattcaatatacagattttcacatccttttccttctttcacaggggaatttccagatgtgccagcaacttgattttgggcttctcagacttcagagatgtgagaaataaatttctgtcgtttaagccacccaatctatggcaatttgttacaacagcctgaactaaggtactgttaggcctctgactttgttcctctcctttggtattggtttggctcttctggtctttcatttttccatataaacttgagaatcagttaatatccacaaaataacttgctgggattttgattgatttgatttgattgtatcaaatctatagattaagttgggcagaactgacagttaaatatcaagtactcctatccatgaaaatggaatatctttaaatttatttagatctcctttgaactttgtagtttttctcattggaagttttttttatttagaattttgtagtttttcttgtataaaccttttacatattttgttagatttatacctaaatatttcattttattttggtgctaatgt

SEQ ID NO: 478068 - DNA, 557 bp, Homo sapiens
gagttaatgggcgcagcacaccagcatggcacatgtatacatatgcagcgaagcaatgatgacttccctagagctaactggccacattgcacatggtaggatggtcagctctaaggagagtgtggaaattaggggatggtcgtgttccaaagtcatagctcacaggagcctctctgagcttccgggttgtgaatcaccagaagacattaaaagaaacaaaacacccaagagtgactctttagtcgtggatttccagaatctacttttggaagataaagctaaattgctgagagctgtggaagacagcacgcaaggcagagtgcagactatagacaccgcaggggttgaagaagaaaataacgagtgttggtgtgccatggagaaattggaacccttgtgcactgttggcaggaatgtgaggtggtgcagctgctatgggaaacagtatggaggttcctcaaaaaattaaaaataaaattactacattatctagcatttccacttctgggtgtatctccaaaaggattgaaggaagggtcctgagaagatatttgtaa

SEQ ID NO: 478069 - DNA, 575 bp, Homo sapiens
ctcccaggtgctccctcacctccatggcctctgcagatccccacccagtatatccaaggtgctccctcacctccatggcctctgcagcccctcccccagagtctcacaggtgttccctcacctccacagcctctgcagatcctcccccagaatctcccgggtgctccctcacctctgtggcctctgcagatcctcccccagagccttccaggtgcttcctcacctccacggcctctgcagatcctcacccagagatcccaggtgtttcctcacctccacagcctctgcagatcctcatccagagccatcaaggccacccgctccactcatggaaatgtaacatgtggaaagaacaggggctaataaagtgtgctggtcaagagcacgggctctacagcctcacagagctggattcaaaccctacttccttcacctactagctgtatgacctcggaaaagacaattaccctccctggccctcagttttcccatcaataatatggggacatactattttctcaccagattgttctaggaaataagagaggcaacatttgtgaggtgcttgaaatagc

SEQ ID NO: 478070 - DNA, 685 bp, Homo sapiens
ctcaagctgctagatatgattcagtctaaagtttgttggaagtatggagcccctcggtattggcgaggaacaggtgctcaggctcaggtggacggccgtctttttcctcattgctcgcagcactcccttggaggagttgctcctcaccccattcagctataattgtctgaatacttatttctcggtgttcactgcagaccaacctgcaagtggtgaccctgacatgattgcctttaagttaaacgcatggagtaggatgactcaccagtcttcggggaataccgggaattcagaagatttacagggaaaggaaacacaggaaccagaacaacagggaggggctcctccccccactttattcccttcagtgcagcataaagaagagactttttctcgcaatgatgaggacggaccagagccttttcctcccccaagagaaaagccattgccctcttttcctccacccttaagaagaccttcattcattggccccgagtcaaaaaaaagtatctgcgaaaatggtgtacattcatcctttactcgggatggttgaggctctgggaaatggttatgagatgattctgcatgattggaaaactctggtaaaagttttggtctcagctgctgaatatactgtgtagtggactcaggctcaggtgcacagtcatctatttcctcaatgctc

SEQ ID NO: 478071 - DNA, 611 bp, Homo sapiens
ctcagaagttgtatgagaacgcctggatgtccaggcagaggtggcctgcagtggcaaagccctcatggaaagcctctgctagggcagtgcagaagtttgcaagccacacaaaagcagatggcagaccagatctggttcccagaccatggcttgccaacctgtgcttgtgaccttttaagctctaagggagaatcttctagactcagggaggctcttaaaagaattcagttccctgcaattgtaggactgaagttcttatttccctcatggccgatggcctgggattattctctgctcctaaatgctgcatcattccttgacctgtggacatttgccttcaaagcttctggagatattggtgcaaaagaagacttcaaagatcctgagtcaaatgggaaaaaccatgcaacatgatgactagaatgaacatggtatcctcagagtgttataaaaacccagagaacagaacaatctaattttcaactttatgttaaaaacagaaattttgatttaactaagagctatattattagtataagctctagaatagccaaaccttacagagttcacttttatttatttcaaagtctgtgtcttgttcactcttacct

SEQ ID NO: 478072 - DNA, 2308 bp, Homo sapiens
tgccaggttcatccggtgaagcccaggatccctcttctctgagtgtgatgaaggaggccccacccacactcatagccagtgaggcagtggccactctctggggccatggccctgcaggcgaggctgtggtactggtgcggcagctatcgaggcatgacgcaggccactgactcaccacgccaggctgactcacctcccaggtaccccggccctcctcagtggaaggagggctttgagcttggggctggggtgccgggagagaacgtggcgccggaaacggaaacgtctgtgcagaccaatggggtgccgagagagaacgctgactccggaaacgtcctggctgtctggggaggccctgaacccaccccgaggccccacagctttttctccagctcagacactttctggggctcagtcttgctgcggcccttgtggcatttggcaggcagtgggtggaccatgagtgagttaggaggccgaactgcccacctctacaatgggttcccaggagagcgaacacgggacccgctcctccaggcctcagccccactctggaatgagttcaacagcaaggtacggtgagagctggcggcttcatttttggaaccagggagagagagagagagagaggtttatgagagacctcatgagacagctcatgatggaagtgagactgagttgcagtgaaccctgtcactgaagagacagccttcacactgtgtcttgcaggggaaaatacaactctttattaaaatttattgccctgaaaaatgggcagtgttacttacttattctgggtgcacaggtcctactcaagacatggcgaaaaggaagcccagaggcttagttcactgagaaatgaaagggtccataccaggtttccttggctactccatcagctgtacagttggaaggacttgtctctagaataaaaccttttgcttctcctgatggacgacaggcctgcttggagaaaacagtctactcccgtaaacctatagaggacctcaagtatttgttcaagaagctgcctctggaagacagcaatagttaagtaacatccttatataaatgatatataccaggggatatgcagactatcttcaggaccctggcttgatacccccaactgcacaattcataacctgaacctctccattctcaatgacaccaggggatatgcagactatcttcaggaccctggcttgctacccaccaactgcacaattcataacctaaatctctccattctcaatgacaccaggggacattcgaatttgggctcctcttggaattgttttccctcgaggccacgctaatgacctcctcaaccaccctgcttgcctagctctttccccctgcatggctctgtgggcttggacaccccaagcccaggccaaggaagggccaggtctggcacccagaagtcccccacttgaccttgactccttcaagtcccccaataaactgccagtgaaccaccacaagctgcccaaatccattgcattagactgatgcaactgagtgatggggaaggtgtgggtccctccagctttcgtgggtgctaagactgctgggtgtctggcactgctctggccctgggacacagcagttaggaggccaaccaggccctggccttctggcttcagagtccaagagggacagaagtattccttgcttatgtattccctgtgtaagattgcagcaacgctatacaccctgggagaggttcactgtgcaaggagagccctggggatcttgcccagtctctgggcccaggaagcggaagatggaagaggagggaacagcatgtgggtgggaggggagctgggagagcagaagttgggaatgaatgggcaggggcaggagcagaggaggtctggagggtgggtagagagaccttggaagctccaactggtttctcattcatccatcttcaccggtatctccagggctaagcctccagctctgggtccctcccctggcaggagaggacacagtggtgtaaaccaaaaatgaaattctaagcacccccaccatctgaatgcacccctgttcttgaccaagggcagtccagggttaacctgaaacaatagttcagaccacgacaggaaatgggtgttggatatgcctcactgtaccctcctccctttggatttcaggcccagctgaccagcagtaacatcaacacaccccttaaagactgagagaacagactctttaagtctgatgagaaacatttacaatctattctctctgaagcctgctacctggaggcttcatctgatgatgaaacactggtttccac

SEQ ID NO: 478073 - DNA, 778 bp, Homo sapiens
agccaatgggcggagggcatccctgtcctgtcctctagccaatggcggagggcatccctgtcctgtcctctagccaacaggcggagggcatccctgtcctgtcctctaaccaatgggcggagggcatccctgtcctggcctcacagtgaggaagcgcttcatagatcacagctcaaggcccactcgggccactcctcctccacctgatgcctgcagagccccacaacacctccttgaggctgcccagggccccttacgccctctggggccccccagtcactggcccagagtgggtggaggagtcaggatttcaactaaggcccctaagccggcagcaagcgcaggaaaggagctgtgctggggactcagatgctggcgtggggctcccgtgcccatgtgccccatgagggcccctgtgccaggggaatgtggggtcactcgggagttcacggcctgggctcgaaccagagagaggacgcaaggaatcccagttccttccgcagggagagatggggccaccttgaaaggtatctacacccaccagccccagttcaggtctcagccccactcatgcccatgctgtggggtgttgggccagcccctcaatctctccaagcctgcaattggttgtctgaagaaaaagagtgacagcaatgctgaccagcacagaaggctgctctggggtgggcttagcggtggatggggaggcccaaaacccagccagcaaccagcagtgcccacccagcacccgtatcttgactcctgacatccttcttca

SEQ ID NO: 478074 - DNA, 918 bp, Homo sapiens
gcagtggaaggccacccccaatgtgctgagtccactcagcagaagggaagcgctttccctgagcttgcaggactcagcccagagcccggtgcttagagggctctgtgagcctttgggcccagggggcctgtagacgcctctggaggctggaatgtctgtggaaagcaccaccttgctgattctgccgcagaggctgggctggcatgtgggctggggcttgtcctaacactgggaccctggcaggtctctggggttgcaggcaggaagcagtggtggattctaatgttctttatgtgtttctctctgttcttctctgcctgctttggatcggctgttactaagctgctgccgagtggcaactctgcttatctcacggtgttgagcctccttaacaactctcatcccatacaggtttgcacccccagtggatacctatggtcatgtggtcacctattcaatcagcatataaatagcttatctctcatttgggaccatgaactcaatggttaccagcatattgataacatttggttcaggggtcaatgtacaacaccctataatgtacaattatataccatcacttacctgagagctaagtgggcaattcgccttatattggctggggttgaggctgccattggcttacccaccccatggggaaaatttgcctattatgaggcaactcttcaaaactttacttcttcattctacgcactgtctcataaaacaggagacactttagaaacattaaaactctcccttgattcctttgcagatataataattgatgacagattagcacgagagtattatacttattggttgaacaaggagtatgcactataagtaataaaacctgctgcacttacgtaaacacctcaggtcaaatagaagaagatgaacgtaaaatatatgagc

SEQ ID NO: 478075 - DNA, 548 bp, Homo sapiens
gaaaagagttgaaggacacgctgcaaagtgtgaaaaaaacagggcctgagcttgccaagagggccaagtggttactttaatcatgtggaacagccactttttcatggaaaattttctactccaacacctgtggccattaaaggcgccctcggctcttttctaccctgggtcccaggggtcactctccagccaaggctggctgccagctctggaggacctgagaacaaagcctgggcccaaactggacatgaggagcttcaccacccaggtccctcgtggggctcaggcattgacacggagaacagggataccgggctgggcacaggagtggggcctcgacaagcaagagaagccccctccagaagcagccccgggagccgtcctctggggaagcagatggtccaggaagcaagaggagggaacagggcctcatacacaggtgtcagaggatcctaagaacattctggactggcagctttctctgtgggttttcatgggctcagcggctgcctgggtgggacgctgatcctggctcactttcaggcatc

SEQ ID NO: 478076 - DNA, 982 bp, Homo sapiens
ctcagacgttccctgagcacttcctatgctgctgctggagcccagggatcagccaactatgacctctggccccaaacggcagatcctctgtggagatgtacagaccctgcttgctggtccccctgagtgcctgctggccccacccccaccctgcaagacactggccatggggtctggcacatccatgctgactgcctgcaaggcagctcctgccactgagtgggcacagacaccaacaagacaggggggtaccactccttttctcagagaggagaggctttccctgagcaccctatttgaaatcgcaagctcacctccatcctggaaccccaagttgttctcttcctgctttattttccttcaaagcatttaccaccacctggcaaggaggggtactctcatctgtgaagcagaggactgtgctaatgattcctgcactgggttggatgacagcctccaagaagatatgttcatgtcctaagccccagaacccatgaatgtgaccttatttggaaaaagggcctttgcagatgtaattaagtgagggatcttgagacaagatcatcctgttcttccaaggtggactttaaatctaatgccaggtatctttataacagacagaagagaagcagatgtggacacagagttctagagaagccatgtgaagacggaggcacaggttggagtgaggaagccacaagccaagaaacacctggaaccaccagaagctggaaaaatcagggaaggaatctttggccagtcttttctcaaggtgtcagaaggcctcaaggcccttgttttgacactcaggcctctggaatgtgagagagtaaatgtctgttgttttgagccacccggtttgtgatcatttgttatgacggccacaggaaacaaataaaatctctcggtcatctctgcagttgtcttccagccaaacaggccgaaacctcaataatgagttaggactgggaataatcttgag

SEQ ID NO: 478077 - DNA, 597 bp, Homo sapiens
ggctggctctggcgaggatgaactggggaaggactaaagtgtccaaagcatgggcagtgcctggcccatgggaggcgctgggggtgaccgtcctccttctggaactccttcctgacaagtcgtctggaggcaccctcgtgcactgggatacgactgatgcaggttggaaggcagagctccctgcagtgggagaaggatggcagggagcaatggtccgggtctcagaagctgattccaaaccagaagggtgggagaaaaatattagtttggagacctgtagccagacatttctggaaacgagaagaattcaggatccagtccagattgtaggttgggatttccagttccttgatgaagagaagttacgagactgggcatccttgctttgttcctaaacaggaggtgaaaacattcagtcttctgccattaggtatgatgttagctctggattttttacacatttattcatttatttattaggttaaagatgtcttctactcttagtttgctaagagtttttttaaacatcaatgggaatgttttcagaatctttttaattttttttctacatctatggagataattttttatagtgtt

SEQ ID NO: 478078 - DNA, 1050 bp, Homo sapiens
gtgggggcctgcctgctggcttcgtgggccccctttctcgtatggcttaccagggttccaacctgccctcgctggagctgctcatctgtcgatgcctcttccacctccctattgccctgctacttaaactgcgtggcgacccccttctgggacctcctgacatccgaggctgggcctgcttctgtgccctgctcaacgtcctcagcattggatgtgcctacagtgcagttcaggtggtgcccgctggcaacgctgccactgttcgcaaaggttcttccaccgtatgctccgctgtcctcaccctctgccttgagagccagggtctcggtggctacgagtggtgtggactgttgggcagcatcctaggactaatcatcattctgggacctggactctggacactacaggaggggaccacaggtgtctacaccaccctgggctatgtgcaggctttcctgggaggcctggcgctgtccctggggcttctggtctatcgttctctgcactttccctcctgcctcccaacagtggccttcctatctggcttggtggggctgctgggctgtgtgccaggcctctttgtgctgcagacccccgtgttgcccagtgacctcctgagttggagttgtgtgggggcagaggggatcctcgccttggtctccttcacatgtgtgggctatgcggtcaccaaggcccaccctgccctggtgtgcgctgtcctgcattccgaggtggttgtggcccttatactgcagtattatatgctccatgagactgtggcactttctgacatcatgggggcaggggttgtgctgggcagcattgccatcattacagcccggaacctcagctgtgagaggacagggaaggtggaggaactttggacttactagacaaagactaaacaattgtcttaaatatgcacaagagttaaaagacaactaaatgaaatcagagaaatgatgtttgaacaaaatgagaatatcaataaaaatataaaaattatagaaaggaaccaggtagaaattttgtagctgaaacgtgcgacaa

SEQ ID NO: 478079 - DNA, 651 bp, Homo sapiens
ccagccagaccttcttgctaccgtggaggcactcgtggcgagcctcttccgaagcctgaatatcctcatggcttcggccacagcagtgacaaaggacagtgttggtttacgcttgtggtcccagtgcagctattcatactcaccctctcccgcttccctcactctctaaggggttggagacagttgtcgctcaaggtgcaaactccgggctggcgctgtgtgtgaacagataacaacaaaatgtatgtggctgagtccactaggaagacgcttctgtaccacatggagttctctgaattaacttccagatatattaaaattattaatggacaggtcacacaaggagaaattgacccaggactggtaagactttccatcatcctaccggacatgctgagacagaaggcaggcttcaacttgtggtgggatttcaagttcagagacacatttgctgtgatgtgtcattattactgccacatcccatgtcgtaacagcagcccctttggggagtgtcctacactttcttgggcagcacgtgtcagtcaacagctgcaagtcattctggctccttgcccaacggaagagagagcattgcttaaaacagtctctgccctacctccagagaatgtgatagaaagcgagtgacagact

SEQ ID NO: 478080 - DNA, 1212 bp, Homo sapiens
tgctgttcttgtgatgctgggacatccatcttctcccgctgctgtggttctcaagccctcagactcggactgggagactgggatttacaccactgcccgccttccctcagttctcaagaaagaacagattaaaccactggctttcctgcagtgataggtgtctctctctctctctcaagaaagaactgattaaaccactggctttcctgcagtgataggtctctctctctctctctctctctctctctctctctctcattctgaattgagactgggggctgtgtgcgtgcttatgcatcatgcatatgctgtgctgaaaggcaaaagcccacaagaagcctacgcagcgacatcatcacacaatgctggaaaaccaggaaaaaatgtgtatgtgtacaaatcaatggaccagggagttggcaatggggaagaccttcaagtgaatggccaggaccaactgtgtatcagtagcaggtgctttttccacgtgctatttcatgaaacactcacaaaacaccctgcaagcacaattggaatgcctctttcttccatctcagtctcccttggatcccctctcctttttgcctatgatgtcacatactggcctccctcaggtcgaggagctcacagctcaggccctgacatgggtatttttctgcatttggaccctgccatcaccaaaaatagtccctcctatttcaattacagcttaaatgtcaccttagagttggcttcctgattcctcatgtttcagtagatcccattttgtttaaacctcttggtttttaaaaaaccttttataaatgctttcttgttttcatctttataattattcatttgtatgtttagttgatcactatctgccacttccgctagagtcagctccatgtacaatgtgttttgttttcagcacctagcatgatgcctgacatgtagtaggtgcttacatacttgttcacaaatgaatctcttatgttaaactctctaatcactaattgttctgtaaatctgagcgtcacttcatgacttatctataatgctattttgttgactcatattggtgggcgtctatttcatgtcttcaataggactgtacattgcagaaatgatctcttatatttctttgtaccaaaagaagttagatgcaaagaatcaatgaagttagacttaatttggtgtctgtcacattctgaattactataaccaggatac

SEQ ID NO: 478081 - DNA, 2508 bp, Homo sapiens
tcccagcaaggtttcaccgctagttcattgattcactcactcatttatgctccatcatatgctagaccctatcctgggggccaggaggtactggggggcctgtggacctgcagagggcatccacggccaagcatacactctgcaggtggaaggtgtggggccactgggaccaaggaaggcaccgcgacatcaggagaggaagaaacagaacccacccgagctgggggtgctgagattgaaggagagagtggaggaattgagactgggggctgtgtgcgtgcttatgcatcatgcatatgctgtgctgaaaggcaaaagcccacaagaagcctacgcagcgacatcatcacacaatgctggaaaaccaggaaaaaatgtgtatgtgtacaaatcaatggaccagggagttggcaatggggaagaccttcaagtgaatggccaggaccaactgtgtatcagtagcaggtgctttttccacgtgctatttcatgaaacactcacaaaacaccctgcaaggtaaattttattctgcttctttttatggttaacaaagggaggcttcaattaagaaagcaccttgccccaaatactatagctagttaatgccggagctaagatttaaatatagagcctgcctcctgtgattaagaaaaacaaaacatttttattttaaaaaaggaagacccagagaagggcataatttaaccatcacttggcagtatatgaccccaccacacagaaaggatcaaagttagctttgtggcatgaatgtttatataattatttgttctccaggtgtttagctcagtcctggacatattataggcacccaatggatacttgtgtagtgaaatctgacagtgggacagaggcgcttctgtgtaaggttaactaaaaaggctgaaacccttaaagtctagatgatgaaggctgagatctgatggggctcaagtataacaaagtccattctctctttgaagcatttcagcaggatgaatgaatcaccagtctcctccctttctccccttcctgactgcccaaagcacatacccataacaccgtgcccttgggcccttagcactttacttcaccctgctgtcttgactgtaggggctcccactgcctccagcatcaagcataactttctagggtgccctagccttctccctacctgcatcttccctctctagcctcatcccttgtccatgcaaatctttgtctccggtcagcctgatgccctgatgggagcccgtggaatccttatctcacacccatccctccccttgcctacatctctgtccagagctccagcattttggtgaactcgccccgcaccccgtaatgccttctttaactcttcctgctcctctccctaattattttgttactattgccagtgccactccatttgcacttagaataaaataaaaattccttagcacaattggaatgcctctttcttccatctcagtctcccttggatcccctctcctttttgcctatgatgtcacatactggcctccctcaggtcgaggagctcacagctcaggccctgacatgggtatttttctgcatttggaccctgccatcaccaaaaatagtccctcctatttcaattacagcttaaatgtcaccttagagttggcttcctgattcctcatgtttcagtagatcccattttgtttaaacctcttggtttttaaaaaaccttttataaatgctttcttgttttcatctttataattattcatttgtatgtttagttgatcactatctgccacttccgctagagtcagctccatgtacaatgtgttttgttttcagcacctagcatgatgcctgacatgtagtaggtgcttacatacttgttcacaaatgaatctcttatgttaaactctctaatcactaattgttctgtaaatctgagcgtcacttcatgacttatctataatgctattttgttgactcatattggtgggcgtctatttcatgtcttcaataggactgtacattgcagaaatgatctcttatatttctttgtaccaaaagaagttagatgcaaagaatcaatgaagttagacttaatttggtgtctgtcacattctgaattactataaccaggatacgtgtctaaacttgaaggagacatcacagtggggtttcatgttacttagggtcctggtagtattggttgggatctaaggtctgcactgagcctaagaactgtgtataccccaaattttctttgcactggagacatcatatcacttggccaaaaggccaactgagccagcatcagatacaatcttgtatctttggttgaggaccagagaaaagacttggcttgaattgggagggcatgtgggaagacaaacacaaggctttaagtcctagaatcccactttgtctgggaaggcaatcatattaggaactaaggaacagaggtctacagtgttctatttcccatctcacactcaatctggggacatgtgctctatgctcattctc

SEQ ID NO: 478082 - DNA, 820 bp, Homo sapiens
cacacctaactgctacttctgactctgatgtttattctggaattatctacagctcatccctggtttctgttgttgaccattctgagattacaacaagaagcaacaggcaaagcacctgactcaccaagcttacatgtgagtggggcagacatgcatgcaagggagtacatgggcaacagcagttctgtgaagaaagctgaagtggtggaaggactctccgatgagaatccttttagtggagatctgaaagctgtgaggaagtgtaccaagagactgcatgacaatctatgcatgcagcgtgtatctggctacccagttacaagtgggctagatcctatgcccaatactagatgtataaggaaagtaaatgacacctttgctctgaagaagttcactattgaacgtgagttacagaaaaggctgggtacaaatgtgagggagatggtaatagactcccaaggtgaaatacgctgtaaagttctcttcgaaagctggagaagcactgacttcttgtccttttttttacctggcctgattttcatctttttcttcatctcaacagttgtcatatggaacttgccattttgtgtgaggctcaggttagagtctgggatgacagcgtcctgtgcttatgatgcgatagtgaatggccatgatgaaagggagtcatgaagagcaatcttttagtgactgcttcagtttctaggttttatatagagtcagagaaagagcagcctttcttagtttatcctcacttctcgggcacataacagccttcaatcgtgttgattaatgccgccttcttggaactactctcttc

SEQ ID NO: 478083 - DNA, 579 bp, Homo sapiens
gtgtgcgcgcgtgtgtgtgtgtgtgtgtgtgtgtacacatcatatgagtgtatatctacggtcaaaagtggaatttggacccatggactatctggctacctggccagctcagtttcagatatggcagctgaactacctacactcccacttccaggtctgggtctcccgggcttcccacatctgtgttttttacccagggaagataggccatggtgtagacacaaggctggtgatagaccctcatgttggtgccaaggatgcctctacaatattgttccaggaagtactagcagctttgaagagagtactgggctttcgttgtgatactgccacagtgaaagcaaaaggctgtgtttttgagtgggctgtttgtcagatttcagagaagacatgtcaaaccaccgtaaattacaagctagatgaagttggagagctggttcagaaatctttgaaccaaaccgaaacaaaacacagccctaatgacatgagtttcttgtaaactgttttaccaggttgtttactgcagaacagagagaaccttgactaatacacttgcagaagtccacagaaagtccatta

SEQ ID NO: 478084 - DNA, 612 bp, Homo sapiens
ctccttcaaggcagtcccttgaagggtccctttcaagggaggcatggcaagcaggccgaagaaagatccatgggaaaaccttgagctgacactgctctctgctgggaatctagcgccatgcaccgctttggtttgcatctgggctccgcggacccagataggcttgagaggaatcccttctccagtgccagaaaggcagttttctgcactcagcagcgctccaaattgtcagatggatgcccagagctgggcttgggggtcagatgtggctaaatgtctccgatctaggttcctgccatcctggcccaaggcagagctgctggcatctcagcagcttcaaaaggcccaagttagctgctgttgtctcactggaaagtttcagttgtcagactcggggagtgacgtcagaagtgatttctgctggaaacagtcccctcctctggattctttacagaattaggatctatatttttttggttacatagcagaagcccacagaattactctgtgttgatgaattgagcaaaacctccagaacctttttaagatccagggaatgacgattggttggtccaatttcaggttctgggatagaagcagcggagactccta

SEQ ID NO: 478085 - DNA, 911 bp, Homo sapiens
gcggcgccttccttctcccactggaaaccaaatcctgggagcgtctcttctgcggcagcagtggacgccgccgaggagggacccgaggccggacccgaggccggctccaggaactgagcccaaggccgcggtagcgatccggacagggaagacaccttcggtgggcttcatgccttcctccatcgcagctaaccaccttgccctcaagaactccaggattgtgaacagaagggcgcaggagcccggcctgaacgcggcctcgcccctcggcggcgggaccagggtgccagagcgcggcgttggcaacagcggcgacagcgtgcggggtggccgctcggagcagcccaaggcgcggcaacgacggaagccgcgcgtgctcttttcgcaggcgcaggtgctggccctggagcggcgcttcaagcagcagcggtacctgtcagcgcccgagcgcgagcacctggccagcgcgctgcagctcacgtccacgcaggtcaagatctggttccagaaccgacgctacaaatgcaagagacagcgccaggacaagtcgctggaactggctggccaccctctaacgccgcgccgagtagctgtgcccgtcctggtgcgcgatggcaagccctgcctgggccccgggcccggcgcacctgccttccccagcccctacagtgcagcagtgtcgccctactcttgctacggaggctacagcggagcaccctacggcgcaggctacggcacctgctacgcgggcgcgccctcgggtcctgcgccacacacaccactggccagcgcgggcttcggacacggtggccagaatgccaccccgcagggccatctggcagccacgctgcagggtgtcagggcctggtgaggctcctcggcttgactctgccaaccagggccagatgctc

SEQ ID NO: 478086 - DNA, 1647 bp, Homo sapiens
gtatagttcaaagagctctgatgggtattggccgaaacctccaaatggaagctaaggaggccactgtactgagaaaattcctgagtagaaaagtgcagtgggcacagctgtggcccatcctgtcggtgatcattccctctctgagagctgctcccttcctgatggcagtgtggcccaagcactgggttatgctgtctgggatgccaccctctcgcagcatgccttccctagaggtctgggagctggaccggctgctgccttgtgacatccgggatggcgccttcattactatgccctttcactgctatgcacaaaaccgtggggaggggtttaggcacagatccacactgccaaactggcttcccaagggactggctacctctgccatggcctcaaaggcaaggaatcagaaggccacctacaaagtcacggtgcggggatcgggaggctgccacttatcactgctgcaccccctcattccataaatacctctcagcatccatgaatctggtgaccaaacactgccatgctgttgcagtggggaacccactgcccgccccaactgttcctgcctcaagtgtctgtgaccttgctaggcagcagaaaacaccaaagaacaggaagggagcttcagctcatgttcactttccagatctttccaattcatctattgccagaatataattcatggctagacccttggctgcaagaaagtctgagaaatgtggctttacatgttctggccactgcagtccaaggaggagtgcaagatgctaagtgccaaaccaccatatctaccataggtggggagaaaaaaatattgaattctgttaaataatcaatattccaaagattttcaactgtttctaacatttatttaatgaaattaaacaaaaatcacgtctgtgaagattatgggcatattcacatttgctaagaattctcttaaccatcaaaaggcaacttctttccactggtatcaccattgcaaagttcagggggtttctcatccattaggaggtgtgtgtgtgtgtgtgtgtgtatatatatataaaatatatcttatacatatgtattatatataatataggtatacatataatatacatacatatataacaggtgtatatatgtacatagatgtatatatgtatacataggtgtatatatcatatatacataggtatatattaaatatgtgtaaaatatatagacgtgtatatatcttatatataaaatataaaatttatataaattataaaatatatataaaataaaatttatataaattataaaatatatataaaatataaaatatatataaatatatataaatataaaaaatatataaatatatataaatataaaatctatataaaatatataatataaaatttatataaaatatatataacataaaatttatataaaacatacataaaatataaaatttatatatataaaatgtacatatttatacataaaatgtatatatattttatatatacacatggatatgaatgctgagaggctaagtaaaaaaatacatttatatatacacatatatctatatatatttatatacacaaatcaacatattttatatatgtacatatgtgtatattctatatcctatctatatatctt

SEQ ID NO: 478087 - DNA, 640 bp, Homo sapiens
agtgtgtgtgtgtgtgtatgcccatgcacagtaaacatttctatggtgttgtgctgggcaccagcgataccagtaggaggaggaagacccagtccatgcctacagaagttgcagaccagtgtgggaagaagcaagccacaaagagtagtccaggaaaggatgaaaatatctcagaaagagaaatgagcccgtgcaaggccctgagaaaggagcttgctgagtgtattcaagaaagagcagacagcaaggagggaaaggccacattcagaaaagaggatgaagatgcaggggactgggatgagttccaaagagcacaatggatggatttcaggagttggggaggagtgagagatgatgtcaaattaaaggaagtgtggagccacatggagatgagagtccaggcaagaaggaatgatctgggtcctagtctgcctgaggtgactgacatcaacagggacttcgtttttgatgaccttcgtagttttaagaagtactgatcaggaaaaaatatcccttcctattacttcatcttagtcaccttaagcaagcacatagtctcatctagtagcacatctaaattcagccccaaattagatccagatgcataactcagactaacctgatagatgacagctcacaa

SEQ ID NO: 478088 - DNA, 652 bp, Homo sapiens
tcctttggtggtaggctttagagttgtcaagagaccccaaagccataaggacagtggtggctgctgcccttcctgctgggccgacctcctggggtccaggaagctggtgagtatgagtgcttctgggcacagtcaggagccttgctggtcgagcctgggcttctggaagcccttggagatgccactcttctgcttgtccttagaaacctgggccatcatggatgaggatgcagacagagggcaaaggggctgggcttgggtgtcagactgctgtgtggctctaggcaagttccctaacctctccgaggtgaggtgttctgcatttgacattcaaaaccaattgagaaagaaacccagacatcaaatagggatcaaaatactacctcaattgctggtgaagctcaattggaggaagctgtttggactagagtccagattgattttcaaatacttccctctgaatcatatggacttgcccactcagctgcagggaggagaagctctgctcagtggttacttccacttgcacatcagagcagaaagaagaatacaaatgttctgtgggcaggtagacccaaaggaagaaagaccacatgggaataagagctttggaccttagcccttcccaagtgaggaatgtaaacatgatgcc

SEQ ID NO: 478089 - DNA, 688 bp, Homo sapiens
cctctgtcttgataaatcggctctatgtgggcagcagataaggaaaacctgttgggtggttacaaatccataaaatggaggctaatcagaacttcagagcagaggtactttggatttatggctgaggagtcacttttccacattgagctctggtcttggggccctggagaggccaggctaaggctctgggaggacagattgtcctggttcttttgggctgtggagaggctgccagccagaggagaagaaacagatatgttcagacaattagagaacttggtcaacaccgaagaagaagcaaattgttttttatcttcttgtactgttacactgttacacatccaaaggttttttatggaattgttttattctgaaagtggaggccatggccatagctctggcagttgtggggcgctgactgagagtcaggcaggcctgggtgtgaattctggtttggctacctgcaagctctgtggcctcgttcccagccgaacacctaatcaagcccaggtcatctggtcatctacctagtgcgttctcttcttgtaccaccaatttcctggttacagggcttcttagatgctgtaggtggggtctaggatggtgagaggagggcttgagaggagaactacttgatctaggctttgcatttatgtaactgacaaacagtattgaatttagacttttg

SEQ ID NO: 478090 - DNA, 739 bp, Homo sapiens
ttattttatttgcattggattgggaaaatgggtattatttattcagaggagagtcccttggagacctcaacagaagacacaagctgttgtgggaattgtacctgtggcaagacaacatttttggaaatgtttagtgatggtatcacctccatccacatccttataccccttgaacttcttcttcacctcatccaagtagagataagaatttttgatgcttttcccctcagagaaggaatgagaagattctgcagcagatccctccctgtggcactgagtttgggcacgatgttcaccagggatgttgtggccgggtacaatggcagccagaagatcctcttcaactggtcatcgacgtcattgcctggaaaaagaggccatccagcattggccagctctgcaaagatgcagccagctgaccacaagtcaatggacgtggagtacagcttggccccaaagaagacatctggtgggtggtaccacagtgtgctggtgacagaatttgaaaaccaaagtcagcttcttgtcgctgtgcaggaggtcatgaagcctgacgatgttcttgtgcttcagctccttgagtgtgggtctatttctgaattctctgttctgttccattattctatgtgtgtatccctataccagtaccatacagtttggattaccatagctctatataagtcttgaaactgaataagtcttgtaacttattgctcccactttattcttctttttcaag

SEQ ID NO: 478091 - DNA, 1270 bp, Homo sapiens
ttgctcacagcctaaaggaggagattcccgcttaaaccagcagttacagacaaacgcaatccaggctctgtcatggggcccttaaggaatttacttaacctccctgtgcctcagtttcctcatctagaaaaacattaccgggctgcgccaggatgcagagtatatgcaacaggactatccgtccctgctgctgccctttctacccgccctgcccgttgtcttgtagattgtcccatgttctggatttttctgattgtttccttctcatgggatgacctaaaaaacatttttttttttgagacggagtcttgctctgttccccaggctggagtgcagtggcacgatctcggctcactgcgagctctgcctcccgggttcacgccattctcctgcctcagcctcccgagtagctggactacaggcgcccgccaccacacctggctaattttttgtatttttagtagagacggagtttcaccgtattagccaggatgccggcaagaacgaggacacttcacagggctgggctgccgaggaaagatgagagactaaactgatgagaatcaccaaccagtttgatgacttggagaacagtcacttcctctttctgggctacagttttctcatcagtaactgaagagcttgcagtaccttcaacattccttcagagctgctctgtgagaagacaaggagaaaatggtccctacaggatactcacctctgtctcagggagacactcaagcatttattcaaccaagaaagagaattagttccagtacagacagccagcatgcagtgagcactcagcgatggccaagtatgggagaagccatgctggaatgaacatgtgggaccattttgtgcagtttctcagaggaagataacaaccatcttcaatggcacatggcagttgccaaattgccatgaagcaatatctaaagccacctcatgctcaggagaaaacgctcaccttcccctcctggctccccgtgctctacacgttcagagaaacttctctagtaatgaactcaggaactggtcactgagagtatagtctctatggacagcttcggagccatggagtgaagccgagcaaatccatggaccactgccctgcccccggtctatctcgctagactagggacaggacttgggtgatgcaggaacagagaatggcctgaggaggacacagaccagaccagagaggaaggaagatgagaggaggatgcgggaaaggggcttacatcaatctccagaagcaagagttggc

SEQ ID NO: 478092 - DNA, 466 bp, Homo sapiens
gagggaagcgggtccgcctgccggatctaacccaagtttcctcaccatgggcatgtggtccctcggtgcaagagccctgggggctgctgccttggcattgttgctggccaacacagacatgtttctctctaagccccagaaagcggcactggagtacctggaggatatagacctgaaaatgctggagaaggaaccaaggactttgaaagcaaagcagctatgggaaaagaaaatggacctgggaagctgcggatctgtcctccctaaaacccatgtggacgagctgggtgtccccctctatgcagtggtaaaggagcacatcaggaatgaagtgaaggatttccagccttattttaaaagagaaaccttcctggatgaaaagaaaaagttctatggtccacaaaggcagaagatgatgtttatgggatttatctgtctgggagtgtggtacttctgagcctggaat

SEQ ID NO: 478093 - DNA, 641 bp, Homo sapiens
agcacaaccataaaaagctataaaatggtacgtgtgccagctggacacaccaacagcagctcccccatgatgccccacctggggctaaggcttaccagtctggatagaagatcaaaccagctgcaacattctcttaagccaaagcctaacccagagcaaggcccaactctcttcaattccatgagggctgagagaggtgaggaaactgcagaagaaaagtgtgaagctagcagaggttgtttgttcatgaaatttaaggaaagaaaccatctccatagcataaaagtgcaaggtgaagcagcaagtgatgatggagaagtggcagcaggttatccagaagatctagctaagatcattgatgaaggtggctacactaaacaacaaattttcagtgtagatgaaacaaccatatgttgtgagaagatgccatctaggactttcatagctacaaatgagaaggtgatgtctgaaatggaacaacaaagtctggatgacagcgcgtgtttactgcatggtttggtgaatattttaagttcactattgagacctactccacaggaaaaaaatagagatttctttcaaaatattactgcttattgaccatgcacctagttacccaagagttctgatggagatgtacc

SEQ ID NO: 478094 - DNA, 659 bp, Homo sapiens
cctactagcaacatggcgggcatcttcaccaagcatgtcttggctcaggctattgccagaacccatatccatccccctgctccctgcctgccccctgtggagttcctagaaatgtcaaccttaaaagcacatcaatttaaacaccaagatgtcttcagtgtttgccctggagctccagaagcttttggtgaagggagagaggccgacatatatgaagaagagatgctcaatatcaacatcactaatcatcaggaaaatagaaatcaaaaccacaatgagagcatctcacacctgttaagatggctattatcagaaagacaagagataacaagtgttggaaagaatgtggaggaaggggaaccttgcagaccgttggtggaagttcagattggtacagccatcatgaaaacattacaaatagaactacaaatagaactaccgtatgatccagcaatcccgctaccagggagctatgctctcttacgcattctaagtggaagcaggatgatgcactgaaaagaggggaaggagataaagggaggaattcaggatggctgctaggcttagtttgagcagtggaataaatgttgacgccacttactaatagtaaaatggatctggggggaaagtcgagaggtccgtgttgcacatgtgaagcc

SEQ ID NO: 478095 - DNA, 821 bp, Homo sapiens
aacaacccagagtttgcatttcaggggttggtgcatttcagggtgggaagagctgcaccaccagggcggctggcagctgcaggggcgggcacctcaaaggactgtctagagcagccgaccacccagcacgtgctcagtgaggcacatgcaatcaacctgaaatatggtaggcctggtcctgtggccctgtggccctgaaacagacctttcccgcttaaatcgtcttcttgatttggaattggtttttcatcaaaaattttcattcctttcttctctgtctggctttgccaagacggttttgccagaggatgaagaggctgaactcatcagtagagctgtcggcttacaagagggattcccggtgtcccagacgattagtgctgatgatgcacatcaagaggatggtgttatgagatcatccgggaactggccggacggatcaggacagcccacaccagggggacgtctgggaaagcagggagccgaggatgaactcaccgaagctctctccgctgctggctctatttctctaagtctccatatacatgccaagttaatatcatatagaaaacttcagtgagtaacagtagaactgagcaaaagatccagtgtttccaggattcttttgttctgttttttcttgtgcccaaagtcccatgcaccttttatactcaatgttcttcccaagggaccctacattttccattttcacaaggccctgcagattatgtagctagcactagttacatgctatactttaggtgcaagtgaagctggaaaaacgtagtttcagcggattctaccttgggaaggaggatttc

SEQ ID NO: 478096 - DNA, 1541 bp, Homo sapiens
gaagagagaatacacaaagccgctctgtccattctgttctggctgacatggcccagccttttatttgtgtcagtcatgttgcttgccaaaaatcagaaattcttgaccctctggacagctctgtgaggagggaatgggagacatcacactttctaagtgaggaagcacagaagggagatgactttcatgaggttcgaagacagaggtggattcagagcttgaatctacgtcttctgcctcagagcccctcgcgtgtttaccacatgctgccagagactagaaattccatgaaatctgtcagagatagaaagaggcggcacaactttctggaaaattattggcttcgaaatgttggattggctcacagttgttcagcccttctgtttatcacgaagatttgtttatctatttgctcatctgggtatcccacaggcatttccaacccatcgtgtccaaatcttttttaacattatatttgattatagatttagggggtacatgtgtaggtttgttaccattatatttgattatagatttagggggtacatgtgtaggtttgttaccattatatttgattgtagatttagggggtacatgagtaggtttgttaccattatatttgattatagatttagggggtacatgtgtaggtttgttaccattatatttgattgtagatttagggggtacatgagtaggtttgttaccattatatttgattgtagatttagggggtacacgagtaggtttgttaccattatatttgattgtagatttagggggtacatgtgtaggtttgttatcattatatttgattgtagatttagggggtacatgagtaggtttgttaccattatatttgattatagatttagggggtacatgtgtaggtttgttaccattatatttgattgtagatttagggggtacatgtgtaggtttgttaccattatatttgattgtagatttagggggtacatgtgtaggtttgttaccattatatttgattgtagatttagggggtacacgagtaggtttgttaccattatatttgattgtagatttagggggtacatgtgtaggtttgttaccatcatatttgattgtagatttagggggtacatgtgtaggtttgttaccatcatatttgattgtagatttagggggtacatgtgtaggtttgttatcattatatttgattgtagatttagggggtacatgtgtaggtttgttaccattatatttgattgtagatttagggggtacatgtgtaggtttgttatcattatatatgattgtagatttagggggtacatgtgtaggtttgttaccattatatttgattgtagatttagggggtacatgagtaggtttgttaccattatatttgattgtagatttagggggtacatgagtaggtttgttaccattatatttgattgcagatttagggggtacatgagtaggtttgttaccattacatttgattgtagatttagggggtacatgtgtaggtttgttacatgggtaggttgtgtaac

SEQ ID NO: 478097 - DNA, 1103 bp, Homo sapiens
gctcatcaaagtgtgtctagaggagatacccaggcagacagcaggctgctggtcaggaatatcccaagtcctataagcttggccaggcccggtgcctccgtgttttggtcccaggagctccgcctgccagcctcctccagctgctgcccgtgtgttctccctgaagagcatccaaagcccatgccttttcccaactcctcctctctcctgctgactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgattaacggggaactgcattctcagtatcacggctactacgtgaagctgaacgccccccagcaccctccagtagaagtggaggacggcgatggatccagccattcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggtacccctctacaccccaagggggaagggaagccccagcagctccgcagctaccctgagctttagactgcctctgcaaaattcaagaccgacttgacaccttcacgcgaagattctaataattaacattgtcttcccaatagtaacagaacgctgccatatgaaattgcacctcattctttaagatttgcacactcaaatacttc

SEQ ID NO: 478098 - DNA, 573 bp, Homo sapiens
ccaccgacagcttgcaccgcacacctggaaaagccgcaaacactcaacgccagcccatgaaagcagccaggagggaggctgtaccctgcaaagccacaggggtggagctgtccaagaccatgggaacctacctcttgcagctggatatgagacctggagtcaaaggagatcattttggagctttaagatttgactgccccactggatttcagactggcatggaattcccacgtgttgtgggaggaatccagagggagcttaatcatgaagggcgaggagggtttttccttaccagaaggaacctgggccttgccatcaggcctgagggcacaagaggagcagctgctgatcactactgcacaggccccttcctgcatgaggggacacaggcatctttttcctccttcctgttgtttcagctcccagtgcaactgagtctactgctgaactcagaaataaatttgaaaaccaaccacaaagtttaatcttgaagtccaccaatattttttagttatctaattggaagaggtcttctatttacttattgaaatatgaaaagaaaagaaaaaaaaa

SEQ ID NO: 478099 - DNA, 1342 bp, Homo sapiens
ctgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggatcgtcacactgatgatacggatgtgcttctccgtatacaccatgttatcggagagctgccaacgtatggttatcgtcgggtatgggcgctgcttcccagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaatatcctagggggatgtttcttttaatgtcacaaagagtgtacaaaacgtcataggaggtgtacacattgtgacgttatctgtaataccctagaaagatgttactcctaatatgtcacaggggcgtacacagtttgatgttacttataatctcatagagagatattacttcaaatgtcacagtggatgtacacacacagtgtataccctgtgatagtattcataatatcctagggagatacaactcctgatgtcacagtgcgtgtacctcgtgtgtgtacacccttgatattagtcgtaatatccagggtaaatattactcctcatatcacacagagtgcacactctgtgatatttttcatcatacttt

SEQ ID NO: 478100 - DNA, 1503 bp, Homo sapiens
cggctctttgctgctaaagttacctggaacgggagtcgttatgacccttatagtctcccgagaggaggaatggagacttttcttcattgagctggaccaagagataagaccagctctggctaagcgatggccaagagtacgggcggaagacaaccctccagggctggcagtcaaccaagcccctgtactcatagaagtgaagcctggggcccagccggttagtcgggtgcgccaagggaacagatgccctacaccagcacctggaggactgtgggtagaaggtgtccaagaagaaagctcagatctgccaacagcagtacaagaagcacataagctgactcttggccaaaacctgaacataaaggcctcccgtgttgtggtgactttaatgaatactaaaggacgtcattgggtaacgaatgccagactcaccaagtaccaaactttgctccgtgaaaatctccgtataaccattgaagtttgtaacaccctaaaccctgccaccttgctcccggtatcagagagccctgtggatgggagcagcttcttcaacccccaaagagagagaggtgcagggtatgcagtggtaaccctggacactgttgttaaagccagatctttgccccagggcacttcagctcagaaagctgaactcattgttttaatttgggctttagaactcagtgaagcccttgtcaaaacggtgccccagtggtgtgttacctgccgacagcataatgcgaggcaaggtccagctgttccgtccggcatacaagcttatggagcagccccctttgaagatctccaggtagacttcacagaggtgccaaagtgtggagatctgattcctacatttggactgcccttacggatcggctcagataacgggcctgcgtttgtggctgacttggtacagaagacggcaaaggtattggggatcacacggaaactgcatgccgcctcctggcctcagagttctggaaaggtggagcagtgcgtgtacgtctgtcgcgacattcaatggaatgtcatcctgtgcctccctggatatgacgaacaatatcacggaggatgtacaacttctgagatattgggagtgatatcaatttctcccttctggaagttagggacaacatcacaggggaacaatatcacagggttgcataagcccccttcgatattggaagtcatatcatcctctttccctgtggatattaggaagagtatcacagggctgtgtaaaccccctgcagtactgggagtaatattatcctctctccctctggatattagggagattttcacaaggaattacttcgatattgggagtaatatcatcctctatttccctggatattgggcgcaataacacaaaaagttgtacaacccctgccatattgggagtaatatcatactctccttccctggatgttagaaaacaatatcagcagggctgaacaccccctgcgataatgggagtaatatttactctttcacaggcca

SEQ ID NO: 478101 - DNA, 718 bp, Homo sapiens
atcaaccaggacgtagaaatgatgaagtactcaggcccctgtgctgcaggtctgctggagtttgctggaggtccactccagaccctgtttgcctgggtatcaccagtggaggctgcaaaacagcaaagattgatgcctgttccttcctctgaaagctttgtcccagatagccactcaccagatgacagccagagctctcctggctgctgcctttctttcggagatgccctgcccagagaggaggaatctagagaggcagtttggcttcagcagctttgccaagctgtggtgggctccacccagttcaaacttccatgcagctttgtttacactgtgaggggaaaacagtctattcaagcctcagttgtggtggacgctcctcccactaccaagctcgatagtcctagatcaagctcaggctgctgtgctggcagcgagaatggcaagccagtggatcttagcttgctgggttctgtggggatgggatctgctgagctagaccacttgactccctggcttcagccccctttccaggggagtgaatggttctgtctcactggcattccaagagccactagggtatgaaaaaaaaactcctgcagctagctcagtgtctgtccaaacagccaccagttttgtgcttgaaacccagggccctggtggtgtaggcacctgaaggaatctcctggtctatgggttgtgaagaccgtgagaaaac

SEQ ID NO: 478102 - DNA, 654 bp, Homo sapiens
gacttaggaaaagcaggtgggagtcatgtttggagcaatcccagatggagttcccagtgggtttttttgtctggacaggaatctgagtcaattttggtcactggcagctgggacacactcagcttttttggtttatatattaaggtgcaccaagaacagccaagttatgtgtcacgggctggttttccaggaagcaggctctgggatgaagtttcgtgagcagagagtttattgggaagtgccctggagaatagcacctgtggaggaaaacaggcttgggcagaaggagaaaatgagttgcaatgcgtgcctgccagcttccgctgatctcaccagggctttgacattggaatggcccatcagagtcgccctgtgttgggcccagatggcctggcctttattctcttttcctgcttcattggtcactggatgtgggctgcccggaagggtgtgacttggggaggcagctctctgcagatgaggcaaaccctgaaggagctcacagctgtttgggaagagggaggcaaatttacatatactccttatgttaccctttatgtttaagatcaaagggcatatgcctttcatttttgttttaaaatatatgtttgaatgatacatgcatcatagtatgaaatatttaacatacaaaat

SEQ ID NO: 478103 - DNA, 571 bp, Homo sapiens
taggcagaggaataagatgaaatttattcctggtgaagagggtgtgaacactgttgaaatgacaacaaagtgtttggaatattccgtaagcttaattggtaaagtagcagtagaacttgggggaagactgactacaatttttaaagagattctaaggtgggtaaaatactatcaagcagaaacacatgctacagagaaatcttttatgaaagaaagaatcaattgtgcagtaatcttcaatgttgtcttattttacaaaattgctacagccaccccaaccttgatcaaccaccaccttgattacttagcagccatcaacactgaggcaagacctttcaccagtaaaaaaagattaccactcactgatagctcaaataatcattacgattttttagcaataaagtaattttaaatcaaggtttaagacatgttataagctgctcaacaaaacgctgttattatggaccatctgcatgaaaatggaaatatctgttagagtcacttattttaatgatacttggtgttgtgaaatttcactgttattctgcttctttgctttgatatatctttc

SEQ ID NO: 478104 - DNA, 744 bp, Homo sapiens
cggctgggaagatacgatattatgacaggccatgttgagaaaggtctctgcagcatgtgtagcagtgcacaaagcttccaaggtctccacattctcaccaacatttattttccatttttcgatactagccttcctaatgagtgtgagaagaaggaatctgctgatcttcagttacctggggcatctctgttaatacgaaaaagaagaggggagatgaatgaagccttgagtctttctcaaatgggaagttggaaccaaggggcctacataaagtcagcactttcaaagtactgctccctattaagagcaaagactagaaacaaatccactccaacagaaagacaacaaagagacagggcatctaggaaacttttatgtggatttctaaagcaccattacccagtcttatttgaatatggagtcctttcttcccgcaaaagtaacaatctgcagggcacatttagggaaatagtgggttaccctccatcggagcaataaatccttcaaccatggctgcttttcttgtatctataccccacagttttgtgatgggactggttctcatatgttttaaagaattttaaatgatttttaaaagaaatgttaatatatttgaaggaaaaagacaatggtttgttataaacaatagatatgtttcttctgttattaaaacagagcctagatttggtacataagtatgtgatgtactgacacattttcagagtttctaaaaatgttaaaaac

SEQ ID NO: 478105 - DNA, 1277 bp, Homo sapiens
gccagaatccaaacacttcctatctggccccccgtccaacattgcggatcaaattgtgacatgagatttgatcgggcctaacaaatcatatccaaaccatagcaatagatatagtggtgactgaaaccacacgccatgttgggagacttccaaacaagtctagagagttggcacttagggatgaagaaatcatcttctgggtacacttggtctttcctgatgacgcttttaagagaaaggcagagttgaccctgggctttcaaaaaactgttctttcaggcaaaacctcagagagaactggctgctagtgatcctctgcagagaccttgaagagcacggcaattatgaaacttcaacaagaaaagatttaagctgatcttttaaaaaaatatatactgtcaggaattttgtagaaatgactttaatgtaataactgcttctttgacttatgttttgtcttgtggtgaaaagaaaaatatttataaaagcatgcctgtgtcctaaaattggggacacaaacttaaatgactgaaggcacttgaggagtggaggcaaggatggtgaaaccaggccctgtaccaagcaggagagcgtgaacctgctaaagagagtgactgcttctcatttccagtcaatgcgactggtgtcgcattccagtcaaatggagttgcgacaccatttcagccacagcgattgatctggattttctgtaaaattccctgatttttacatattgccaattaattaattaattaaaaagaaatgtagatgttcaaccatgctgtgaatctcaggcagccgccaacgttaaaggaaccttatgtagcatctatggatctctccaccttctccaaaactctgccactcaagctcacacggttccctgacttacctgcaggattagtcctaggctcgaccttggaagaaagaatgactgagctcctgctgcagaagataaactgtgaagcctctaacctcttctgcagtgctctctctctcgccagccccctagtgaaggttgacaagcccttgaggttcttggacacagacaccaaactgtggcataggagaaagggcaggaacctgagtttggatgtcaatttcctcacatacccttcaacaaatcccttggttattcagcagataatttatactccatgggaaagttggcagaatgtttcaaattatttaaaagaaactgtgagtggatgagaaaaagaaacttgagttctcctatttaatgttttcacattttctctattttgatataaaataaa

SEQ ID NO: 478106 - DNA, 535 bp, Homo sapiens
tgccctattcttttcagtctcacggcggcctgcagtagggctatggatggggaccttcccatgggtgcatgggagcaggtgatctccgctttccctccttggaggagtgcagcagcagtactgtgtctgcagatccccattctatgcccaggtctaatgacgactctggtggcctgtgtggaaatgcaccatggcatcctgagccatcctggggagcatgtctctaaaatccaaaggtcaatttcattgattgatgtctgtgccacctgcaccgcaaagagcgaccttctaacctgtgtcctcttttcacctctccctggggacaaaagccactaccttatgggcaccacctgcgtaccaagcaacgactgtgccacagctggaaacaaagccttcccagcttgtgcagccatcctgaggagtaaagtgaatgctatgaagtactgatccaacatatgatggtgttttactcacagctaaaacatatggttcacagaattgaaagatggaaatagatttggtgctttcctaggtt

SEQ ID NO: 478107 - DNA, 1247 bp, Homo sapiens
ggaggcctggtttgaaggacacaaggacactaagacctgttctttagactcaagcgccatcttgctttctgggaaagggctctctaacaacccccgactcttcagagttgggagcgttggtttgcctggaacgaacttccacttttcctgtacttctcgactgagctgagggtcagcagagaggaaagccattcagctccagggtcccaacaagatgttggttgaccttgcagccatgagcagaactctcaaaaaggaagtaagcaaagaaatctccaaaggaccacaaaaccccccaggctatcggttatgtccccttcaagctgtagggggaggggaatttcgcctaaccccggtacatgtccccttctccctctctgatttaaagcagatgaaggcagacctggggaagttttcagttgatcttgataggtatatagatgtcctacagggtctagggcaaaccttcaatatcatttggagagatgtcatgctattgttaggtcaaaccctggcctttaatgaaaagaatgaggctttagctgcagcccgagagtttggagatacctggtatcttagtcaagtaaatgatagaatgacagctgaagaaagggacaaattccctaccggtcagcaagccatccccattatggatccccactgggacctcgactcagatcatggggactggagttgcaaacatctgttgacctgtgttctagaaggactaaggagaattaggaaaaagaccatgaattattcaatgatgtctaccataactcagggaaaggaagaaaatccttctgccttcctcgagcagctactggaggccttaagaaaatatactcccctgtcacatgactcactcaagggtcagttgattctaaaagataagtttattacccaatcagctgcagataacagaagaaagctccaaaagcgagccctgggccctgaacaaaatctggaggcattattaaaccaggcaacctcagtgttctataatagggaccaacaggaacaggcccaaaaggaaaagcaagatcagagaaaggccacagccttagtcatggccctcagacaaacaaaccttggtggttcagaagggacagaaaatggagcaggccaatcacccagtaaggcttgttatcagtgtggtttacaaggacaccttaaaaaagattgtttaatgagaaacaagctgccccctctcccatgtccactatgctgaggcaatcactggaagg

SEQ ID NO: 478108 - DNA, 1421 bp, Homo sapiens
tgaaggcacaacctaatttctccttactacttatagcaaaatgggagaggagagagataagttgaaagaattgttacacaaacagaaactggaacttgaagatttgaaaaattctcgggctgtccacgttgcaatagatgaaaaattacattctgggaagaaaaatcaagaatgttgctgtttgataaagagattacaggtgtgtgacttatggatccaatcagccatatcagcagaggcaaggaatagagatggggttgtaccggcaaaaatgctgttttggactgaaggaaacgaggatgagacagttaaagaagactatctgacttctgggattctacagaatgatccagtagagatatttggcagtgaacatgtatttgataactttacttattttatcttgaagcttgctgattttttcttctgcctgctcaactttgctactgaacacctctagtgaattttttatttcagttattgcacttttcagctccagaatttctgtttccttcctttttataatttcactttattgatatgttcagtttgttcatacattattttcctaatttccctttgtttatacatggttttcattagattttttatcatatttaatacagttgttttaaagtatttttctatgttctgacaatgttggttctgtcaattctgccggtttttcaatgtttcagtttgaggatgagagcttataattggttactttgcaattttgttaacatcactaccgtttgtttttataaccagtatttacaactttgattgtctttgtaacacaacatgaacatctcaacttttatttgaagatattaacacattaggtatactgacaaacaatatattgtcctaaatttccttgattctgtcataattttagtgcttcatcacttcatttttcttttagcctttttctgtatgagctttgggctattattttttagttctttttttcttgttattttataaattatacattttatttgaatactactatttattacttttgaattttcaaaaaacattccttaactttcttttatgtacttatgaaggtaaaactggaatgatatcttttgaacttcctcaatataaaacaagtatgtttcattgtttccttgttctccaataccaagtataatataaagggttttttagggggaaaaaacaccttttttgctagtataacatgaaattccaaaaccagagaattgttattgaattatttcaaagcatatacatattatttttaataataatttatacaatgacgttaattcttagaacccataattacaactttttagacttgactctggactgcagtttccagtttccaccatcaatctttacatactgccttagtcagtttgggctgctgtaacagaataccatagcat

SEQ ID NO: 478109 - DNA, 1416 bp, Homo sapiens
gtgtgtgaaagacatgagggagtttagcacataccaattctgtgacctggggcaacttacacaacccttctctgtgcttcagtttcctcttttgaaaaaaggagatagagatacttcctacttcagggacgtgatgagatgtgagtttatacacacacagggccttggccatcgcctgacacatgagcgtgatccttgtacttgtatgaaaaaagttaactgtgaaacagcctcaggcaggtcctccaggcagtatccagaggaaggcattgctatcacagagatgacagctccatgcctgttattgcccctgaagactttccagtgggacaggatgtggtggtggaagacagtgatattgatgatcctgaccctgtgttggcctatgataatggatctcaatatgttggccaagctggtctcgaaatcctagcctcaagcaatcctctagcctcggcctccaaaagcggtggaattacaggcatgggacaccatgccttgcctttaccttttctacatttagatatgtttggacacaaaaatgcccctgggttacaatggcctactgtattcagtacagtaacatgctgtgcaggtttgtggcataggagcaataggttatactacagctataggctataggcctaggtgtgtagtgtggctttgccatttgggtttgtgtaagtgcattctatgatgtttgcacaataaccacaaaatcactaaatgatgcatttcggagactgtatccccaccattgagtgatgcatgactttgtgtgtgtgtgtgcgtgtgtgtgtatatgtgtatatatctcacttattaggcataaaaatgttacaaatttagatgctatagataacagtatatctgatactgtatattactacagatgctgtggggattagaaagataagaatgtcatgaccaactttttataccactaaatatgaaaataggtgtaatatacaaattcctagagaaatatgttaccaaatccgactaatatatgaatgcaatttaccacattaagaaataaagaaagcaaagttttatgatcatcttataagcttcagaaaaatcactggtcacattcaacaatcattcagtatacaaacttacagcaaattagaaatggaaaagaactttcaaaacctgatgaatgacatctacagaaacctacagcaatatcatactcagtgataagattttaaaatgaggaacaagctgaggatagccaccatcactacttctaatagacattattctgaaacttttatttattgtcataagacaagaaggcagaaataaagccatggagaagaaaagaaacccattgtctttatttgcagatggcatgattatctacatagaaaaccccaaatctatgaataaatgattagtataagagtgttt

SEQ ID NO: 478110 - DNA, 484 bp, Homo sapiens
cttcacagtggggattgtggtaggttatgactcacatagcaaaataatggtcccaaactctggaggaaaactagaggggatgcttcccaggtatttgaatctggagctttgggcctctgaaagctccatgggcccaggcccaccagggagttggaggcctgtctgcagaagccggtgccaggaccacagagctctcagccacactgccctcctactcctccccatcttctctgggcttgcaccaggccctgccctggtcagatatcctccaaaacgccccagcctggaggctacaacttgggagcctcagttgccccctgcgctgaggaagcagggaactgtggggccctgtgactcttcttccctgacttccctggatgtcccacaccatctctgctctcccctgcctcctggagcccttgggctgctggccctgccagagcagagaagctaagctagaggatgttctgtactagcagtttac

SEQ ID NO: 478111 - DNA, 580 bp, Homo sapiens
gttttgtccctgccctagagatttatgctgatgacacccggagccccctgctatcagccatggtcaactccactgtattatctaacatcttgggtcatgccttttttgagctgtttgcagacagagttccaaagacagcagaaaactttcatgctctgagcactggagagaaaggatttgggtataagggttcctgtttttacagaattattccagggtttatgtgtcaaggtggtgacttcacatgccataatggcactggtggtaagtccatctacagggagaaatttgatgacaagaactacatcctgaagcatgcaggtcctgtgttgttcatggcaaatgctgaacccaacacaaacggtttccagtttttcatctgcactgccaaggctgacagtggagacaatgtgagcaagaaagccctgagccctggccctgtggagtttccactgcgtcaggagaaagcgtaagtgccctgacaaagaaaagaggtgttacattggataactcaacccacaacaatagctaagtattgaagacttcaatacatttattgcattgtgagctgtatttgggg

SEQ ID NO: 478112 - DNA, 569 bp, Homo sapiens
aaatgtcacgtattattaccgctgccgccacggtttctaatcgcgttaaacatgggtaatgaagccttctctggccagcgcttgacaaagccatcgctgagcagctgccaccagggctccacacacgctctgggcaggatctgctcccaacccgtccaggtccacaaaggctcctgtttgaagctgcaggcctgcaggcagcccaaatatacctgcgagctggactgggcctgctggccacacgtctgggattcccgtcgtttggttggaacacatcatcatcagttcccctcacccctgtcttacaggatccgccacggcctccaccctcagacacaaggagcgcagacagagaaacagggaagacatcagatactgaagtttgtgttaattggggagtttttgctatgctctattccaacaaatattatcatcgtcatcatcttcattttcaatttcatactgtgaaaaacctcatagtgccagaaggaatgaaatgaaacataatgaaatgggggggattttaaaaattgaaaagcaaatgaatcagacacatagctagagtatat

SEQ ID NO: 478113 - DNA, 503 bp, Homo sapiens
cacaagaatggcaaggctggctgaaggcagcgattacagccacagttgtaatactacaacatacagtggcaatggtggcagtgatgggggtggctactatctcttaaatacgtggaccctggcatttggagcaagaggtcaatccataatgatgatgacaatagtagttcctatcattattgccactatagagaacatttccaaggtgcttgctgtgaaggatgccctggtgaccacctatgcaaggccacagtttatcagcgaatgtccacccacacaagcttgtgtccgggaagatttactgagcacctactctctacctggcactggaggaagccacgcttcctcggagcagcggtcttatgtgtgtgttcagcccacaaagattacacagcacactcaactcagagccacattcgagcttcatacccgccacatgtgagatgcagaggatgtggctcttctgtgaaggggaaactgaggtttacaaaagttgcatatgt

SEQ ID NO: 478114 - DNA, 1225 bp, Homo sapiens
ccacctgggcatgtgtggttcctgagctcacagaaggccttgggagtcccgaaacttgtctctcacttgagagggaatggtcctgttccccagaccactgggaccacaggaaatgtgttaatggggaagacccctgaacctcagcgctgttcatctcccatactctctcatgcacgtgtcttaccaagggatgtcctcgatgcagtggaccagtgagaaacactatggcaatgaagccctgatggagaagtgtgagctagagccgtcagaggcagcttcatgcaggaaggagcggcagaggatcctggggtctggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggcgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggtgtggggagggaaatgggacagaaaagtcatttgtcatagttggtgttaatttccattggtccaactc

SEQ ID NO: 478115 - DNA, 811 bp, Homo sapiens
atcccagaggtgcagaggctagggatggctgctaatagaccctttgtgggaagtcttcccatgtctgggcccctcaaggctggctccctgggttgggtgaacacacagtgcctgtccccacacctgggagtgtctggaatcctgccaggccacaccatctttcctttggccagcatcacttactcttccctcgtgggccctccagggcttcttagtttgaagggtctggtggtccacatgcacctggttatcttgtctcccttgcgagctgttccttggctggtcctcatcgccccagctgaggctgctttggggacacctgtaccccacggcttcatctggtatctgtgctcctgttccctcttcctgtctgcacctctagtagagcttctaaacttcaactgggcatcctccaatacctgctacctgtccctattgggagtctcataggtgtttcaaatgcaggtgattctaaatggagttcaactcccctacaccatctgcatgtctgcgattccatctcactctgctgtttagaatgagagtaaggcattactttttagtttcccattgttccgctgacttattgatgcctcagggacttaagcaactatgcaaagctaatggtaaggaggggcttgagggcaaagatggtgaccccttcctgttgggctttaatcaggcaatgctgcactgctgccccaaccctaccacccttttcatcagatctgaaatctatgcctggtgactgaggcagccctgagttaagggatcatgttccaaggggtcagacaaagctttgcagggctct

SEQ ID NO: 478116 - DNA, 1071 bp, Homo sapiens
tgggctcctgggaatgcagggaagaggcacaccattttcaagacagaggaagcattctcatgaaagatgaagaagaaacggagaaagaaggggcctttctaagaggagaaatcctcatcttcatgcaagggctgtggcttcatctcacccccttccctcccagctggactggaaacgagattggcacagacactgagctcaaggagtgtttccccagcactgtagttcagaggaaagggactcctgggggtgccgcactcaggactcagtgtggagagtcagtctgtggctgccaacattcagcccagtgcttctctgagtcacccaggaagagggtgccttgtgggagggtccacacccctccccaggtgcagctcacagcccatgactcgtccaccagggggccaaatcctgtcaccttgctggatgtcacctacgaagtggagacagtaacaacactgttcttcctcctttccttgtaggtttcttgtgaggattaaacggaagaatgtttatgaagtaagtggaaaataaagttaaaagaagagaaaagattgatttgcaacctctgggctttacttccgtcatctgaagttgggatctactcaggtttcccatcctgaagtccacatttcactgggaaatagggtcgtgttctcagcagcgcttgacactaacagaacaaatacccagtgtggatttatacgtgagcgtcaattttatgtgtggattttggtgaaaaaaaaattaagtgatttaaaaatattacctggatatgccaaatgaaggttgatatattttgagtgaaatatcaaatatgtatgtgtttttcaaataacagcatactctgcttaaaaataatttacttttctgggtggtcctcttaggtcccccaacccagatgcaggggagggtgtgacctccccctgcacttctctctcagggctttggaggaggctgtgggaagcagcggagggagcggacatggattccagcttctatgttccgggattcttccagcaggtctttcccatctgtctctgattgctcccaacccagccttgtgtctgt

SEQ ID NO: 478117 - DNA, 3748 bp, Homo sapiens
ccgaggagatttgaatgcaaagccaggcggggcttgcacctatggtaaatgttgaacaacagctctttagaagagagctatttgtagcatttgccaatgtctataaggcaaatgttcccaccatggacaaattcaagctcctaaaagctgttgtcactgaatatggaagtttggaagagatgcatccaatggccctttctgagacagtgtctccagctcgccgtgggttccacagttccatccctcttattctccattctctaaatgttttcaagagcctttccttctcctggcaaaggtgcacatattggcctctggacagcaaccctatcatgggcactgatatggaaaaagcacacagttctttattgattgaactctaccagcgaagacattcagggggaaaaagtcttgttgaagttgaagctgtgtttaccctctgagcaaataatgtcatttctaggactttatctcagagacatacaacgaagcaatacatgcatggttgactgctgtggtattgtttctaacaggaaaagaaaattcatcaatggggaatagagaactaaatagcaacatattaaactgtctgagaatagctttctggtgctcagtgtggcccctggcaagaaattggcaatattccataaatgttggataaatacatctataaacatataaagtgcaatgtggccacttcaaataataaggtagatctaaattagctgaaactggtgcccaagatgcttaagtggaaaaggcgagtggcagaacagtgtgtatataatctgttcctgtttgatagtttctctctttatttctcctgtgtctgtgtctaaatactttcaaacatgctgaaaggacctgtatagctatagaagatacacgtcggtgttaatttctagagaacaatatggagggacttgttctgtaattggtcttttacattcagcagtatgcattagacaaattcacatggaaatcagcacagcactgcatcattagtcctgatgattgctcaatatatcattatagagagttttcattatttgtgttgatgtttagcacctttggtgattccagataatctgcagccccacacctcactgtttgaaccaaatgttgtctttgttttttaaaacatgaaaataaactcatggggaaattgcacatatgttctttatgtttgtaatcatttcacgtatattttttctttttcactgacaagatgacaagaatccaaagaagaggtcccacatgaattgacaaactcatggaatttctggttcctaactctagaaatatgtatacccttttactatggaaatttccaaacatgaacaaaagcagagctaataggacagtgttcccaataccaagcttcagtgattatcattactcattttgtcccatcgtccccctgatttttttttgtggggggcaggtgtggggctgtactgagaggccaatcctagacattgtgtcctttcacctgcgtgtttctccagtagacaaccagtccatggcatttcaaaacttagatttcttattagatgcagagtcctcctcctttcctttacccccagagtaggagagtgtggttctctgctggggtctgtcccacagaccctgacccaacagcggatgaataacatacactgacacagatactatgcttgtcagtccagctgagggtccaggccacttacagactccaaggagagtactgtaaagagttgcagctgctgccctgactagctggccctgctggcatttattcagcacacattaaatgacaaagactttgagtcaacaccattagagggtaatcagccttcaacctggtcgccccccaaccccaacagcgagagagccatcctgcccgtgaatgatcaaaggttagttttaggaccaccagagtaaacaatttatttagataaactcctctacattcctatgtatctactctaagttatttactcaaggtaaggattaggctactttcagccataaccctatcctgagacttctgcagaaaccttctggccttccaagaagatttgtgtctatatcctataacttcaccttaaaatttttcccatcagcctgactgaactcccacaggtctccagcaatttggcttgggaaggaagaacatgccccccaaccctccaccaccgaccccacgaacacctcttgtgtccttcttccctgtgtgaatccatgtggactgcaggagtggggcaggaaagagggagggggaaagtcaggtgacttcttgcatggtcacccttgacaaaggcatcttttctctgctgcttgtccctgctccttcttgttggcaccgagggccctctgttctctcctcatcatgggcatctgaatgctgtctcaacagggacagttaccaaatctgttttctattgatgctgtaacaaatcacagactcagtgacttaagccaatacatatgtagtatttttcagctctggaggtcagaagtcctaaacaggtgtcactggactgaaatcaaggtgttggcagggctgcattctttccagaggtgtgagatggtagtttgtgactttcaagaggccaggtggaccctccagtctcaggctgccccatgcccctctctaccttctgtcacactgcagctctcaacaccagctgaaattaatcttgttcacatctctgcttccttgcttattgtctgtccacccagatttccacatttgaatatgaacaccttgaaagctgggtcccttttcatctggttcacaattctattccttgcacctggaatagtgcaggcacatggtagctgttcagtacttattgctgtggcctgaatgctcgtgtcccccaagaattcctatgttgaaacctaatccccaatgtattggtattagaaggtgggactttggaagctgattcggtcatgaaggctctgttctcctgaatgggattaggacctataaaagaggtcccagagagctagctagccccttccaccacatgaggatgcagcaagaaggcatctttgagccagagagcaggccctgcacagaaaccaaatctgctggcaccttgaccttggactttcccagcctccagaagtgaggcaatgcatttgttctttagaggccacccagttggtggtatttaagacacttattatttgttgaatgaatggattttacaaagactgatttaatcttgccccatagtgttttaggctctttgatgggtacattagtacaatgtttatgtttaaaaagtcatcatctgaccaggctccccaagcagatattcttcactggcaacttatagagacctgctcatcttcctcctccccacagaggcccacccctgcccctgagcggtttcaggaccagccaccagccttctgcagggctcagtggctctcttctcccagccccttcccacctcctctgctttctccagatccttctgaggatggactcagctttgctctctggagggtggtagctgctgctgttgctgcagctgcatttcctctcaagggaaaggttttcctctttttgcttaaatgtgtatgttttggtacctggtgctcctgctctgtgtctctgaatccttttcctgcattttaaactactttctgtgcttagttattaggtttctaagctatttctctctatgcaccctgttttagggagtacttactagaaattctcttgaaaggtggagtttgcaaatttgaa

SEQ ID NO: 478118 - DNA, 602 bp, Homo sapiens
gctgtccttggtgctgggttacatctgacaaagccaatgtagggatgcagatcctcgtccttgagatgcgtttctggcgtggccaaggcagtgtttccctgacatcaccaaagtggtgccctcatttgtctgtgccccagcctggctttgttcttgggatttccagctcagactgcatgaaggaccaggatggaggcttttactgctccagggagctccttagagactgtgggcttcctgaggcctccccagaagcagaggcctatgttatcatctttgacagccgcaggactgtccacaagggattggatgacaccccccttctccccatgtttcagggctatctgctctactcagtccaccaaaacaaatgggaatctcttccagaaacaccctcacagacatacccagaaataatgtttaaccagatatccgggcatcctgtgacccaatcaagtttatccataaaattaaccatcatagatgccaatcctgtcttcctgccaaatattcaatgaaaaaaactaatacctacccaaataaaatctcatgttttatattaaatatcaaatacccacccaactgaaacccaaatgcatacc

SEQ ID NO: 478119 - DNA, 731 bp, Homo sapiens
aggtttgttagaaagatcaaataagaagatgtggaggtgtcatcaaagagtctgattgttccgaaatggagcagatgtgctgggggtccaagctggggggcaggggagggatggggcctgatgacaagcagaaaatgcgagcccccagcacagcacaagtgccttatggaaaaggagccagactgttttccaagaaggttcctgctcctgcaactcctccctggctacagtctatcgacctgggatcccagccaccccaccctcacctgatcacttgggccggaagaagctctgtacttcctgagatggagctcccagaggtaggagggaggaccaccatttttgctgctccacagcctcagcccctgctgccctcagactcaggagggagcaaagatattaagaacgaacatgggccccaagcacagtgcagctgccttatggaagagcagccagaatgttttccacatgaatccctgcccctgttactcctcactgggcagagtctcttgacttgggccaacacaaccacccttccccccccatacacttttgccagtggcagctctgcgattttctgggaaggaaatcccagagacaatccacagcccctcttccatggcaactgtggtggtacagcccttactgcttttgagctcgggaaggaatacagggcctggttgcattactggcacctccaacgtgctgcagccaccatatggagatgagcc

SEQ ID NO: 478120 - DNA, 688 bp, Homo sapiens
cttggtgtctgaggggttttgtctgtggctcctttcggactcttggactcatgccagtgatttgcccaaggctcttgggccttcgacaacagactgaaggctgcgctgtcggcttccctacttttgagattttaggacttggactggctttcttgctcctcagcttgcagacggcctattttgggacttcgcttgtgattgtggaaaacattactgtttgtttacaaggtgcaagttttaaaggaaatgaccataaaaactttttaaaagatatcttgatgaacatcatcaaaaccaccatttctattaaaaatgtcatacaactggaatcatataaaatgcagcctattcagaccaacttctttcagggggaaatcattgagttttccaccatgttccttgaatttcctgaatctatagtttggtgtcctgaaattaattcagggacattcttatgaacgccatggaaaggcatttggataaattattttgaaaatagtcattgacattaaaaacatattatactaagactactgtcagagactgcaagatgttgtaaatattctttgctaacccaattagaatttaagttatttgaaacttgtactcttgtccatgaataaatagtggtttacttttaacacatgcatttatttgagtttatctatttaaaagaaataatatgtga

SEQ ID NO: 478121 - DNA, 817 bp, Homo sapiens
acccgtggccacccatggaccaatcagcatgcacttcctaccctctgaagcccataaaaatcccagactcagccagactggggcagatgaggggatgacctgcctgcagagaggagctgtccactgtgggtctctctttgctgagagatgggcagataatgggacaacctgtctgtggagaggagctacccactgcaggtctcttctgagctgttccactgctcaagaaagcacctcttcacctagctccacctccacttgtctgtgtacttccttcttcctggatgcagggcaacaacttgggacccatagaatgatgggaagcccagacctaggagctccccaagccagggttgtgacaccgtctttggggatctctggttctggtgattccaagcttccagtgccaccgtgttccctgatgccagtcatggaagctgcttgcagtatgcctggtccagctgcagccttgcagggagccagcgcctgtgccggtacttggagctgcctgccccaccacagccagcaagcctggctgtgtgcagtggctggaccccacacttgctcactcacatactcctcactgctctgcgcctggctcgcccttggcaggcatgggactcaggtcagtagcacgagccaagtgcagcctgccaggccaagtggacagaatgagctcagtgggcctgaccgaaacttgggcaaaggcaccaccagccacagaggtttccagccggaaaacaacaccccaacgatcctgtgacattatgtgcaaagacagctaatatcagattttcagaaatgaattgctgatatt

SEQ ID NO: 478122 - DNA, 858 bp, Homo sapiens
gagcagtgtaggcctcaagggatgacggtttgcagcagggagaaagcagtgggaacggcatggtcagaagccagaagttatgtctgtttcagagtttttcttctgcttcttctttcattcaagaaatcaaaagatacttggtatgatttcaatcttaaatttgttagacttgttttaaaaccgatcctgagatctatcatggagaatgttctatgtgcaattgagaagattgtgtattctcctgctattgggtggaatgttccgtgtatgttggctaggcccatttggtctatatgtttttcaagtcctctgtttccttatcagtcttctatctggatgttctatctatggggaatatccgatgggggatatccagtatccaatggggtactgaaatctctttctattattgtgttgctgtttaattcttccttccgttttgccagtgtttgcttcatttctttagctgattgatgttggatttataactgttatatctgcttggtggattgactcttttatcattatgtaatgtcctttgttacttaggacaggtgtttacttaaagtctattttgtgtgatggacatcacaatgttaaatgtcagaggagggtatttatttttatgattattttaatttgctcaaggcagcactaaattatttctaacatcattaggctattaatattataaatgaagacagtgttttccctgaatttatgcagagttgcttcaaatacttcactttatgtctcttaagaaaaagcctaagggaatcatcatattctttatttttcaaaaattattaatgtgtcagagttttatttagtttttcacattagccaccattaatcttt

SEQ ID NO: 478123 - DNA, 1194 bp, Homo sapiens
cagagccagacttcaataggctctgcgtcctgggaacccaaacagaaacaccaggatggctacagttccgggatcagaagaccgatatgcgggaagctgtgaaatagagatagtgcatccatgtaaaaagaggaacaaaaactacaaacagaccattctcaaaagctataacgtctctattgcaattgtgttcagagtttgttccttccggtgggttcgtggtcttgcagacttcaagaatgaagccgcagaccctcccaataggataaaagccacatggctctttatggagactgaattgcgaacagaagtgatatgcctcacttgccctggaagacccactcctgatggcaaatataaaaatggaaaagagttgtctgagctgtaccagacttcatacaagcaaaacaatcaagtcactgatgtcactgatagttttgtgtttttcaatattaattgccttgactacacccactactggggcaatatcaatgagacaagcttccaaaatgttcatctcttctcggcccaagatttctttgtcaacaccatcaccctatctttggcatcaaaaatagaagaagaaggaggagaagaagaagaagaaaaaggggaaagaggagatgaggaggaggatagagttcttgacctcctatatattatagtctgttaagaataatatatctgcaaataaaataatataataatatataatattatataaagattataagtaaaagagataaaacgattcattttatgtgagataaggagaaaaaggggaacagtaaaatgttctaaaggtgtctcaaaacaataatttgaaaaaatccattaatatgcaaagtggtaagcacatgtgtgtatgtaaaggtttttgattgtgaaaccaaatgacatgttggtgacactacaaatagctcagtaaaataaagttggaaaatacacgaagaacctcatattcatgtaaatgaccttgagttgtatcatagacaagatggggaacataataccttgttattcaaaattaagtcaaaattccttcatttaaagtttaaactcttaagtctaatagtcaaagctttgaagaaactggcccatattgacctttaaacctttatatttaactacgtctacaaatatttttctccaaaaataccggtctattctttctttcacaaaatatgcaatgaa

SEQ ID NO: 478124 - DNA, 1545 bp, Homo sapiens
agttcagatggaaccactcgaattccatgaatgtttttgtttaatcaagtgaacacttcagtagctcccagcatgaatgacgcagaagacgggtgatttctgcatttccaactgtggtaccgggttcatctcactggggcttgccagacaagtgggtgcagccctcggagcagggcggggcattgcctcacccgggaagtgtaaggggtcagggaattccctttcctagcaaagggaagccgccatgacagacggcacctggaaaatcgggacactcccaccctaatactgcgcttttccaacggccttagcaaatggcacactgggagattataccccgcacctggcttggagggtcccacacccacagagccttgctcactgctaacccagcagtctgagattgaactgcaaagtggcagtgaggctgggggagaggagtccgccattgctgaggcttgagtaggtaaacaaagcggccaggaagctggaacggggtggagcccaccacagcatgaggaggcctgcctgtctctgtagactccacctctaggggcaggacatacctgaacaaaaggcagcagaaacttctgcagacttaaacgtccctgggtgacagctttgaagagagtagtggttctcccagcacagagtttgagatctaagaacggacagactgcctcctcaagtggctccctgaccccggggaagcctaatttggagacacctcccagtagggggcgactgacacctcataaggctgggtgcccctctgagatgacgcttccagaggaaggattaagcagcaacatctgccgttctgcagcctccgctggtgatatccaggcaaacagggtctggagtggacctccagcaaactccaacagacctgcagctgagcgtcctgactgttagaaggaaagctaacaaacagaaaggacatccacaccaaaaccccatctgtacgtcaccatcatcaaagaccaaaggtagataaaaccacaaagatggggagaaaccagagcagaaaagctgaaaattctaaaaatcagagcgcctcttctccaaaggaatgcagctccttgccagcaacggaacaaagatggatggagaatgactttgacaagtcaagagaagaaggcttcagacaatcggtaataacaaacttctccaagctaaaggaggatgttcgaacccatcgcaaagatgctaaaaaccttgaaaaaagagtagatgaatggctaactggaataaccagtgtagagaagtccttaaatgacctgatggagctgaaaaccatggcacgagaactacttgatgcatgcacaagcttcagtagcccatttgatcaaatggaagaaagggtatcagtgatggacgatcaaatgaatgaaatgaagaaatacagagaacgccaaaaagatactcctcgagaagagcaactccaagacacataattgtgagattcaccaaagttgaaatgaaggaaaaaatgttaagggcagccagagagaaaggtcaggttacccacaaagggaagcccat

SEQ ID NO: 478125 - DNA, 669 bp, Homo sapiens
tgtaatctaatgcatccagttaaaactttaaataggtggatgttgttcaattcagattttcaactaattagtgtaataaaggcttccaggatgaagaggaccaaatgtaatgaaaaagatgaggaggtgctagcccaggggaaagtagtggaggcaaaggtgacagacatggaggctgagaatatgtcgggtattggcaggcctttaagtagtttggtacagctgctggaagctggtagagatattccagcaccagaccttaataaggagttattactacaagagagaagtgaagaagaacattctttctttcttgatggcagcaacagtggtggcagctgcatggccaagtttctggaggtcaataatcctttagacttcaaaactcacaacatgtatgatgtgtgtaatcatcatttgcctacttaggctaacacaaaatgtctaaacttttgatggaacaggttttaatctgtgcttcgtcatttaatgaacactaatcacttcctatgaaatcttcatttctacatagatctgaattccttgatcgtcttcatatggagcctttcaaataccaaggatttatcgatacattgtgataaatgttttgacccgttagcctattatttttttcagttcattttaaagggtatttacaaaacaccagcc

SEQ ID NO: 478126 - DNA, 686 bp, Homo sapiens
ctggtagatttggtgtctgttgctcatcaccaggtccgatcacacagtcttctgagagtaatggcttctgcttcactcccatcttccaaatttctcagaggctccacttttagccaactcaacatggatgaagtcggaaaccatcattctcagcaagctaacacaggaacagaaaaacaaacaccatatgttctcactcataagtgggagttgaacaatgagaacacatggacacaggaaggggaacatcacataccagggccttttgtaaaagccctgaagattctgagatggaaagttcgagcaaaagtgagagtctctaacttttatgtcatatcttatgaactattggaggaagatggccagtggttatgggaattttcacttatagagaaaacagaaccaagcatagaatttggcaatttagaccatgacagtcctttgcaattgcaaaaaaagccccaaaagtcttccatattgagaaggagagttcgctggaaagataaaaataagaaactgattaactgaaatgaaaacagaaaaaaatccaaagaaccagccaacacactaataaaagaaacccagaagcaatcaaaaagcataatttgacttgtataggcttataagagtgctgatggtgaacggtacatttttaataagaaaaccagatgtgacatacattttat

SEQ ID NO: 478127 - DNA, 2296 bp, Homo sapiens
gaaggcagcaagatgttgcgagccacagctccctgctggttcccccctggatacccagaagctaagaaggtggccgaggaggcggccctggaggcaagccgccatctgggaggggagcagagccaggccggtgctcccgaaggcagcaagatgttgcgagccacagctccctgctggttcccccctggatacccagaagctaagaaggtggccaaggaggcggccccggaggcaagccgccatttgggagcggagcagagcccggccggtgctcccgaaggcagcaagatgttgcgagccacagctccctgctggttcccacctggatacccagaagctaagaaggtggtcgaggaggcggccctcgaggctccagaattcccactgccctctcatcagcctgcccagagcttcgggctctgggtgccccagatgcacaagcaggcctcagcatttgtggacatccaggcggagccccagaacaggggtccggcggtgcccccagcgtggcccaagatggtgacggagtcgtgctacttccctgcgcagaggggatcggcctgccgcttgccagccgccccaaggctgacagagaggccctcgggagtccgcatctcagcccccaggaagaggaagacgatcgcccactcttccagcccttgcttggtcacaggttacacagatgccaagagaacccgggtggccagcagcagccaacgctcccgtggctccaaggtcggcagacagccagggaagacgcgcaacaggtcagggatggcatgcaagaccaccgccaccaccagctctaagcgaatcgtccgtcagtgtctcaagttctgcgcctccaagcaggaggccgaggagaaggcgctgaacgaggagaaggtggcctacgactgcagccccaacaagaacaggtacctgaacgtggtcctgaacaccctcaagagactgaagggcctgacccccagctccatgcccggcctcagcagggccgccctgtacagccgcctccaggagttcctgctcacccaggaccagctcaaggagaacggctaccccttcccgcaccccgagcggcccggaggcgccgtcctcttcactggccaggggaaggggcccggcgactcctcctgcagggtctgctgccgttgtggcaccgagtacctggtgtcctcctcgggccgctgtgtacgcgaccagttgtgttattatcactgggggcggctccgctcgagccaggtggctggaggccgggttagccagtacacctgctgtgcagctgctcctggctctgtgggctgccaggtggcaaagcagcacgtgcgggacggccgcaaggagagcctcgatggcttcgtggagaccttcaagaaagagttgtccagagacgcttatccaggaatctacgccttggactgtgagatgtgctacaccacgcatggcctagagctgacccgcgtcaccgtggtggacgccgacatgcgagtggtgtacgacaccttcgtcaagcccgacaacgagatcgtggactacaacaccaggttttccggagtcaccgaggccgacgtcgccaagacgagcatcacgttgccccaagtccaagccatcctgctgagctttttcagcgcccaaaccatcctcatcgggcacagcctggagagcgacctgctggccctgaagctcatccacagcaccgtggtggacacggccgtgctcttcccgcactacctgggtttcccctacaagcgctccctcaggaatctcgcggccgactacctggcacagatcatccaggacagccaggacggccacaactccagcgaggacgcaaacgcctgcctgcagctggtgatgtggaagccccaggcctcttccaaaaccgccatcagtcccgagagctcaccctgcccacctcgccgcaaagcgaaagaaactggagcagccggcggcaggagagggcaaaaagccaagagtaaccccaaccccccactcccggtcccccggaatccctgccgcggcccctcgggcctgtccacatccctctgcccctcccagacctctgtccttccaccaatcgcctcccgcagccccgagccgccactcccagtcccccgagtccctgccgcgcgccctcgcgcctataacgtctttgcgcttctaccttttggtctttaaagtgtgatcaaaagagacttagactcccacatagtaataataataataatggcaaacttaacaccccactgtcaacattagacacaccaacgagacagaaagttaaaaaaggatatcc

SEQ ID NO: 478128 - DNA, 702 bp, Homo sapiens
tcctgccagagttatatcaaaagaacatgactggctctaggcaagactgtgaagaagctatggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaaggacaggacaggacaggacaggactggcatcataagacctccgccaggcagactccaccatttcaaaagaaggaggaggaggaggaggaggaggaggaggaggaggaggagaaggagaaagaaggaaaaggagaaggagaaggagaaggaggaaagaaaaaagaatatacaaatggtggaaaggtggacatggctggagagaggcaaacagcagagagaacagaaaacacaggccccaccactactgttgttgggttgctgatgccacatgtcagcaaaatcagcgtctgaggttgaggatgttaagataataatggctctactctaaccaagtgccatgggaaaaactgcaaccccacccctgtcagcaaatgctcgatggggacccagatgtctacccttacccggctgtaagtggggtcagagagggctgagc

SEQ ID NO: 478129 - DNA, 619 bp, Homo sapiens
ctcactgcaataacattctaggacattgcctctgttcagagctctcctaagcaggcagtaattatgggcagtggaactaatcactgtacatatacctttaaagatgagtgtgggttcttcaagcacacatgtacagtgcatataaaacttagaagcatgtcagagagaagttttgacaaaaatcctactggacaagatgaatctgctgatgagtggacagagagaatagttcagaggagccacaatgacaaggcagcaatacctaaagaccgccaaatgaaaacgttaagtcttttaaccttgggaaacgcgactttatttggaaaactgaagaagaagatgttgaaagtgaagataatctcacttaggcatgtcagccaggaaatccagtcagagaactgggtttttgatatcagtgaaatccaaacagaaatagaaaaattacctatggtcgatcatagtgttatcatcattggccagagaaggaatttccagcctcctccatgtgaagatgacaaggatgaagatctttaagatgatccacttccacttaatgaatagcagccctgctagttagtgttaatggagatacaaatatgaaaagctatgggttatgcct

SEQ ID NO: 478130 - DNA, 677 bp, Homo sapiens
tcctttgcttaggttctgccctaggaggaacccgaagtgtgatgctgaattttagaacagagcaaagctttgcattgcctggtttaacttatatttccatgatgattagtgatgttgagtatcttcatggaattgcaggtcaaaactacaatgagagatcaccttgcacctgtaggccattattaaaaaaagagagagagagaaggagagagataacaagtgttgctgtgtggacctccagtagttctcagtactcatggaaggattcacaaggccagagcggactgagactgaagtgtggttttgatattagcagcaccccacttcacaggccacaatgcaggccagaccgggccccagaaagctgcccactttcacttttccgcttcatcttgagagataatgcaggtgacctttaaaaaattgttgctatggttaaaataacatcataacagtgaaacatcaatagtaaaaaacatcacaataatgtgatgtttatttagcatttctgaaattgtggaagtctgggatgggagagagaatagccatcagttatttaggaagacctttgcaggggaatttgctaagggtctacggatccctagtaataaagtcgcggcttgcgtttttatggtgctttcaaagtactttcctatataccatttcattttcacttt

SEQ ID NO: 478131 - DNA, 1526 bp, Homo sapiens
cattcactttccctgtaagattttctgtgctgggcccatcccatgactcggagcacaaggccagatcccaccttccccatgtcgagtccccaacctgctggagaggccacagtgattgctacatggagtcaggggagaggatggctgagagcccatccaagggaggaaaggaggttccaagacttcaggtcttacaaagaccgtagaagacaaatgggagcccttccaatgagctcctgttgttcatctttctacccagccataagtttcctgaagtacctaggagtcatccctaatgcagctgtgaaatgcctgcgtatggagcaggaagacccagatcttttgccagataaggaatgctccaacagccatagtgctccccgatcctcctgttacaaaaaagaggcagccaacatgagaaaaacagataaggtgattgaaaacttgaaagttatttcagtctaacagatctgtaagccacttaagcattaatgccaatatcaaatagtcaattggctatgcgtgtctaaaacaagtatgttgacaagagtattaatacagtttagaaaacccattttagtcctgatcttatacatacatatcatatgatttaattacttatattgtgattaagtggtatgttcgcattcatttgaagatatttgagtcccctgataacttctcacaagtatttataaagtagaaagtcataaaatctaatctaagatttcaaaataattttgtgaggcaatatcctttatttaatcttgatcatatgaaggaatcacaaaagtaatttgagatatcaggagctttttttatgcagatgaagaagaaaatactggatttcactggggttaaccagctggaacgggtgaagatgttaattgtactctttgcctgtcgttttatctgttatctatcattcctggtgtcttgaaataactcagggaagaaatgagataactttttttggcacagttataaataatagctgttttgcaagaatgttcatttttgacagctgctcattttttctagaagatcctttgacttcaaaaagctgcaaagtattcactcttgttttagtgaatgtgacaattggcatattaaaattttctcaaaactggaccttaaatttgagcaaataaataaataagtcattctgaaatatcaattggaagtcaggaactaaagaaagatgaattagttgcaatcattttgttcagtgttgactttaagattgtcagtgtactttgattgctcgacagtttaattttatactacaaattattagaaagtacaatgatgaaaaattggactctgctgtacttccagaaaacccataaaaattatcaagctcattcaaataagctggaaggtaacactacagaaaagggaaaactgattaattttctctcgaaaagtagtgctttgaaagtaactaactttgcaaatatttaataaaattgtacatatttagtaaaagaaaagcatgtattacatagagataaagcagttgcaca

SEQ ID NO: 478132 - DNA, 565 bp, Homo sapiens
gaaaaaccatggattaatcttcaaagaatccagaaaggactgagtagaggatgggccatgaggaaggcacacaatttgaaatcagcagtgaagtgataggagaggctactcttgttaaagaattctgcaggtctgttggagtttgctggaggtccactccagaccctgtttgcctgggtatcagcagcggaggctgcaggacagcaaatattggtgaacagcaaatgtttctgcctgatccttcctctggaagcttcatctcagaggggtacccggccatgcgaggtgtcagtctgcccctgctggggggtgcctcccagttaggctactcgggggtcagggacccacttgaggaggcagtctgtctgttctcagatctcaagttgcgtgctgggagaaccactactctcttccaagctgtcagacagggacatttaagtctgcagaggtttctgctgcctttttaatggtgggcgcccctcccccagcttcgttgctgccttgcagttcaatctcagattgctgtgctagcaatgagagaggctccgtggctgtgggaccctcc

SEQ ID NO: 478133 - DNA, 705 bp, Homo sapiens
ggtggaaaggagaaaaacaataatgaaggaaaggacaattctggaaaatcaatgtaggtcacattattctgaagtccatacatcagtagaatcaagcaggaaacacatagagagcttgagggaaatttatgacaaacttctatctgtaaaagtgcatacaagatgcagtattttctttgggaacagaagcagagaacaccagtcagcttacctgatcagcaactctgtagacctcttgtctgttgctacagtcacacgtgtagggaaacactttcttaccacccttttctttggccaccctggagtaggaatgcagaagattaaacatcagaggcagaaacattcaatgaaaggaggaatccaaacccagatgaggttgcctcctgtccaaagaggagccagcatcctcagcaaagcttttagttccagagaatatagagcttttgacccagacccagatgcatttcagtggctggaaatgacaatccttcctccacctcaaccctgaccctgccatcaacttctcatctcacctcactcctggcgcctctgaggggagggagaggaagaagaagaagaaaaagaagaaggagaaggaggagagaaaggaggaggaggaagaggaggaggaggcagagggggaaggggtggagggggaggaggaggaggaggaggaaagtcttgtaagctttggaaatgaccttg

SEQ ID NO: 478134 - DNA, 520 bp, Homo sapiens
ctggcatgtcagctctgccctgagcatgtgcacaccccatggggctgtcacagtgcccaagatcagccctgactttgctctgacatcagaacaggtgctgacagcagggagaagccaggcagtgggaacaggcatttctgagccagcgagggcagggggtccttcccgagctcccaagacaggaggcctgggtctgcagctgaggttcgggcagctgcagcagtcctgccagctctacggagtgggaggcctgggtcagcagctgtgtttggagcggctgcggctgcaccttgggagctcctgctccaccaacttggaaggggtggggctcccacttgttgccagctccacggagtgtgcagccccagctgtgcctccttgctacagctggcatgatggcaaggagagaatgcctgatgtggctcacctgtgatctcaggctttgcactgccctggtattactctatgaacaccaggtttgattttcaaatagagaaccaacagttcatactgattttaa

SEQ ID NO: 478135 - DNA, 684 bp, Homo sapiens
aagacggacacaaaagttttcactatgtttgtggacactatctggaaccagcagcttggttttcaggctttaaactgtctttggcttgaagtaaattgttttaaaagtgctttgcaaggtatcatatcagagcatgaatcagtggacaagtatgagatttggattcaaatacctcttgagagccagtggttttatgtaagcacacttgcttctctgagctctaatcttcttaccaacaaacttattttaatacctagctcacaatcaattttagaaattttagaatacattaaagcctctttatggtcctgtagtatcctgagccctaagcactgtgtctcagagcctgggggagagccacccctgcctgcttcattttcttcagatccctcatcagctggacacagtgctctccacttgtttgctacctgccttcccctcatgaaaggccgcaatttctccagaaagtgtgaagaatacaatcaataactaaacagcaatcgtccatttagactcaccttgtaattatttccatattctcaccaaattttgttttagaacttaatcccatttacattaaatacattgattaaaatagatatggagtgctcgcttcggcagcacatatactaaaattggaacgatacagagaagattagcatggcccctgtgcaaggatgacac

SEQ ID NO: 478136 - DNA, 775 bp, Homo sapiens
gatgccctcatgccagccggggaagaggccttgctgaccccaacccagccatgtatgaagctccacatgcatcaactcagaccccctccctcccctgcaggtctccctgtcctccaagggtcatgggctgcagagccatccccaaatggccctgctggaacccagaacccatcggcagatgcccccttctgtgaggacacccatcgcaagtcagtcttgtgcctgcccccctccctcggtgcccttcagtcttgcctgtcattcaccaatcactcctggagcccctgccaggtgccaggcaccaactgggctctgagtttgttgtcccactcaaccgccacagccagcgggtctcaggaggcacgctgcagagcacagtcctaatcttgtctcataggacaccagtcctattgcattaggacctaccctaataatgccatttaatcgaatcacctccttaaaggccttgtgtgcaaatacagtcacattctgacgggtaggggcttgtaggagattttccttcccttccatcttgtcccctttccctgacttggagatatccaggtctctcctgctgtccatgcccctcagcctccaccctccccccataatcctatttatcacccagagccccaagcacattcacattatagtcagaagacttactctgtgtgatttcaatcttttcatatttgttgaaatatgttttattgctgtatgtatggtcaatttttaaagatattgcatattttgttatgttttatatttgtccatt

SEQ ID NO: 478137 - DNA, 1082 bp, Homo sapiens
ttccaagatggccaaataggaacagctccagtctgcagcttccagcatgagcgacacagaagacggtgatttctgcatttccaactgaggtactgggttcatctcactggggcttgtcagacagtgggtgcagagtggggcattgcctcaccagggaagcacagggggagattatatcccacgcatggcttggagggtcccacgcccacggagccttgctcattgctagcacagcagtctgagattgaactgccaggtggcagcaaggctgggggaggggtgtccgccattgctgaggcttgagtaagtaaaccaagcggcctggaagcttgaactgggtggagcccaccacagctcaaggaagcctgcctgcctctgtagactccacctctgggggcagggcatagctgaacaaaaggcagcagaaacttctgcagacttaaatgtccctgtctgacagctttgaagagagtagtccttctcccagcatggagtttgagatctgagaacagacagactgcctcctcaagtggtgcctgtcccccaagtagcctaactggaattcacctcccagtaggggccatctgacatctcatacagccaggtgcccctctgagatgaagcttcctgaagaaggatcagacagcaacatttgctgttctacaatatttgccgttctgcagcctctgctggtgatgcccaggcaaacagtgtctggagtggacctccagcaaattccaacagacctgcagctgagagaaggaaaactaacaaacagaaaggacatccacaccaaaaccccatctgtacgtcaccatcatcaaagaccaaaggtggataaaaccacaaagatggggagaaaccagagcagaaaagctgaacattctaaaattcagagcgcctcttctcctccaaaggaacacagctcctcaccagcaatggaacaaagctggatggagaatgactttgatgagttgagagaaaaaggcttcagacaataggtaataacaaacttctccaagctaaaggaggatgttcgaacccattgcaaagaagctaaaaaccttgaaaaaagattagac

SEQ ID NO: 478138 - DNA, 1627 bp, Homo sapiens
gcagaggatttttttcaaacagggccatacatggcattgctggtagatcaagtctttatgggggggaccgccccaagccttgcagatgtttagcatccttcactcgctgaaagccagctctgaggagaaggagccaaagacagattcccttccccagttctggataactctaaatttataccccataccacgacatgtggaaagaaaagaagaccaaccaaatgagaaaaacaaagacaatttgttcttcacttgttgtagcaagggagtcagctaccttcacttgcatttaggcagactcattgcaggcagaggagtggaaaagcttcatagtggaaaaagggaaggctccagtcctgatcattttgggtcaactgccacagaagttattgttgagtttcctgaattgtcactagagagagcagtctggccccctgcaagtctgatttatggcaggctggctgcctgggttgttatagatcagaaggttggcttcctggaggttgctgcagattgtgggtcacagttctgttttatatgtaacatgaccattgtccatttgtatcttcaatctctcactacaaatagaaacagcaatttccccaagggaaataacactcaaaatgatgacaaaagtaacatagtgattgaaatggacaagaaaagaattttatgaatctttcttagtcatatgtgttacagtagaggttatttacttttgatgtaattattgatatttaaggcaaagtctgccattttttaaaatttttggttctgtttttcctttcctggttttcattttcctgccatcctatggacaacacaagcagtgtttagcatttaatgttaatttatctataatttttaagtgtatctctttgtaaagcagttgtactggttgctctaggcgttacattatgaataacttattgcaatccactggtgccaatattttaccaattcgagtgtggaaaacttccttgcttttatatcctttagtatccccaatttataatataatccattttaaatatttcccctacatacatcgacaacaacactacatggttttataatttttacttcaaccatcaaacataacttagaaagctcaggaggagaaggacaacatattgtgtttactcatatttttgttctttcttctaaatttgtatttttccttctttacgacattccaagatttctttttaaaaaaatttaattttaggttcaggggtatatatgcagagtttccatgaatcattcacttaaggtaggtcagctggcaacgaattttcttagctttctttcatttcagattgtcttgagagccctacaatcctgaaggatatattttggaaattatttttcttaagcacttgaaaactgttctgctacttcctctgacctccatgatttctgatgagaaattcactgtccctagaattgattttcttcttagggttttcataaagaaaatggaaacaataatggtccaaacagagtagagctgtcagaaagaaatcatgcatcaaaaatgcagctcagtcctttaaacagattagatgctgattttcacagtgttgaaaatagttcttatatatttttaatttttttattatacttt

SEQ ID NO: 478139 - DNA, 527 bp, Homo sapiens
aggagtgtggataaatggttgagcttttcaaagaggtgaacgtgaatgtatttatattccacatatctgaaaatcacacacacaaagactcttggaaaagccgaccactttcttctggcaatgacacggtgtcccagaaaggatccaggtggaagtggggcccatgaggatgtcaatgggcagccctccaatctcaatggccctggggagaccacaagaaagaattacactggtggccatgcaggatcatggtcatttaagaacatctcagtaggaagggggtgtagcacggagagtaatgaagaatctggaaatgtgaagtggctgtactttaggcagctggtaagcaggactgagaacttgccctgggctataagcctcccaggtgagaaagcaagcaaactcacagcttcttggctgtctcatggagcctgcagcagcaatccacctccttcaaagcatctgtggattctcttgtttttcctgctatgttcctatggtagttcttggagcaaaagtttatgatg

SEQ ID NO: 478140 - DNA, 673 bp, Homo sapiens
cgggttttcaaattccacacattctagcacagtactcagaaatgaagttttctgggtttgggaaaatgaaatatggagctgcatgggacccttaaacattgcttggagaagagccacacaagagagccactagaactgcacctgccagtgatgcaagcaaggaaagcactgctccagcagtgggtcccaaggctgggtttatttgtagcagctggctcgtcttgtgtcttccaatcccctgtggctaaggtcctgcatactgatgaaactacagactcagccgatgtgacggaacccactgatgctagctggtctcacaaggagctgactcatcaaagaatgcgttcattatcagcaccaataagcaaagatgctggcaaagtgcacagtttgcacctcttctccttggtggtcttaagccacagacccttttacacaacagtctccatgctgtctgccctgcacagctcaacctctgcagagaagttccctttaccacctccacctcctgcctcaccgagggctgctgcagaccactgggtcacctgccatccaaaggggctgggtgggattgtaccagctggacactccacctactccccaccacctgcaaatacacaaggaatgcaggacccactctgccaaggctgtcacatcccttctctctgaagaa

SEQ ID NO: 478141 - DNA, 563 bp, Homo sapiens
ccctgcattgccagaaagttaggagaggagaaagttaacataaacattacctcgcacatgtagtttttatgcatgaagctgttaaagataatagacctgtgttaaaacccacaaatgaatggaggcattctctggcctgcagaagagcgctcattgtcctctgcggtccattttccacacgtacaatgtgttcacagctggctgttctttctcttttggggacacttgtgaatatgcatgtcccaaatcataggcacagcttaagggccaggaactcacgtccataccctcctcctgctcagcctcaccctgactccattcagcctcctttagaggatgagaaacatctccccaaccagagccggcttaggctccttttaattgcatcattggcctggtgggaggatagagagaaaggagaacaagagttcagcagagccctgaaaaggggggatggtaatggaaggaggacaggactctgagctcctcgatggctaaagcaaagaaatggaattctgacacttgttgcctatatccgctctacacagagctccctgagaagc

SEQ ID NO: 478142 - DNA, 740 bp, Homo sapiens
taggagccagacaaaggcacaattacccccacatgactgcctactaagaattctggctgcagaaaaggcttttctgcagtttgtttttgctagttctgctccaagaacccaagaggcagcatgccatccgtgacccaggctgaagggaaggactttccagcagcctcaatgcttgaggaatggggggcactgtggactgctcaaggggaaggggccggtgggatgctagacggtggcaggtggctattttcacgtagcagtcagcagcaaatgaaagaggtgtgtggagatcattctccccagaggccattcatttctctacagctgaaagagcaatgggtgcttgaaggagaagagaaagagaggaaatgctctgctccctcccagcactgggaggagcacagggctgcccatgagtgggcccgaggccatgccggagccatctgcgaggattttgatctggaactagacagcagtgatggtttcacagtatcgtgaatgtgctaaatgttactaatggtaaattttgtgtaatgtctatttcatcacaataaaaagaagtcagtagaaaaagtttaccttaccctagtggctaagaatattgatgctgattattattgaagctgtgttgtttctaaagaggtggaggaagaaatgaatggatgcatgggggtaatacttcaaactcagaataatttattgtgggcactaaattttatctatggaaagtagcaaatatc

SEQ ID NO: 478143 - DNA, 505 bp, Homo sapiens
caccgacaccaggtggaacctcacggctgccggaaagccaagtgatggtgacaaataaacctgggccagaggaagctccagcagacagtaagaatatggcagcagacagcaaggataagaagatccaccaaaggagttggctctctgtgctccaagcagaacctcagctggagaatctttgcaagttctttgttcaccgagtcctagtggaatgtgcgagagcagagaaaggctttgagtcatgcaggaatggcttcccagatacgccgggacacagcagtttaattggatgtctgggcttttataaagaagaacgggaggcgcggaacaccaccaccacacgtgtcagctttgcagcagaagaaaaactcctccagcctcagcagccagtctctccggcttctccctgcgacttcaggcggacccccagtgaccgagaccaaagaagctgtgagcacagcggctgagagctctgtcctgtctctgatgttttcagggccagcgc

SEQ ID NO: 478144 - DNA, 871 bp, Homo sapiens
gctgatcaacttgttactcccatcaccatgggctacgtggaaactcctcctttctactctgcaccccatacctgctttaatgagcatgtctccaaatggcaaggacaagaaggccaatggccacaatgacccagaagtgttagaaataccaaatctgccagtggcaattgccaggctgagacccaaggtctttttggtcccaaaaagcatggaagaagctgatccaaactacctcatccactctgagtcatgtgttctttcttctgtgacagcagcaacaggacagatcttagatttctggaagagcttcaccatcctgaacacacgtgggagaaaagaaagctgccacaaggactggtgctggcctccaggtccagggacaaagaggccagctgaaaagtatccccagaaaggccattcaggctccagtttgcaacctttagaagcagggcagaaagatgaaaaacctgtttttgcctttggagggaagatgaaaaaaggaaggggagaggactggttattgactgtgagtcaggcagagtgtgggagctttattcgtcaatctcacatcattggcaagaattttctaacgtatgcattatcacccctatttgatgaatggaattttactgagtcaggagggaagtctgattccaaggagttgtagatgattgcttcattttgggagctggtatagtttaacgagcagcttatgccacactgatctctagcatatttgtatcgacaaggagacacaagcctgcatgattgtggttttttccctaggttcctaatagacctttgttatttatatttttaattgtgtgaaagtacctgaaagcttagtggcaaagaagacagttgtaaaaaa

SEQ ID NO: 478145 - DNA, 568 bp, Homo sapiens
cggcagtttcagtgtccgaccaagactcgttgagaaaaggtgatgacaatggagctaaatttcctgaatttcctgctggctgtggccgctaagcccaccatttgctactcgcttttatctacctgcaataatcaggcccatgcacctttgcacatccctggagcccatgcaccgctgcacatcccctggagcccatgcaccactgcacatccctggagcccatgcaccgctgcaaatccctggagcccatgcacctctgcacattcctggagcccatgcacctctgcacatcactggagcccgtgcatctctgaacttcacttgagcccatgcacctctgaacttcacttaagcccatgcacagcatggctcagaagcaacttcactgttgagtcttcagattccctccctctgcagttagaattactttttccttctctttgcttctacagtggtttgtttatattaatatttgcgatgctaaggcattttgtatctcccctattagacagcaggctccctcagtacaaagatgcttcgtgagctctttcattcattcatcaaatgt

SEQ ID NO: 478146 - DNA, 616 bp, Homo sapiens
cgccatttccctgcctgtccagaaggcaacatgtttttgtcatttgcatcctttctgaatgaaagctgccacaaggactggtgctggcctccaggtccagggacaaagaggccagctgaaaagtatccccagaaaggccattcaggctccagtttgcaacctttagaagcagggcagaaagatgaaaaacctgtttttgcctttggagggaagatgaaaaaaggaaggggagaggactggttattgactgtgagtcaggcagagtgtgggagctttattcgtcaatctcacatcattggcaagaattttctaacgtatgcattatcacccctatttgatgaatggaattttactgagtcaggagggagggacaattttcccaaacatatcatcatccatgtagacatggaaccttttgggaccctctctaaggtctttacatcatcctgcaattgtaccttccaagcagaacaccaatacaagcttaactggagtgggatgatgtggttgggttcctaatagacctttgttatttatatttttaattgtgtgaaagtacctgaaagcttagtggcaaagaagacagttgtaaaaaattgaataaataaatacattt

SEQ ID NO: 478147 - DNA, 586 bp, Homo sapiens
cgtaagggtagtaggttaggcgactgcaaatgggaatcaccagcacgtcgtggtctctctggcgccccctcttggcagagcctaatggagcctctggcaaagcggaaacgacgtggtctgcagagttccagagttgcagccccagtatctttaacatagacatgaaaatgtactctcccaagatgacacaactggcagatagagacctgatctataaactgttgagtccagagcctggtcttgtaatgactgtgccacatggcatctcaggagaaaagacaatgatgaatacctatctgaatcaagggaaaagttttacaaaaattgttattaagaatttgaagtgtgtactgatcaaatgtgcaagaatgaatatcagctctaagttatccattaatagtttatctgctacaactggaaccctgtctgccatgtctgtcctgattccttgctgatcaaggcaatcagcttgattctaagctgggaacctgtcaggacaagatctggaaaagcatatgtggctcagtaagctgcaggtaggtgtgtgcgtgtgtgtgtgcacgtgcgcatgtgtgtgtgtgaatgt

SEQ ID NO: 478148 - DNA, 875 bp, Homo sapiens
agaccactatggacaactttccatacattccacctaattcttcacttggctgcatcctcaacaattggaatcaatttaaccctgataatctaaggagaaaacatctgattttttactgtgatgatgccagccctggccctcaagaagtcaccttgtccccagtagaaagagtaccattgtccccaataaatgtgattggagaggaaactatccccaattctctcttcattgacatttggaggagcggaaagtgtccaggtggcaatcttaacttccagtttaatggaatcattgtgtctcctggtggcagcattccgccatctggaactaacacctctaggccagcagaaactaatgccatgggaacaggaatcaaaaattttgctagtggaaactgcagaggagaatatgttgttctggacatctgtgtgtttctggagaaatataaaaatatgtgtacacggatattagaggaaattaaatgtaataaatacacactcttctaaggaggagcttttcaaatggaattctttgagtctgagttacaaggtagaagtcagcctttaaaggtactcagtacaactaaattatgccaatttcttgtgcattactttatgatacaatatctaatttacaggaaatatatattttctgtaatttcatttcatcataagttgaaatttatattctacttgtattatgaggattgacttaagcatatgtggaaagtatgtttgtatatgaagcttgtatttacattttattaatctttttgaaagaaaatgatagtactaatcagtatacatatgataaattgtccagttattttttacagaatttactcatggttttcagtgactttttttgattgtaac

SEQ ID NO: 478149 - DNA, 1798 bp, Homo sapiens
cctttgaatttgatcattcacttatcaggatttgagtagtactatggatttggaagaggaagaccacagagggtccctgacttcccgcaacacattctcggaggatcaacttgttttactaatcagttccaatggagttagatataagatgccatctggtcgtggcatcaagcctttaagtagccacttcttcaatagaaatcctaaactccaaatcctgacgtccaagctgatgaccacatcacggtgttctcctgcacagtatagacatctgctttcccacactgctaaagctctgctcccatgggcagcttcctcctgccccaacctgccagaaggcaattacaatctcagaccctcaacttccttcctcttcatacctctcacaccagtagaaaacacctatgcagaatattttgagagttttaataagcattctgcgtatgagttcttacatatgtgatttgcacatatattcttcttatctatgtcttttcattctcttaacagtgtcttttgaaaagcagaagttcttaattttgatgaaatgtatttataatattatcttctatggatcacattttggtgtcatttctaaaaaaagttctgcctaacttaaggtcataaaggttttcttttatgttttcttttagaagttttatgtttttaaagtttatatttaggtctatgattttttatattaagcaatttttatacagattgagaggtatcaatcaaattattatttttggcatagggatagccaattttccagcactatttgttgaaaagataatcctttctctattgaattcctctggtaattttgtcaaaaatcaactaaccatatgtatgtctatttctaaactctcatttctcttcaattcatctatttttctgctttatgccaatactattcttgactatcataataacttaatagtaagactttaagtgagcatgagtcttccaaatttgatccatttttggcttttcacatttctttgtaaattttagaattaagtaaggaggattttattattctgtttttgcctcagagatttttagtgtgcacatttaaaataattggaaatttctaacactaatgcatcacaatgagatctgcttattgattactggttctacattctctaaaggagttactaatgaccctttttaaaatttaaaagagtcttaatttctgtcttcatccaccagtaattttatatcctcatattctccctatttaataaaaaatctgatttcttcagatattatcttaaatagagaaatataggaagtggtaaatacttctcatactcagttacctcaccttaggcgtgaataaatacatgaaagcaagcattgagcagctcaattggcttccaaatgtgtcatctcataggcaaagaaatgtatctctggaaacttctctaaaaagtattcccattttgtctgaatgttagaaccatctgaggaccttttaaaaagcctgatgactatgcacttaccagacaaatacatcatgatttttaaggatagaatccaggcatcactgctttgtttgtttgttaatttgtttataaagccccaagtgtgactataactggcaatcaagactgagactaattgctccaaaaggacactcaaaaaaaatctgcagaatgataagaatgttaaatgtcatatttgctacttttaaggtctttgattttgtaaattagttatttatttttattatttatttatttatttatttattttgagacaagatctcactctgtctcctagtcttgaa

SEQ ID NO: 478150 - DNA, 609 bp, Homo sapiens
tcaatgattttcagacttaaaatgcagcaccatctcctccccaaggctccatctccactaccttcagatttgaacagcgattggatttgcaattgtgccagttttgagttatgtcaagtcttcagaagtacatccctttcatgggttccactgggtttcagggatggcaacttgaaacatgcaatcattgtcattggggggccccttagtccagtgagggagatgaagaaatatataggaggcccccaagtacaagtaatcaattgggtgaatggtggtgccattcatggagctagggaatatgtgaagagaatcagatttggaggaaaagatgagctcaactttgaacataatgggttgaggtgcttggggaacatcaagtggagatgtctgactgccccaacaacaaagaattatctggtcccaaatgtcaatggtgctgaagttgaaaaaccctgagttcatgttttagtttcaaacatggacacttacctttacagattaaaattcactttagatttggtctatttttcatatgtcaagattctgcctctgttcacagaacagagcctcgcatatattttagggtacatgtgcacattgtgcagg

SEQ ID NO: 478151 - DNA, 697 bp, Homo sapiens
aggggttggagtgcgcatacaacaatcatgaaccagggaaagctcagccgactgcaggcaccagtgtgcattggtgagaaagcaactgcttgcggaaggaagaaggtggttgaagctcaacctggagccaaagctctgagtcttggggttcagccaggaggctctgagacttgttcacgggctctgcagcctctgagacagtgcttcagctccgtccctgtcactatctggaagagccacggatatcctggggccgtggtgggacagctttgggaggaaaatgagattttctttgcatgcgatcgagcgtctgtgtcagcctgtggagttccctctgttgtgcctggaagtactgaacacttgctcttatcttgccttcaccggcctaggcaggagcctgcacagggccagtggggagctggcagcaagagggaaaagcgccgtgaccactagccgactgtgtgaatatgctctttattctgctgtaaaggtgatggtgttggtgtcctagatgcttcaccaaaatatccagctaggaagtgagaaatatatctaattttcaagagtttattaaattaatctgataaacttgaatttagggattattcaagtgagacttcatctatatgctgctcagaaaatacccaaaatatttacagaatatcaggatagcacatttctttttaaaattttggtt

SEQ ID NO: 478152 - DNA, 669 bp, Homo sapiens
cagcaacagacagatgtgtccccttttatctgccaggtgtagcaaggctgccagaaatgcaatggctccaagaaggctgcacagcgcccatggggtagtcacttttgctgccgtgatgggtatggcaggaccaggagccaaatctctgacgctcaggtccatgctcctcagcacagcaagctgccccaatagccacaccaatgccacttggaatttcggagaaaggaagggtaaatttgaaatccacattccagtgtggcagccagtcctggcattggcagcaagaggcacccgagcagatggtgcagctggcagggcagctgccaccatctgtgcgtctcctgacctcctgtgcgggtgctcccaggagatgtggtgccctcgacttcaccatggatgtaggaaggagagaagaaaggcaagggcattccaggaagaggaaccacatgtgcacctgcatagagctggaaaacagtatgaccaggctgtgatgagcaggttcaatgcttttaatgatctggagaaggtggccgcatacccctgtcaacgctgacttgccttgaactggttaacaccttccattaactcggtcaatgtcagttcattagaggaaataaagggtgtttgtaagctgtaaccacataatccctgaaaaagaagggatttaac

SEQ ID NO: 478153 - DNA, 617 bp, Homo sapiens
tgacagctccattacaactgcaactccctcgcaagtccatgactcttggtgtcacatccacccactataaagcctgcaaaaacctttgtctcttccccaccccattgaagagctcagtgatttgtcaggcctcgcccctccctgcctgcctgcaccatccgctggagcttctgtgctcatttctgcacttcatgttcaccctccaccccagattttgttcaggaaagttcatgctcagttgcaattattaccaagttcaactaggagcttcctttaccctgtggcccctccccaattctgctagctgccttcccttccccaaggacctctgtgagctccctaaatcccatccaagtactaaccaggctggatcttgcttagcttttgagatcaaacaagatcaggcactttcagggtggtatggctatagactcagctccttaaatccatttcaggtatagggcattaattccatcacaaggaccctaccctcgtgatctaatctaattctattacctctcaaaggccctatctccaaatactattatatttggggttaagatttcaacatatgaattgtatggaacataaacattcagtccataatattcaataaa

SEQ ID NO: 478154 - DNA, 850 bp, Homo sapiens
ccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagtaagtatgcaaatgctgcctggatttaaacatttcttaggagaggtaaaagtgttaaaggtcattttgtgtggctggaatttggttccctgggggtgctgcagagcttttagtacttgttattgttggagaggtttaatattaaaggaaggattcaccagaaacc

SEQ ID NO: 478155 - DNA, 612 bp, Homo sapiens
ccctgtcaaaccagaccaatcagctctctgtaaaatggaccaatcagcaggatgtgggtggagccagataagggaataaaagcaggctgcctgagccaacagaagaatgaacaagcccagacaggaggatctagtaactccagacatgtggccttaagagctgtaacactcactgcgaaggtctgcaatttcactcttgaagccagtgagaccacgaacccaccagaaggaagaaactctgaacacgtccgaacatcagaaggaacaaactccggacacaccacctttaagacctgtaacactcaccgtgaggggagtttggctctatcgcctaggctgaagtgcagtggcgatctcagcttactgcaagctccacctcccgggttcacgccattctcctgcctcagcctccccagtagctgggactataggcgccggccacctcgcccggctaattttgtgtgaaaactagatttttacacttattcctaccaatttattttttcatcaactattgagtggcatcaatgaactatgatgtattataatcttttgtacaaaggaatgagaagttacaacagagaacaacacatttgattcttacatgacctt

SEQ ID NO: 478156 - DNA, 694 bp, Homo sapiens
cgcagggctgtggaggcctcaggaaacttattaatataataatggacggaagcccaggctccccttatgaccccaagtttttgcatgcaatcatctggcatgatgaccccctagtttcctacttggctttctcggacagcagcctcaaggtgtccttaggtgcctcagtataccctggggagagtgaaagccacctcctcacttggcctttgctggtcttgctggaggaaggtatactccatttagagatgctccttcctctgggttggaagattgaaaaactgtggaggacagacacagctgaaccccaaagagcaagcaacaccaagccgctgtataaaacgccagtgaaagaaaaaactctcatcacaacaacaagaattaccaagttatcttcttcagtgatggccctgatacaatcatgtaagtgtcttttcactgggagctgtacggaaacagttacggaaaatttagaagagctttcttattaaccaattcatgttgctgaaaaccttttgtatgcaaaattaaaagggtaatggaaagtactgcagaattgtaactacataagcttgaactataaagtcaagagcactccaagactcaatgttgtaaagttcaatacttttgctcagtgtacttaagatgcatctccaaatgttttatgcaagagcatggcccataaacctgaaga

SEQ ID NO: 478157 - DNA, 865 bp, Homo sapiens
actgaaaacgtctgtgagttttcaagtctcaaactgatatttatgctctcaaacttatccagtctattaattttgtatgcctgccttaacaagttaccacagattgagtggcttaaaaaatatattttctcatatttctggagaccagaagtccaaaatcaaggtgttggcaaggccatgctacctctgaaggctctagggagaaacttccatgaagatggatttgagactgagctcgcgtcttccctgctgcagcaccagattaaagccttctcccttggtaatacttgtcatctcagtgattggctttctgtgcggaaacggataataatatctgacttctcaattttcatgagaagcaaaacggaatgtgctattaaaagccttaatgctgcatgtgttgcagctgccaaattctaaaatttcaaattaatgactgtacaataaacattaaaataataagcaaaataattaagagtgaagcttacatatggcttatatgcttttaactaggcttttagagtttgcaaagaccaagagctgcagcactaatttcattgagagattttttaaaaattagtgttcttcagagaatctagatgaatattcagaaacagttaagcatgctaagtaaactttcatataagaatgttttttaaaattgtgtttgaaatgtagccaacactttggtgttgattctcccttagacagtgtcaatattttttaaataaacctaaaatgtttgaaatttatctatttgtatactttgtaatgaaattaaacttactgctaagtttctttatcaaagtttttagaactctttttaaatgttcatattataatatttttgataaatatacctgaa

SEQ ID NO: 478158 - DNA, 442 bp, Homo sapiens
aaggctctctgtaaagcgtctgccaccatgtttggtgcattagaagtccttcctgcacagtggccctccccacactggactaaggtccaatgtcacctgccaattaatagtgcctgtcaggtgaagatggcactcagagagaggagtgtgccccaaggtccccgcagaggcccactgctgcatctgaagctgtgctatgctcaggccagccaacttgtcatcttccatgtggccttgtgggatgaagacgttgaagaaccccaaagatttcaaatgaccacaagagattccaaagctgaatatgatcctgaccacaagaagacccagggtacattctatataaggtgtttctcagaagtctcatatggagccttctccctccatggccttctgccttgtggagacctccttgtgtccccaggaggactctgctagactaaat

SEQ ID NO: 478159 - DNA, 585 bp, Homo sapiens
tcctctgtgagataaggtgggagggtgataaagggctgagataaatccatgggttatgcagcccgtgggtctacagtcagtgtgttccgtattggagcctaatatgttgctgcactcattttgtgatggggaagaagggtcgggacttgtgctgggacctttctccgggagagggacccttctctcacccctcaagcccctctttgtcttctggcagccaacacaggcttatcctgtagaagcctggcacaggctgagcacagggcatcagaagggccattcaagctcggggcacctgagtgagagtaataagactccaagtgtaaatagaccacagtcagaccctacctgggtccggctaaaccccttaagcttcacgtgtaaggacagaagccaaggtcagatactgatattatctacctacctttggctacctacttttggctgcctttggctgaggagttgctagaagcagagacggatgacaggactggggtggagatttgaagtgtaggctatgggacattatgcaaatgcaagctgagtgaattaagaggtgtttgcctgttgggtttggacagattc

SEQ ID NO: 478160 - DNA, 585 bp, Homo sapiens
cactgtgcatgcatctttgccagtatgcgtacttcatcacgctgtttctgcactcacaaatctctgactctcagctttctgcttctctgcttagctagaggcctgccttcatctttccctctccacctaactcagctctccattggagtcagcagagacctgggcaccatgttcttgcccttggagagctctgaccctcagaaagatagagccgtgcacttcctgggtcctgacctccaacttccaggtcacggagcaggagctcatgctgtcggtcccccccacactctcaggcctcctctgtgtgagggagtaagtagggatgacacaaagaacaggagctctgatgctggtccagtcctgattcaccttctcactaaccctgcgactacagtggccctctgttatctcatctgtagaatgggaataacatcagccacctgagagttgctgtgagactttgatgagatttcataaaatagctagtcaggtgcatagcatataacaggtgcttagtcactttttattgtcttcctgttttccactgtcttcccttctaaagtaaatggagaggcaacgcctttt

SEQ ID NO: 478161 - DNA, 604 bp, Homo sapiens
actggttttgtttctctggagaatcctgacgcatacaggctttaaatgaacttgctcacagaagcatgtttcttgctccatcagaaggacgtccctgggaccagcctgcgcactctaagacgtttagcggcacccctggcctctcacccactagatgccagtagcacctcccctgcaagtggtgaccaccaaaagctgtctcctgacattgtcaaatgtttcctgagacccaatgttctggaagtatcaaggaaggcttcaagcaggacgcaggctttgagaggtcctgggatgaatgaagccaacttgatcatggtgggtaagtttttcaatctgctgctggattcggtttgccagtatttttttgagcattttcacatcgatgttcatcagggatattggcctgaagttttctttttgttgttgtgtctcctcccagttttggtatcataattatgccggcttcataaagtgagttgggggggggggtctctccttttcaattgtttggaatagtttcagaagaagggataccagctcctctttgtatttctgctagagttcagtcgtgaatccgtctggtcctggggtttttttggttggt

SEQ ID NO: 478162 - DNA, 599 bp, Homo sapiens
tggaaaactatacctctaaatatcaattgctcagagcatgaaggtttttggctgactttgaaaacatgtctgcaaacagctccaaggaggcatggcccaagggctcgccattgacggcaatgtggaagaacatggtggggttgaccatggctgatagtttggggctcctggtggtggcagcagctgctgcaaagccgagagtgacattttcaatcatgttttggatttgtaaatatagaaacaatgttcataacatggtttgttacatgggtgtaatgtgtgacgttgacgtttggagtatgaatgatcctgtcacccacatagtgaatataatacccaacgtatccagtggcttctgctgcagacatgagctgcccattaggagcagcccattaggagcagcccatgaggagattatgatgccaattatgtctgtaccaatatcagctggctctagggagtccgaagtgactaaggactggagcagtcccccagcacagcacagaagctctatggaaaaacagtcagactgctttttcactcaggtcctggatcctgtttctattcactgggtggaatctccagactgagttctgaaa

SEQ ID NO: 478163 - DNA, 900 bp, Homo sapiens
agccctatacctcttaactcagagacaagactttctagcccaaatggtattagacaatcacctagccttagagtacttattagctgcccaaggaggagtatgctcattgcagggaacttcttgtatgtggatcaatactgggcaagtgcaacagctcctcaaggaaataaaaattgaccttacagcaatgcataatgttatacaagtattcaaaaacatacataccaatagtcctggaaactgcagatctgttctgtatagagccaatgactctgcacaggattccaaaccccagtaccaccctcacacagacacccttctgccttcactttgcctgggtgtcacctgtgagggtgctttcctcacccagtgccacgtgctgtaccatggacctctaacacagatgccgtctcgccctcctgggcccagacactgcactggctgctgcccctgccccttgcctgtggggtgcacccccacctcactggagttccagcatctgcaggacgcctccgctctccacgctgactcacacactgttctgcactgctctactttctgttcatcccacttgggccctgatgctctgctctccatggataccctcctcaccttgctgggctccagcacctggtgcttggccactgtggcctgtttcctacttcacccactgctggtgcctaccttgtaaatgtatagcttcgtgcctgaactaatgtttttatccagtttttttcctcttggtgtttgggaaatatgatcacagagctttgtaaaatggaagtctcatgtgacataataatataataataataatgcagaattcaaaacaagtttctgggtggcagaaatgatgagggaaccaataacattcagaaggaattgaggctgcgtggctta

SEQ ID NO: 478164 - DNA, 860 bp, Homo sapiens
agcgaataaagagcacctgcaagtttggctatatgataaggcatagcccggcaggggtgttcaaagctcatgtggcttaggagggtcactcagttgccccccgccccacaaccactggaagagactttttactctttgccaataagagctatttggctgcctcacctccagaagctatgtggtttcaggcactccagcatacagatgactgctctatcagttcagtggatgaaggagataaaattgcacaggggtcttaaaaataagaaaatctctgatgacttgttttgcaatttgaaaatgacaggagatgtggggtttgctggggatgaggattctgaaatgtttgtggtggtagccagggatataaacaatgggcaactgacctatgctggctgcagggacagaagtgaagattgcaaagtgtcgtctcattctggcagctctttagagacaagcatcccagacttctacaacccagggcctgggagctaatctggatccctcctttcctgtgacttggttgtttaactcttccttcaattcttttctttaagtggctcctcttgttagttgggatagactacattgtgccctggtcacaaaaatgtcagtggcttaacagaacagatatttatttccagctcacactaccagtgccatgtgggttgacaggagactgtgtgacacacagtcactggggtcccaagctcagagagactccctcaccttgtggttgaatgactgaaacacatggtcacttcagttgccacagcaggaaagaatatctggagaatcatttgtgctgttcttctcagcctgaaggtgacatgtgccatttgtattcatagtctattagc

SEQ ID NO: 478165 - DNA, 1037 bp, Homo sapiens
tgtcttaaagtgacaatggttaaatacaatggatttcaagacaaaaatgaagaagctgctttcttatgaagctgggacgcctgaagaaatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcagtgtcccagtggggactctgtgtgggggttctgaccctatatttcccttctgcactgccctagcagagattctccatgaggggtctgctcctgcagcaaacttctgcctggacatccaggagtttccgtatagcctctgaaatctaggtggattcccaaacctcaattcttgacttctgtgcacctgcaggctcaacatcaagtagaggcttccaaggcttgaggctcgcaccctctgaagccgtgggctgagctataccttggccccttttagccacaactggagcagctggaacacagggcaccaagtccctaggctgtgcacagcaagggggccctggtcccaggccctcaaaaccactctttcttcctgggcctctgggcctgtgatgggaggggcttccatgaaggtctctgacatgccctagagacattttccccatttccttggtgattaacattgggtccctcattacttatgcaaatttctgcagcaggcttgagtttctttccagaaaatggatttttcttttttattgcatcatcaggctgcaaattttccaaacttttgtgctctgctccctcttgaaagctttgctgcttagaaatttcttccaccagataccctaaatcatctctctcaagttcaaaattccacagatctctagggaaggggcaaaatgttgtctttgctaaagcatagca

SEQ ID NO: 478166 - DNA, 717 bp, Homo sapiens
cagttcctgcagcttcagttcagccatccatggctaaggctctctctagcagtgacagtggggaacatgaattatgatggggctttcagaaatccagggtgcagagatgttctggatacagctgagtcgtgtgcttcgggaaggactgcagtcctgccagatgatgacaaaggagttcttgcagctcccaacccatcccgggatgatgaaccaggcctggcgtccagggatcacaaattagatatgaggaattcagatggaggggctgtgcccactgcaggctggaccggatggggaaggaatggtagcagctcctccttgtacctctggtggaatttggctgtgaatccatctggtcctggactttttttggttggggagtggcatgtgcaaagatgtggaaatgtggaagggcatgatgcatttgcacaccagcaacacagcatacctggtacaaaggcagatgcctgaggagtaggaagcagtgagccacgatgctatcagaaaataggatgaaagccccaacctcagagacagagcctagtaaacagcagatgccactgtgtgagcaaacaggatagtcaattctcaatatttacagtagtatgttctgtaaagtcaccgtgaacactgaattaacaaatgctgaaccactgttcctgggggaaatagagggttaggttcctgtgagcctctggtcacatttctgccaaactg

SEQ ID NO: 478167 - DNA, 594 bp, Homo sapiens
ctttagcccatgatggcagggcttgcccaaactcaagttccactcactggcatggatgatttgcctccgactaggactggtctaaatgttctgtcagccaccaaccgagttcttcactgtattgctttccactgttacacaatagctgagctccgaggcaacatcatcaaccagccactctgtgaacacagatgtgagggtgggaatatacaatccaggaatgatcgcagatgtgagggtgggaatatacaatccaggaatgaacacagatgtgagggtgggaatatacaatccaggaatgaacacagatgtgagggtgggaatatacaatccaggaatgaacacagatgtgagggtgggaatatacagtccaggaatgaacacagatgtgagggtgggaatatacaatccagggagggggctcccttcaggtccctacttcctcattatgcttcccaggatcaccttcgctaagatctacatgtacacaaactctggtcctggggtccgatttttaaagaccctaaattaaagcatttcttaaattggtattattttaatgtattttatattttatataattttttgctgtgc

SEQ ID NO: 478168 - DNA, 692 bp, Homo sapiens
agattttatgggcatggggacttgctttggtccagaaatatatggaaagcatagattggcagaggaagccatcagacatgtgtttgtctcaggtgagcagtgggatgaccttctgtcttgtgaagataagctatcagtttacattgccagggtgaaattccacagaactgtttttggggtaaagatcttgaggctcacaaggaattccttgtgggcaaattgtgagggagggctaaactcattctatactcaatatagacttaagaatgagtggattttcagaaggcatttgaaagcacacttgaccctgaatttcattgtcaaatatcaaccaggtgagatctttacggccacttcatacgaaaacactgacaccactaactcttctttagtgtctatgtggagagtctacatggtagtgacagatggtacgaaagtggactggggggttcgatgacttacgggaggcacccagaacagtattcagtatagtaacatgctctatgtaactaacctgcacgttgtgcacatgtaccctaaaacttaaagtaaaaaaaaaaaaaaaagagcagtaggctatactgcatagcctaggtgtgtagcaagctacaccatctaggtttgtatttttgtaccctgactcgtcactttattctaagaactatccattttgtactcatcctttctccttc

SEQ ID NO: 478169 - DNA, 558 bp, Homo sapiens
accaatttctcttttccattacttcaggctgatgtgatttacctaggaggcatggggttcagggaccctctggaggagacagtctgtcccttagcagagtttgagtgctgcgctaggagatccactgctctcttcagagctggcaggcaggaacgtttaagtctactgaagctgcgtccacagccaccccttcccccaggtgctctgtcccagggagatgggagttttatctgtaagcctctcactgggactgctgcctttctttcagagatgccctgcccagagaggaggaatctagagagggagtctggctacagcagctttgctgagctgcagtgggctctgcccattgtgcactcccagcagttttatttacactgtgaggggaaaaccacctactcaagcctcagtaatggtggacgaccctccttccaccaagctggagcatcaacttcggactgctgtgctggcagcaagaatttcaagccagtagatcttagcttgctgggctgtgtgcagggggacccactgagctaaaccacttgtctccctggcttt

SEQ ID NO: 478170 - DNA, 928 bp, Homo sapiens
tggcttcaagggagaggtagtcttcaccatcttgataaatggcacactgttaattgttaacaagtcacaagctatacttattttatttatgtatgtgtttggttactggtatattttcagtctagttccctatgtcttctacgaggagtgggatcttgtttgttatgtttactgttgtcataaaatagatatcagaacatcttcactaaataggaaagtcaataaggttttggtttcgtgggcacccaatatctcttttcttatcttatttctggtactggggagggggttggagcagtcttcacacagctttcctatgcagttattggacgatttcccccaaatttcttcctactcattgctaaggctatgtctgatcatctccatccagatagaatggactatccacgaagtttcaggaggcttacaactcatgtcatgttccctgaaaagggcactcagacatggagatttatatgaaagaagtttagtgggtcattcgctacagagcaacaggtctgaagaaatgaaggagacctgctagcataggtctaaaacaatgtttttcaacattgttcttttagattttctttgatactgttaaacctttggatttctatatattggaaatgaacttagttttctaatttccattaaaagagacataatgggatttatatttagagttgtattgattctataaatcaatttggggagaactgacatctttaaaatatttactttgttatcccccaaagaggcaaaaacgtatgcttcataagattcaacaattcattcccacttggtgacttttcccagggtttaggcaaaatggggagatatcttggctttgtcaagaaattggtccttgctgaacactgtcgagtcctagatgaaaatgctttctttcttgcatgcttgaggcaag

SEQ ID NO: 478171 - DNA, 778 bp, Homo sapiens
ccaacagacctgcagctgagcgacctgactgttagaaggaaaactaacaaacagaaagcaatagcatcaacatcaacaaaaaggtcatctacaccaaaaccccatctgtaggttaccaacatcaaagaccaaaggtagacaaaactgcaaagatggggagtaaccagagcagaaaagctgaaaattctaaaaatcagagcagctcttctcctccaaaggattgtagctccttgccagcaacaggacaaagctgaatggagaatgactttgacaagttgacagaagtaggcttcagaaggtcggtaataacaaacttctctgagctaaaggaggatattcgaacctatcgcaaggaagctaaaaattttgaaaaaagattagctgaatggataactagaataaacagtgtagagaagaccataaatgacctgatggagctgaaaaccatggcacaagaacttcgtaactcaggcacaagcttcaatagccaattcaatcaaatggaagaaatgatatcagtgattgaaaatcaaataaatgaaataaagcaagaagacaagaaaccctacaagccagaagagagtgggggccaatattcaacattcttaaagaaaagaattttcaacccagaatttcatattcagccaaactaagcttcataagtgaaggagaaataaaatcctttacagacaagcaaatgctgagagactttgtcaccaccaggcctgccttacaagagagctcctgaaggaagcactaaatatggaaagaaacaacc

SEQ ID NO: 478172 - DNA, 491 bp, Homo sapiens
agtgggatctgaatgagtaagatattcatcagtgtacatgttctttcaggtatttttcatgtaggttctttacaaacttgcagaattcattccacggaagacaggttctgcattaggcttaattctaagaaatttgaacttcctgtgtttataagtaaacactgggaatttgagatgacagggctctttgccaatctcctgatgagtgactttgaaaaggtgaaaggatccaaatataagataaagccaggagaactggattgtgttttcaagttgcctacattttgtccatttgtgacatttaactgtaaagtttattcacagttaattaaacacatcaagatattcacagcaacaggatctgctatgtatagtattaaaattcctaagaagacaactgtgttcacaggaaaaaacaaggttcttgtcacacaaccaggaagagacacaaagacactttgaagggtgagggggaatggaatttattgggc

SEQ ID NO: 478173 - DNA, 565 bp, Homo sapiens
gagggctgccagcatgctgcctatgaaaatgaggacagaaagtttccctggatacaatgaggattcaggcccctttgctgctggtctactgcagtttgctggaggcccactccagaacctgttcacctgggtatcactagtggaggctgcagaacagcaaagattgctgcctgccccttcctctgaaagcttcatcccagagggcaccagcctgatgccagccagagctctcctgtatgaggtgtctgttgatccctgttgtgaggtctcttccagtcaggagccacagggctcgatcatcccagggccacttcagactgctgtgctagcagcgagaatttcaaaccagtgtttcttagcttgctgggctgcatgggagtgggacccgctgagcgaggccacttggctccctggcttcagtcccctttccaggggagtgaacagttctgtctcgctggggttccaggtgccactggggtatgaagaaaaaactcctgcagctagcttggtgtctgcccaaacagctgcccagttttgtgcttgaaacccagggctttggtggtgt

SEQ ID NO: 478174 - DNA, 496 bp, Homo sapiens
gaaatgaactgccaactgtctgctatgattgacttaaccttttgtttgccactttaccctctttgccgagctttctctgcttttgttctgactctgcgtcatataagattaagaactagtctaaccaagattaaatcttctaggttgaaaagagggggcagcaggagaaatgttggccctgataagggagacaagggacgatactccaaaagagcttcaggactcagccagcgtgcattggcagaagctgggagaggattcgtggaagtagattctgaaggccttcgatcaaggaagctggaacataattattcacatgaatgttcatttttatatgtggttctcaaatctactcttttcttctttctttacatgactctctctttcaaatttaattatggctactctgaaattcctgcagataatatgctatagtaaaaaagcctcacctttggatttatgtttgccctaggtttgaatattaatgacccttttc

SEQ ID NO: 478175 - DNA, 919 bp, Homo sapiens
caggtgaaggtttgagccagacctgagagcagcaggtaggagctgatggtagcagaaaagcggaccctcatatgcactggctcactttcagtttttcccagacctaccagaggaaggtgggaattgaagagagttgtgctatgacaggggagggaaacgcgggtgtgaaagtctacaacacttgggttacaggaggagctggtggtattgctgtcagagacaacacctatatgaaaggaaatttcaaattcttcaggtttcagactgtgatggttaatattgagtgtcaacttgaccggattgaaggatgcaaagtattattccaggatgcgtctactcttcctgccctcaaacatcacactccaacttcttcagcttttggacttttggacttacaccagtggtttgccacggggcttttgggcctttggccacagactgaaagctgcgctggcggcttccctacttctgaggttttgggactcggactgatcaccactggcttccttgcacctcaacttgcagacagcctactgtgagactttaccttgcgattgtttaattttaatatggcaataaatttacattgttattaatatccaatgtctactctgaactttgttctactctgactcttaacagtacgtttttgcatgtatctcctattttaaacagatgtatttgacatttagttgctaattaaaccaatcattatcagaattcacaatcatttcttaaacatcattaaaaaagcaatttgtgaggtataaaatgtaaagaacaccccagaacatcatattctgccattttgtctcttaatgtgtatgcccaggaagtttcttctccctggtgtctgcgttcaattaacgctttagtgtaacagctgtggactgtcaggaaatggcccctccctggtgcc

SEQ ID NO: 478176 - DNA, 1207 bp, Homo sapiens
ctggattttgaggaagtgtcatttacctctgggggcagggcacacacaaatgaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagtaggggcagactgacacctcacacggccaggtactcctctgagacaaaacttctagaggaacgatcagacagcagcattcgcggttcatgaaaatccgctgttctgcagtcaccgctgctgatacccaggaaaacagggtctggagtggacctctagcaaactccaacagacctgcagctgagggtcctctctgttagaaggaaaactaacaaacagaaaggacatccacaccaaaaacccatctgtaaatcaccatcataaaagaccaaaagtagataaaaccacaaagatggggaaaaaacagagcagaaaaactggaaactctaaaaagcagagcgcctctcctcctccaaaggaacgcatgatggaagatgaaatgaatgaaatgaagcgagaagagaagtttagagaaaaaagaataaaaagaaatgaacaaagcctccaagaaatatgggactatgtgaaaagaccaaatctacatctgattggtgtacctgaaagtgatggggagaatggaaccaagttggaaaacactctgcaggatattatccaggagaacttcccccatccagcaaggcaggccaacattcagattcaggaaatacagagaacgccacaaagatactccttgagaagagcaacaccaagacacataattgtcagattcaccaaagttgaaatgaaggaaaaaatgttaagggcaaccagagagaaaggtcgggttacccacaaagggaagcccatcagactaagagcagatctctcggcagaaactctacaagacagaagagagtgggggccatattcaacattcttaaagaaaagaattttcaacccagaatttcatatccaggcaaactaagcttcataagtgaaggagaaataaaatactttacagacaagcaaatgctgagagattttgtcaccaccaggcctgccctaaaagagctcctgaaggaagcactaaacatggaaaggaacaacc

SEQ ID NO: 478177 - DNA, 1443 bp, Homo sapiens
tggtccctgacattcactcgggggcgtctgtgtttccaagggaagctgtgaaggactgtgccatgaggaactgtgcattccaccccagttcctacacttttcccaaggtcttctcaacccgcagaccaggagattcccttgggtgcctgtaccaccagggccctgggtttcaagcacaaaactgggcggccatttgggcagacaccgagctagctgcaggaccactgcgggtgaggcaaacagcgtctggagtggacctccagcaaattccaccagacctgcagcagaggggcctgactgttagaaggaaaactaacaaacagaaaggaatagcatcaacatcaacaaaaaggatgtccacacagaaaccgcattcgaaggtcaccaacatcaaagaccaaagcacagattcttacagtttggaagcagaatgtctaacggcaaatgtggtcacactagcggagcttgagcgctgtgctgggagatctgctgttgtcttcagagctggcaggcaggaatgtttaagtctgctgaagctgcgcccacagccaccccaacagccacccccacagccgccccttcccccagcaagctctagtgccccaggtcgacttcagactgctgtgctggcagcgagaatttcaacccagtcaatcttagcttgctgggctccatcgggatgggatctgctgagctggaccacttggctccctggcttcagccctctttccagggcagtgaatggctctgtctcgctggcattccaggagccactgggaatcgaatatgttacaagtcctacttaaaattgaaaatcttcaatgcattgaatataaaatttatatttgtttgcatggaagtccagttcacttatctactttgccaatctaaactttcatcttccctccttcactctgtgccacacccaaatagcacattggtcggttagacaactatttgactttatagctctctgttttccctcttctatcacttttgacttaaatgccctttctaacttctctgataaaatcctactcagccttcaagaccaagctcatatatcatcctgcaatgcttttcttgacacttacacaaaagaagtaatggctctttatatttatttccagttcacatttgtcactgttgcagaggtagttacaaatatgggaagcggaaaggctagaataagcttagtgttggattggaataggagagtacataaagaattcatgtttttaactctgacactgaaaagagctagaagctatgacactacagcagcaatgtatacactcagcatccagcttttcatttcataatataattctccactaaaagaagccaagactgcctggagaaaagatgcattccaaggcttgaagaaggaaaatacaagatgagtctggaagttatggttgtaaaaaaagtaaaaatgaattc

SEQ ID NO: 478178 - DNA, 580 bp, Homo sapiens
tctaaaggacatgcagtatgcagagaaaaaaatacacagtatctgtgtccttttcaattttgctgaccactgaacctattatgagggatatgagcttcctacacagaatgggcaggtctcagtttaaacagtcaacatccaggaagactctagacattgtaaatcaggacccagaagaagaaaggaaaatgtgggaaagtttggaacttcatagagacttgttgaatggctttgaccaaaatgctgatagcgatatggacaatgaaatccagcctgaggtggtctcagatagagatgaggaacttgttgaaaactggagcaaaggtcacttttcctgtgctttggcaaagagactggaggctttttgcccctgccctggagatctggcagtgtggaagggaaatgtgttgtcagagcccccacacagagtccccactaaggcactggctggtggagctgtgagaagagggccaccaactttgagccccagaatggtagattcacttccagcttacactgtgcacctgaaaaagctgcagacagtcaatggcagcccatgaaagcaaccaggaggggagct

SEQ ID NO: 478179 - DNA, 441 bp, Homo sapiens
aactgagccaattaaacccaatgatagggaaactgccagaaacaccctctgtgaatattctgatcatgactactgccaacaggactgaagcatgcctgacctgcaagcaatggagatgctcagcccccagtggggcaccttccctaggggaccagtcagccacttggtggcaagttgattacactggaccttccaaacatgggcgggggcggacatatgccattactggaatagacacgtatcctgggtacagaattgcctctccagtcctcaatgattctgccaacaacaccatccatgcatttaggaatgcctcattcaccatcaaagaattccacatgaaactacttctgatgaaatcatttgtcccctaaatgcttactctggacctgggtataaatctacctctcagaggagccagtgagacagatctttgtagcc

SEQ ID NO: 478180 - DNA, 499 bp, Homo sapiens
tctctccagcgcaccctcctcctctctggtcagctcatgataacgtctgattctttttgatgaatgtcttcatctctaaaatgggaatggtcatatctaactttggaggttgtagtaacagttactgatgttgttaccatcatcacaaccaccaccaccaccaccatcactatcaccaccaacaccaccaccaccatcaccaccaccaccaccgccaccatcactatcaccaccaccaccaccatcactaccaccaccaccaccacaatcaccaccaccaccaccaccaccatcactatcaccaccaccgccaccaccatcactatcactaccaccatcatcactaccaccaccaccaccatcatcactatcaccaccatcaccaccaccaccaccactatcatcacaaccatcataatcaccaccaccaccaccactatcatcacaaccatcatcatcaccaccaccaccaccatcatcatcgtcaactgagaagata

SEQ ID NO: 478181 - DNA, 588 bp, Homo sapiens
cgagtatacaataagacttagccatgggtctgaagcttcatgtaagatctgcctgcttctacttcccctctgccatgattgtaagtttcctgaggtctccccagaagctgagcagaagcactcatgcttcctttatgctgacttctctggtcctcatgctgctgcttaggcctttgtctggaccactgtccccaggaacaaccacagggctggcccctcacatcctgaaggtcacccctcaaccctcacttcatttggagaagactttcctgaccaccctacacacagcaatatcccccaccgtgacttttcccttcggctttcccctgcttcatggttcccatggtcaggctgtcagcccacacaccatgtacttgcagtacatttatttactctctgctccccgctgggaatctatgtcccacgggagcaggaggaaaaacaaaaacttatctaaaaggacacaagcaaaattggaaaagctgcaagcctcatggtaagctgtacccacctgataagtcattggtccgattgtttaaacagtagcaataccttgtggggaatttggcggggtccactgtcttcagg

SEQ ID NO: 478182 - DNA, 951 bp, Homo sapiens
cagatgcctaccgtgaaggctccactggagtgcagctggatgaatgatgctagggtttgaacaggtgcagactgagtcctttataccccaaggaaagacccttagccatgtgatgcctctccccactcctcacatcaagaaggaagcctttcatgaatgttggcagcaccaaagacccaccatctctaaaatgactaagcccgtgggcatctatggctcagtgcagcaaaatccatcttttcagcatctcaagagcatagctgagattgttattatgctcaagagcataactgagattgttattatgcctgagcaatacaaaggcataacaatctacatagctggtcttctgggcatgaatgaaataaacagaaatgtgcctgcacctttgctacctggaagaatgaagtttaatgacacgtactccacagatgagctcaaatcctgcacctttcagaggaacatctggtccttgaccagctcctggggaatcccctgtaaatccttggaatatcctgcctgatgagtgtctcttgtacctggggcttcgtgccatgacagatagtttatgttaacaatgtgatttatggtggggccttaggtcgtgcagtatcagcttgacctctagagggactggagactgaataactaagtttagccatgcaggccatgaaggcactccatacctactccatacccccaaacatcccctggacaccaaaacttggatgagctttcctggctgacaatactccacgtgttgttaaacattatttctgggaggattagatgctgactgtgcaaccccactggaagcttgtgcctgggctctcttggactctctctagaggtgcctttcacatttgctgcttttcatctgcatccttttgttgtaataaatgctaaatgtgcatataacagttttccctacctctgagttctactcatgaa

SEQ ID NO: 478183 - DNA, 535 bp, Homo sapiens
agattgagaagaagtctgtgtccagttggaaaatgtcaaagccccaagcaaggctccctcatgcctctcctcgatatcacaggcctggacttggagccgactggtgagaggctcctggtgctgcccttgtcagtgctgagcgaacacaggccgagtgctccattctgcaggctcagtgggacagaccaaggcagaccctcggcagggactccaggggacaggagtgctgcaggctcagtggggtggacagaccagggcaggccctcggcagggactccaggggacagatgtgctgggatcaaggctggtgcatggctgagcagccatcgccgcgaatgtgaacccggcagtcaggctcaaagcttgagttccaaaccgtaccattgcagcatccctgaaacagccattacacatgccttcaagacacctgatgctgtgttagcaccagcagagatcgagctcctggagagaaaatgtgcctgaaatgatatgagccctggctagtgatgattcgcactccatccccctcaaggtc

SEQ ID NO: 478184 - DNA, 513 bp, Homo sapiens
gattgtctccatttctgctactggactagttcgtccaggatgggagcagccttccggtctatgagaaaatcatcccctgcccgttccagccttggctggagcatcagtcgcctctttctatcccttatcaggcttccagagctgccaggaccactattgctctcatttgatcagaactgtttctctgtttctgtctacctcccaaaaattgacaaagatggccaccttcagtggcctgagatccaactgagccacagggagctaccaggatactccagggcagctgaccactggggagccaggagccatgagggcaagagagcagtggagctgatgggtcacaaggactcacagcttattctccaggtccagaagtttgaaaacatcaaggacatttctgctgatggcttccttgtgaggaaggaaggagaagagaagatgaaaaaatgtggaagaggaggaagagattcttgcttctggggcctggattaaggaaggtcctaggagcattct

SEQ ID NO: 478185 - DNA, 816 bp, Homo sapiens
cagactggatggtggaaagagcaggttggatggtggaaaatgcaggtcagatggtggaaagagcgggttggatggtagaaagtgcaggtcggatggtggaaagagcaggccggatggtggaaagagcaggtcagatggtggaaagagcaggtcagatggtggaaagcgcaggtccgatggtggaaagcacaggttggatggtggaaaacacaggtcagatggtagaaagagcaggtcagatggtggaaagagcaggtcagatgttggaaagcgcaggtcggatggtgggaaaagcaggtcggatggtgggaaaagcaggtcggatggtggaaagcgcaggtccgttggtggaaagcacaggtcggatggtggaaagcacaggtcagatggtagaaagcacaggtcagatggtagaaagcacaggtcagatggtggaaagcgcaggtgggatggtggaaagcgcaggtgggatggtggaaaaagcaggtcagatggtggaaagagcaggtcaggtggcggaaagcgcaggaattctagaaagcagacaatggagaacatgcatgcttcatccaagtgctaacacagagtaaaagacccagagcggcttgttctgccttttcgtttttaaagcatggtgcatacgggagtgaggagtggggatcaacatagccataagtcatctgttttacaatgtgggggaattaggttgtttctagcatagctcatttctaacacttaactcagcaaactgtaatttgtggttcgtacatctgtttcttgcattagattaagattttgaggtggaaaccatagctt

SEQ ID NO: 478186 - DNA, 1412 bp, Homo sapiens
tgacagctagtccaggcttcctcagggcagggcagagtgctgtggatggtcagtggccatcacctagccagtggtgcataatgagattcctgacagtgtggatcccttgtcattgttctcacctgtcgtcaaagtacaaacagatactggatctccaagaaagctttgggtattctttccaaaaagctccgataattgacccaactttgtacaccactggtgaaagaactgccagccccttcactgtcattccagaagcaaagcctcgcactctaggacttgagttgattttgttctcccacccctgtgagtctttcctcaatcgccctaccattccctggagacatccagatacacctggtgatatggtttggctgtgtcctcacccaaatctcatctggaattgtagctcccataatccccatgtgtcatgggagggacctggtgagagatatgagatcagcagacgaagtctcacagtgtccctctacatcagtaatcttgaattaaaagtgtagtagaatattagctgccatttacaaacaaaaatttgccattcagaaacaaaattcataaagtacctaaggattaaccaaagactgcaaaaatattgagaaaaatttagattctattacaggacatgaagaagtccttctaaatggttgtacataccattgtgcgtggatagggtgattaaatattaaaactttgtcaaatctttgataattaatatataagttcaattaatttccaataaaaacaatagcatttgggagctcagcaaatagctaagacaaattttaaaatgaaaacgaaaatgaactgcagattcaacttactacatacaaaggtcttcccttggtccattaccataaatgcatactaaataatacaaacgaaggtattgtgataatgacaaaataataaataaaaaaggacagaaattaaaaatagacctttggaaattgtatgatagatgatagaaatatcatcattagtaaagggctgacaggtgaattacttagtaaatcatattgggaaagagaaaaaataagcatccctacttcccaactaagcaaacataaagttcaaatagattaaaaatgcaaatttaaaagacacatttatgaagctaatagaaaataaatatatgaatatgttaagatcttgggggagggggaagatattttcagcaaggcccctaatatcaaaacttatgtgcaaatgtctaaaacaagaggtaagtgtcaaaaacacctgagagattcagagatcagaaaaagaaggaaaaaaaaaaggagtaggaaattgacaaaaggcaaaatctaattggctaattcgtatatttcactggcaatcagaaaagacaaagatagtcaaacttaatgttattaagtactgagaagacgtgg

SEQ ID NO: 478187 - DNA, 2152 bp, Homo sapiens
ggctggcagccgagcgggtgtttatgttgggtcgccgggtctctggcagcctgacagactacctgatgagccagggcaccggctgcgtgcccgaggacgggctcaccacgcagcagctcttcgccagagccgacagcctcacctacaacgagttcctgattctcccaggattcatagacttcatagctgatgaggcggacctcacctcagcccttacctggaagatcacgctgaagacgccgctgatctcctcctccatggacactgtgacagagggcaacatggccatcacgatggctctggtgggaggtattggtttcattcaccacaactgcaccccagagttccaggccaaggaggtgcggaaggtcaagaagtttgaacatggcttcatcacggaccccatggtgctgagcccctcgcaccctgtgggtgatgtgctggaggccacgatgcggcatggcttctctggtatccccatcactgagacaggcaccatgggcagcaagccggtgggcatcgtcacttcccgagacatcgactttcttgctgagaaggaccacaccaccctcctcagtgaggtgatgatgccaaggattgagctggtggtggctccagcaggagtgatgttgaaagaggcaaatgagatcctgcagcaaagcaagaaagtgaagctgcctatcgtcaatgacgatgatgagctggtggccatcattgccctcaccgacctgaagaaccgagactaccctgtggcctccaaggattcccatgagcagctgctgtgtggggcagctgtgggcacctgtgaggatgacaaataccgcctggacctgctcacccaggcgggtgtcgacgtcatagtgattggggggaacgtggtgacagcagcccaggccaagaacctgattgatgctggtgtggacgggctgtgtgtgggcataggctgcggctccctctgcatcacccaggaagtgatggcatgtggttgcccccagggcactgtgtgtacaaggtggctgaatggggtgcggctcaagaaatactggggcacaggcttgctggatgccatggagaagagcagcagcagccaggcacgatacttcagtgaggaggataagattccattccttggaatccatgaggccaagaaccccaggtcagagaacaggaggcttgccaccatcttggaagcggcttgccaccatcttggaaactttgtgaacaaggacccctggaaatttcaactgcacaacccctactacgccccaattcagcaagaagcagttagagcagtcgtcggcgaacctccccaacagcacttgggttttcctgatgagagggcggactgagagacaggactagctggatttcctaggccgactaagaatccgtaagcctagctgggaaggtgaccgcatccacctttaaacacggggcttgcaacttagctcaaacccaaccaatcagagagctcactaaaatgctaattaggaaaaaataggaggtaaagaaatagccaatctattgcctgagagcacagcgggagggacaaggatcgggatataaacccaggcatttgagctggcaacggcaaccccctttgggtcccctccctttgtatgggagctctgttttcactctatttcaatctattaaatcttgcaactgcaaaaataaataaataaataaacaaataaaaagtaattcctgcttataatagaaagtttagaaacagaaaaaaaaaagcacaatatggcagattagaaactgctggctatctctcagtatgcattctccccttcttgcttgagacactcaaataatacctgcactgctcagaataaactgtatgtttcctgatctcctttacacctggatgtgatcctgtgagcatcttttggtcagtggaatgtgagcagagtgatgtgcataacctgcagattttgtccttgaacctcccactactccttttccctggtcttaccagtcagaatgcaatcagcagctctttcccctactgtcaatagttgctgaataaaatctgttttcatcgctttgactgatggtcaacggctatgtttatttttgacagtacctatgttctgccaggcactatgctaagtgttttgcagagattagtttatttaatttt

SEQ ID NO: 478188 - DNA, 497 bp, Homo sapiens
gcctgccaggccgagtgggtgaaatgagcccaggcattcaccatttcctgtgctgtctccatgatgccttccctgcacccctttccaattcttgccactccacacatcccaagaggcattaacagtggagcaccccccaacccccgccgccctccaccaaccagcaaagctcacgatgacaaagtccacagggtggagcaagtcataagtggaaattgcatgagtgcgcgagcagatattgaatgttgggtacctgcaggggagtgggacaccgttggcttgaggactggacaattctttgctgtgtgggactgtcccatgcagtgcaggatttttcttatccctaggctgggctccagttcccactccaccactcattatggccactcaaatactcccacacacattaccagctgccctatcggtgggcaacatcatgactttgagaaccaaaatccaagagatgtaaaaagcagatgtagcccagttgactagag

SEQ ID NO: 478189 - DNA, 593 bp, Homo sapiens
tatgataccgggctggagggcgctgaaacgttaggttcaggggtacatgagcagatttgtcatactggtaaattgtgtgtcatgggggtttggtgtacagattatttgtcacacagtagcgcagggaagactatggtgggaagaaggtgcaagtggactaatgctcatgggcaggggcccctctgctggagctctcaggcaggagcagtctgccagcgaaggagctatgatgagggcccgaggaagcaccctgtttaggcaagcaccaggtccagcagctggggccccgggagacagggtggcactcagattggactggcttcatctcacaggcaagacagccctgctctgtacagatccaacaaggccaatagaagatatcagacatgataaatgtcagaaaacagtcaaactcttgggtcaaatacacaattcacagatgttctatagtccatcagcatatttcaaggaaattaaagattatgttagtaggacaccagcctaattacataccagttggtatacagcagtggataaacagaacaaaattgaagtaatattaatttactctcctatgaaattcataagcagtg

SEQ ID NO: 478190 - DNA, 674 bp, Homo sapiens
gtaatatccagggagggagaggatgatgttactccccatatcgcaggggtacaagtacacaatgtgcagtatatattttctatattcctctttaccccagaacaacgcaacatgcattaactatatctatattatatctctatctagatctacatctgtatctatatctgtatctgtatttatctgtatctgtatctatatcggcacctgtccactccaatacaaagtaaaattcttgaaacactttacatttgatcatcccctgctatcttccaggatatttgaataccatattttatgtataccttgtatttactcgctccaaattaaacacctcattacttttttatatagtgaatattactatagatttacattaaaactataccttctgttagttcagacttcattttggaatcttcctcagaagttcctttttgaggattattagagataagttttcatgtggaaatgcttctttttcatggtgttcctttgcgtgatcatttagctgttcctttgcatgcttcgttgttttgtattacctcctcttatgtgatatttgggatagctatcacgtcgtgtattttttatttctatgtgttaggaatattcaagtcctctccatatattttaaaatataaaatacattgttgttaaatatggtcacccta

SEQ ID NO: 478191 - DNA, 1491 bp, Homo sapiens
tgaagacctctaacagcagccctcgctggctctcggcacctcctcaggccaaggcgtccactcttgccgtgcttgaggagcccttcagcccgccgctgcactgtgggagcgcctctctgtgctagccgaggcgggagtctgccccctctgcttgctgggaggtgtggagggagaggcgccggcgggaaccggggctgcacggggcgctcgcaggccagcgcaagttctgggtgggcgcgggctgggcggccccacactcggagcggccggcgggtgccgccagccccagggagttagaggcttagcacccgggccagcagctgcggagtgtgcgctgggtgccccagcactgcctgcccgcccgcgctgtgctcaaattctcgtggggcctcagccaccctgtggggcaaggctcatgacctgcagcccgccatgcccgagcccctccacatcctgggctgccgagtggcccgagcctccccgactggtgccacccccttctccgcagtgtccagcctcatccactgcccaagggctgaggagtgtgagcacacggcgcaagactggcaggcagctctgcctgcctccccggtgcaggatccactagggtctgcagcttcactcctgaagccagcgagaccacaaacccaccagaaggaagaaactccgaacacgtctgaacgtcagaaggaacaaactccggacacaccacctttaagaactgtaacaccgcgagtgtccacggcttcattcttgaaatcagtaagaccaagaacccacaaatttgggacacaaaagcataaaaataactgttatatgtcacaagtggaagaccactgagacagaggatcaccaggaaacagagacagttcttaatgtatttgttatttcaaggtttgatttgaatggtggtagaagggatctaaaagtgaccagtgggctgatcagacagagaaatagagaaataaaatattttggacacaatgtttggttacaaaggcagtattaataattcattactctgaaaatggaaaatcggttatcaaagagaaaaatatattaaacatttacattgtctctctaatatgaaacatatttaaggatactcagataggccaaatgaatgatgaagagttactttacaaaaccactaggaacagttaactggtgagaagtagtaggatagcagtagggatgtttagaagtccaaatcctctcataaatgtttttaatattttatattcaacaagctcatgaattatcacacattcattctctcacattttataggcctttgaaaacaataatttacttggaattcggaaaaattttagcacaaaatgtctaatatgaaatatgtaattatactgctttgtatatcacttctgaagttgcatcctagatatatatttctacatattcaactatatatacatgtatccatattcgaatgattgtacataaattttcaatcttattttaagcatgtgt

SEQ ID NO: 478192 - DNA, 545 bp, Homo sapiens
ggtgatcagcactgaacacagaactcaccatggagtttggactgagctgggttttccttgttgctattttaaaaggtgattcatggataaatagagatgttgagtgtgtccagtgtgaagtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacatactatgcagactctgtgaagggtcgattcaccatctccagagacaacagcaaaaactccctgtatctgcaaatgaacagtctgagagctgaggacaccgccttgtattactgtgcaaaagatacacagtgaggagaagtcagtgagagcccagacaaaaacctccctgcaggaagacaggaggggcctgggctgcagaggccgctcaagacacactgagcatagggttaactctgggacaagttgctcatgaag

SEQ ID NO: 478193 - DNA, 2686 bp, Homo sapiens
cgccatgccctccgtcgagtgtaatggctacagagggcattctagagctttcaggagctcagcatgcagcccctcttgcctgcccccgtggagccctctccccagatgggagctgggctcagggtcctgctggatgggcacatggaccgaggtcctgggaagccgcctgctcccacttgcatcctgcctgttactctcgtcacccagacgctgttcacccaggctctgcagcaggcgctgggctggatggcttccggtctgtttggtgccctggtcgcgtgtcttccgaactctgctgcttcgccccggcaagagcacttccttccgcggctgctaaaactggtgcgcgggttcccaacttcgcagaagagcttcatcggccccccgctagagacctcagaccgcagccatcgacgcctcgcctcggggatctgtccccaccctcggggccaggtcagggaccagagacctgcgaagccctctccttaggggtttagttcccaggctttctgaccccagtaattccaaacgcttccctttgtttccacagccctagcgtagcaggtgctccctgcagtttttgcttctgagatagagttctcttttcagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaactcaccatgagtcaggccctgtgctaggtgctgggatgaagcagtgactgacacaggcctggacctgtccttgggaagagtgcgtctgtgacacagatactgtgccatgtggcaaagtaagcgcgtgggacagcagagccttgtttgccattaaagtaatatcacaagtctgttaaggttggagaatcaagtgaacatgctgaaaagttatggggaatgtagtctcatagctgggggagctgggggccttgtcaattggttcccccagtctggagagcaatctgagagtaagtagtgacactgtgtgtgctgagtgtgtctgtgggggtgtttttggataaaattaacatttgaatttgtgaactgagtgaagcagagtgcccttcataatgtgggtgggcctcattcaattagttcaaggcccgcataggaaccacctcctgcctgactgaaccgggacctacgtcttttcttgccttcagacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaaagggtccaaacttaagctcattttggtccttaattgctaatccataggcatgttttggtccttaattgctaatccataagcatgtttcggtccttatttgctaatccataggcctgcacacctgcccccaaggccatggttaggtcagcacttggccctccccttgtctggggctgccagaagctgcctcagaagacctctccctgcagctccagtgctttagggttcagcgcccctccagggcctttatttccttctgggctcaaaagcagatactgtgccagatacagatgatcactttctgggttccagaactcacatgcaccccttttcctggtctctcacatttgctgtgaccaacccaagcctcaggtggtcctctgctgagactgtccactcacgctgttgacagagcccttccaggagctctttttgtggggatttgctatgtacctggcactgtgcaaagaaccccacccatgccgtccttgcagccgccatgtgcggtgcggagcgggctgcgctaaccaccattgtcagaggcagaaacaggctccgtgaggaaggataagtgtgggttatggaatcagggctggcagatcccaaaccttggctcccagataccatgggatctttaggaagatccctggtcacttcggggaggagagagagggcgaaggctgagaatcggggtcctgggtcggaggagggagaggggtggtggtgtgggcttggaggtggtgtgggttggagattggccgttgagctggagatgctccaggtggtctgcgtccaggttcctctggtggcgggggatggggcagagccggcaggggtgggacggggctccgagccagccccgggggcggccacccggacaagcggccctcgtgtgacgcaaatcgaaggaggatggggagaggcgtgaccaagaggccgagcacagctcagggtcgcaggcgtcccgggagggctcaggaatatcacgtccggttcaactgcacgctg

SEQ ID NO: 478194 - DNA, 1654 bp, Homo sapiens
ctagcttctcaggacagaggacgagaggcccagagaccagcagcacaggcccgaggggctcagctcccactgcccctctgtggaggctcggccccactgggccccacgcgacaccaccactccccggactgtccaccatggccctgcataagcagtcctcgcctgccatgtccctcctggccagggaggtcctgcagggctgctgtggggcaggcgaggcagccgctacaccaggccaggggacagcgcgagacgctcagtaaggtcccatggcctcccgtgggcagcccccacagacacagctagaacctctgtccctgtggaagctccagtaccgctttggagaaacaggctttgaacaaaacattgcatcaaaggagctcagcaaactcagctgtctccacttcaccccgtcttcgtgcttctccttctcccacctaaagacggagacaggacgtgtcactctcctgggccaggccctgcatgagcctcttccccgctcccacagtggctcctccctgtggctcctagcagctcttcggaaacctccagcatttcatgcgcagagacccatccccatgcggctaccccaggcccagtatgcgccggcagggcttctcacatgtcctccaggaaagcgcctgggaccaccaacggccaccagggccactggatccatgcggcttgtgcctggtgatgtagatatgacaggccctcgccgcctgctcactgggccaccttacctggctccactgcccttctgcgtcctgcgcgagcggacatcccgggaggcgggcggcggggacctccccgagcacgtcagagccgcccggagccgcagcagccgcaccacgcgcatctgccagcctccgggaaagggcgacaaagctggcccgccccagcgccagccccgcccgcccccagcgccagccccgccccgcccccagcgccagccccgccccgcccccagcggccagccccgcccccgagcgcggcctcccccccagcggcgctcatcccaaggctgggcgtacacgctccgctgctctggagaagggacctcacaggctcagatggccccctacctcatcccctacaaacagcagcacttccaggacacagaaaccggcagaagcacctgctgtccagcccacagcagcccctcagaggtggtgcctctggacaaaggtcacaggaagtcctgcgaaatcatccctgccaaccagcctctcactcccaaggagaccagagaccaggcacagctggagcctccttcctgcgctcagtccccagcgtgactgctgaccctgaccagggtttaacccagtgtcttcactggggagcatggccaaggggcaaaacctctagatcagcacttggcggtaggccctgagccacaacaggccacaccgctcacctctggcagcaccgcagccttggtcttccccgggcccaggcagacctggttggtgtcccatcaattcagaatgagcagctcagcagctgaaggtacacacacaccaggacacagcagctgactctccaggtgggccacctcctcccaggggctgcggaacagtgatgcatattttttcaggtaaccctttctacaaaccagaagagggccttggcccaggcccaccattccttcaac

SEQ ID NO: 478195 - DNA, 816 bp, Homo sapiens
gtcttctgcgttgctcacactgggagctgtagaccggagctgttcctattcggccatcttggctcctcagtaataaaagtgaattatgtaggtacagtatgggagaagcatgacttgggagaattttgaattaaaatcctgcggccgggatgctctgagagcaggctgcctgatgggggcagcagagagcagggtgcgggaggggcccgcaggaggggagtggagccagcagctgagaccccggcaagggcaaccatggatctggagttggaacgggacaatgcgccatcaggccggcagaagctggcagatgagggccgagttgcggcacacaggtgccaggactgcctgctttgttcagctgggatctacccggtctccaaggtggtttcggatggccacacgcttcagaaatccttcctgagggctgaccatgggcattgcgctaccccagactgtgctgaactcttttctgggctggcagcatgtctggggtcaaagctagaactcaaacccttgtccaagcctctttccataatgctgggtgggatgttctcccaggagtcagtatcttctcatagctacacgcttgactctataaatgctttcaggggaggggcagtcttgctgtattccccacagccgttggccctgctggggccagagaagtcgttcaataagtctgtgctgatggattgattgtggggtgccctggatcaggctctgtcccatggcagaggacacttccaccttgccagttctgtggctcctgacagtattagctggatgtgaggcaccttcttttcactcctggtc

SEQ ID NO: 478196 - DNA, 551 bp, Homo sapiens
ttttttttgtttgtttgtttttttttttttttttttttttttttttttggagagatagggacatggatgaagctggaaaccatcattctcagcaaactatcacaaggacgggaaaccacactctgcatgttctccctcatagaactccaaattctccagctttggactctgggacttggaccagcaaacatctagattttcagctcttaggccttggactgagtcacaccatcagcttccctgattcacaggacttcagactaggactaagcagcaccagcttccctggttctccagcttgcagatgccatactgaacagtcacatctaaatccataccgaaggagagaaacatttccgactctacaaggctctaacctgttacaagaggctcctagttacaatcccattcaattcgtatttaacttctcagtcagtcagaagtatctgctttttttcattggtggtttcatagttttctaagaataatgggtagaatcttgtgttacacttatataactaaaggatactttcttgtaattttatcaaaac

SEQ ID NO: 478197 - DNA, 933 bp, Homo sapiens
ggacaggatgctgaagttttacaacggcctctcggaagtggaggcggtgggactccccgcggggaccgaacccctggaccccactgatctgaacggggtgcacttcgacccggaagtttacctagacaagcttcctagagagtgccctctggcccagctgatggatagtgagacggacatggtgcagcagatcagggctctagacagcaacatgcaaaccctgacctcccagtgccaagtgtataagtgtgtccagaattggtgggttcttggtctcactgacttcaagaatgaagctgtggaccctcctggtggggctcgtggtctcgctggctcaggagtgaagctgcagatcttcacgtgggttcatggtcttgctggcttcaggagagaagctgcagaccttctcgggaggcagctaaggcccagtgagaagtcgagcacagcagctgctggcccaggtgctaagcccctcacggcccgggccggcaaggccagccggcagctcctagtgcaaggccgccaagcccacgcccatccagaactccagccggcaggcaagcagcacacccgtgggctgaagggctcctcaagtgctgccaaagtgggagcccaggcagaggaggtgccgagagtgaacgagggctgtgagggctgccagcacgctgttacctctcataaggagtgattaatctgagcttctccagaaagtccattcctggtaggcactgggaataagaaatctcagagtataaaaaaacatcaagtggtaacactttttgtttcctgagcacctactatgtgctgcccactgtgagagctgttagggttgaaatagggagcacagcaggataggagctgccattaggagcttagtggggaaaccgttgtgcaacatggttacagtgcttggggtggggaaggtcagggagt

SEQ ID NO: 478198 - DNA, 1101 bp, Homo sapiens
ctgccagttccctggagtgtaggacactgtgtaggctagagtgatggggaccaagctacactgtgccctctttcgtgccctcttcaaggagaaagtgacttttgaagatgtagctattgacttcacccaggaagagtgggacatgatggacacatccaaaagaaagctgtacagagatgtgatgctggaaaatatcagtcacctggtgtccctcgacagggaaagtgcccttaagaaaaaacacatgatatccatgcatcctatcatcagaaaagacacatccaccagtatgacaatggatccttttgaatataatgattcgggagaagattgcactcacagttccacaataactcagtgtttgttaactcacagtggaaagaaaccctgtgtcagcaaacagtgtggaaaatcccttcgtaatcttttgtcccctaaaccacgtaaacaaattcatactaaaggtaaatcatatcaatgtaatctatgtgaaaaggcctatactaattgcttttaccttagacggcacaagatgactcacactggagagaggccatatgcatgtcatctatgtggaaaagccttcactcagtgttctcaccttagaagacatgagaaaactcacacgggagagagaccatataagtgtcatcaatgtgggaaagcctttattcaatcctttaaccttcgaagacatgagagaactcaccttggacaaaagtgttatgaatgtgataaaagtgggaaagcctttagtcaaagctctggctttagaggaaacaaaataattcacattggagagaaaccacatgcttgtcttctatgtgggaaggccttcagtctgtcttccgaccttagatgacatgagagaacacgcactggagaaaagccatatgaatgccatttatgtgggaaagccttcagtcaatgtactaatcttaaaaagcatcagaaaattcaccctggagagaaaattataaacttcttcagaacatattctgactttagatgacacagtgttaggaatgacgaaggtaaggaatgtggaagagacttcagctgtagttgtagcatctaaacatgccaaaggactcacatttt

SEQ ID NO: 478199 - DNA, 658 bp, Homo sapiens
agcgcccagaggccggcgggagctccaggttcacctcctcctcctccaggtgtttacttttcctttatttctaataaaatctgatggctctaaagggccatggctgcccttcctgggacttcctgggaacctttaaaccttctgtggttcctggaatggggaagcttagggctacatcttgaaatatattctgtgaaggcaaagaagagtggcagtacggagaattattctgagccacatgagagcatgggcaaaagtggagatacctgtgccatgtggaaatacattacaaatggactatggcaaagggaaatcccacttccagctagatgtctgcatgaactactgaaagctgctgagtgtcttgcagcagtccccgtgagtgtgttgtgtgcagtggggccgggctgcttcatccactgcacattaaatgtttccaatactttccggccaaagcttaagcttagagttgtcagaccactgaatttgaatgttgacctggttccttgtggaacagactgatttatagagtaaaagcattgtcaaaccaaatgagcttggatagaaactgtatagagtctgagatgttgtctgaacttccagtcactcattgtgaagtggaactgcagtaactacatttggtgcaaaatttcatgtc

SEQ ID NO: 478200 - DNA, 460 bp, Homo sapiens
gtgacgatgacatgtttgagagtgctcccgggacagcatgtagttggcaaggggcggtgtgtatgtcagacactgctgggaagcgttcacgtagcaggtatttcccatattctggagcccagcccccaccgcagcaggtctcctgctactcagaggaagcttctccctgggagcaagctgtcttgccacaggcgccaaatcatcgcagaagtcgacgcgggtctcagttgagagttgtgacttctcagggagagaagtccgctggatttcagcaaaggctgcatctggccgagaagatagagtcttcaaatgacgagctctctggccgcatcagcccttatataactcacccccaccaacggcgaacacctcacccactcatcagcgacggaaagagaagaagtcggaagtgcgctttctgacctgagaatagtcaatgaagtatagtatttagcacagc

SEQ ID NO: 478201 - DNA, 784 bp, Homo sapiens
gccttctgcctccccccagccatgtggaactttactggcagcatagctgcatgggtccataagcaacttcagtccttgcctcctagaagaaagaattcgaccgaagggcatacagtggaaaaagagactgagcgaacaggaaggagaggaaaattctcttggaagagacccgagcagatgcctgaaggtccaagaaagaaaagagaagagcctttaaccttgatcctgcgttgggttttcctctttcccgtgattcgtcctttagggagaaagaaagtgacttttgaagatgtagctattgacttcacccaggaagagtgggccatgatggacacatccaagagaaagctgtacagagatgtgatgctggaaaatatcagtcacctggtgtccctcaggtaccagataagcaaagcctatataattttgcagctggagcaaggaaaagagctgtggcgggaaggaagagtatttcttcaagaccagaatccaagtaagcaacagggtcctgtgctctaataggaggaggtgctttgtcaatgaataatatcagttgaatattaattagtggttttattaaatgagtgataatttctaaaatgtaggttaggctactggagcagaattccttagatgttattatcattttgttcatgtgtcagatgctactcttgtgtcctcttttttttcttttctttcacttttgggaaaaggataattcatgtacttggctggggttaaactttcatatgctgactcttttcctgatacccctgtgaagact

SEQ ID NO: 478202 - DNA, 660 bp, Homo sapiens
aactgctaaaggaatctgaatccagggctacagctgactcagcagggagtcactcccttttgaagcccactgagacaatggagcaggcacatgagcagagtggctatgaggggggacaaggtgggcaggctcaggcccagggacatgaaggccacatgctggagcttgctgccctgagcacgggtgccttggagcggcccaggcacatctcgactgggaaggaagatggcaacggaccaggatgggaggtggcagcagcagcagcaggtgtcctcagccctggggtgaaaggagggtctctgtgtggacgcagcactgacacctctgtgcctgtgcattctcagagcgccctgcatttccactttgcactgagccttgggaattttgcagccggccctgccgtggccatttttatacaagttatctcatttaatcctcagaagcaaacatgccagggggttattacccaagtttacagaggcaggtcctggggcctagaaagatgatgtcaccatgctactcatacagcctacagaatagggagccaaaataaacttcttttccttatgaattacccagcattaggtattcctttataggagtaaaaacaaactgacacagaaaattgatactgtgcaggggacattgctgtaaagacag

SEQ ID NO: 478203 - DNA, 1589 bp, Homo sapiens
gggcgacatggaggacgactcactctacttgggagatgcagcttttgctgaaatccagcggacttctctccctgagaagtcaccactctcatctgaggcccgtgtcgacctctgtgatgatttggctcctgtggcaagacagcttgctcccaggaagaagcttcctctgagtagcaggagacctgctgcggtgggggctgggctccagaatatgggaaatacctgctacgagaacgcttccctgcagtgcctgacatacacaccgccccttgccaactacatgctgtcccgggagcactctcaaacatgtcagcgtcccaagtgctgcatgctctgtactatgcaagctcacatcacatgggccctccacagtcctggtcatgtcatccagccctcacaggcattggctgctggcttccatagaggcaagcaggaagatgcccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccagcctccaagacgttaactttacacacttctgccaaggtcctcatccttgtcttgaagagattctccgatgtcacaggcaacaaacttgccaagaatgtgcaatatcctgagtgccttgacatgcagccatacatgtctcagcagaacacaggacctcttgtctatgtcctctatgctgtgctggtccacgctgggtggagttgtcacgatggacattacttctcttatgtcaaagctcaagaaggccagtggtataaaatggatgatgccaaggtcactgcctgtagcatcacttctgtcctgagtcaacaggcctatgtcctcttttacatccagaagagtgaatgggaaagacacagtgagagtgtgtcaagaggcagggaaccaagagccctcggcgctgaagacacagacaggcgagcaacgcaaggagagctcaagagagaccacccctgcctccaggcacccgagttggacgagcgcttggtggaaagagccactcaggaaagcaccttagaccactggagattcccccaagagcaaaacaaaacgaagcctgagttcaacgtcagaaaagtcgaaggtaccctgcctcccaacgtacttgtgattcatcaatcgaaatacaagtgtgggatgaaaaaccatcatcctgaacagcaaagctccctgctaaacctctcttcgacgacccggacagatcaggagtccgtgaacactggcaccctcgcttctctgcaagggaggaccaggagatccaaagggaagaacaaacacagcaagagggctctgcttgtgtgccagtgatctcagtggaagtgccgacccacacgtaggggtgaac

SEQ ID NO: 478204 - DNA, 648 bp, Homo sapiens
acttaaatattgctccataaggctagtagttgattcacggactgcatgaggcttgcacgaccccgtggagggtccagaaagggaaggacagctctgccccgagctcaccctgcagactgggcttcagcgtgctctgggcaccctcagctgccatggctctccaaacgccgcgtgcttctcaaattctgagcctttctgccagtcttctctttggacgtacctcaaaggaaaggaactcagcaagtcataccttctcagagacttctgcagagcagcaagacaaagcttactcagaggcgcccacagaccaggaagggcccctgtgtgctgaaaacgggccgccaaaggagcctctgccttcagccaggcttggaagaacaccaggaaagcaaaaggtggtggtggggaccttctccatgtttatggagtggaagcaacctgagaccctcaccgatgcagatgcccaaacttggactttttcagacaccagcattgtaagccaaataaacatgtttctctatctaaattacccagtctcaggcctcccttcagagcaatactaaatagactgagataacccgatatatatttcagaaggatggtggtaagaagaacatgacagagactcttcagtaatcttgattgctg

SEQ ID NO: 478205 - DNA, 763 bp, Homo sapiens
tgaccaccacttatgtctgctgttccgcagagtccacccttcgggagaaatgggagggaggggcccctccttgggctcccatctgctctctgctttgtttgaggactgctccccagatattcaagtcaagtacctgcgaatggctgtgatggcaacagtaccattattaccattttgggtcacccatgactcagggggtgaggtctatgttcagacatctgaagagatccagaaacctgctggaggacggcgaagtggagcagagccaagtcagcccactgggcctagccaagtccccagatttgaaagggagctcaaccaagatcaccaaaaccacctagactgccaccaccaaccacagatgcgtaagtgtgccctgctgagtccagttcagatcaacacatccagagcagtgagcaaaaatccgtgtttattacattatacatctgaggaagaactcactgaccaagcccatggttcccaacttttgttccagtaacaaaaactttatgtataactttgtgctatacctttaacgcttgggagttgaaaaaacaaaccatcatgatcacctgaattcatttccataattaaaaaatttaaaaaaaacctgcatgtaccctgttaagagggctaaacaaagagatttcattgtcttctaagataatgtattatattgtctctgaacacttgcttttagttaaatgtttccttttacttattcttacatgagtctattcttcacctaaggttcatttctcac

SEQ ID NO: 478206 - DNA, 602 bp, Homo sapiens
agaatttgaatggatctccttgtgcagtctgggatttgctcctgctaaactgaaatcttctctcagggggtgccagtaaactacttgtaaaatgcaatgcctcttcaaaactcatccattccagtgtctgcatccagagaaatgcaatgcctcttcaaaactctcatccattccagtgtctgcatccagaaaaatgcaatgcctcttcaaaactcatccattccagtgtctgcatccagagaaatgcaatgcctcttcaaaactctcatccattccagtgtctgcatccagaaactaccccttgtgactcctctcaccttacacatgccgattctccttgtcgtgctcccacaaggccgtgtcgcctgcttctgttccttgcccagtccttggtctccttctagccccactctgttcctcttgcagtgtcatggccttcagctgcagctccgttcagttggctcccagatctacagcttcatccctgaactctctgctgagttttctatccacgtttccaaacaacaaatggaacagctccacatgggaaaattcaaagatcctcaaactcattttgcccaaaactaagttcatcattatta

SEQ ID NO: 478207 - DNA, 1596 bp, Homo sapiens
gccaacagcgaaagcaaaagtggttcggcacagacattgtttaaaatggctgcgttaaaaataccatctcggcttcacagatttctggagctgtttacctccaaatcagataatcgactcagcaggctacatgacctctggtgtggaaccacactcttcctgctctttctgggagttggttatccaattaaagaagcagtcctcatgctgctggagggctcagaagaagacaagaaaatgtgggaaagtttggaacttactagagacttgttgaatggctttgcccataatgctgatagtgacatggacattaaggttcgggctgaggtggtctcagatggagatgagaaacttgttggaaattggagtaaaggtgactcttccatggctgaaaggggccaatgtacagcttgggatgtggcttcagagggtggaagccccagcccttggcagcttccacatagtattgagcctgcaggtgcacagaagtcaagaattgaggtttgggaacctctgcctagatttcagaagatgtatggaaacacctggatgtccaggcaaaagtttgctgcaggggcggggccctcatggagaacctctgctaaagcagtgcggaagggtaatgtggggtcagagcccccacacagagtccctactggggcactgcctagtggagctatgagaagagggcccccatcttccagaccccagaatggtagatccactgacagcttgcactgtgatcctggaaaagctgcagacactcaatgccagtccatgaaagcagccagaaagaaggctgtaccctgcaaagccacaggggcagagctgcccaacaccatgggaacccacctcttgcatcagcgtgatgtggatttgagacctggagtcaaaggagaacattttggagctttaaagtttgactaccccgctgggttttggacttgcatgggccctggaccgggggaggaattatatggtttggccacgtccccacccaagtctcaacttgaattgtatcccccagaattcccacttgttgtgggaaggacccaggaggaggtatttcctgtcacttttctgtggaattccagtgttctttcttgcatgatctatttgaaaggtgattactcactatttcagttcttcttcattgaggaggttattggagtacaggtggtatttggttacgtgagactcccagtacccctgcttctggtgacagcccatggcaggtggggaggacttgcagatggaaagaatgagaagggcagcctggctcgcagggagtctgatcaaccctgactgtgaagatacaggttgtaagctgagatcatattggagagtttcttttgtgactaagggatagagaatctgaatttaccttcattccaaagaaaataaataatcttaaaacaagctttaagcatgcatatggctgtcccctcaagtgatgtgtagattaatctttctccttctaatgatgattgccttatgtgtgcaggcagccatatttctctgatttcctggaatagtcttgatttaaatgtctaccttactgtcccactaagaacacctagatttgtcagaccgcac

SEQ ID NO: 478208 - DNA, 3449 bp, Homo sapiens
aaacaactttctcattgcctaagtgggatgcgggtgggaggggccccgcccctctgctctgaccgcttctgtagcggctgaatttctgccggagtcgcagatggcgggtaggttggtgagcccagcgcctcacacatttcctgtcgacttctgctctctcagacagaaatgggatccactcctaccgaggaatggctttggcagaaagagacccatcggttgcaggagctgaggcgattgcttaaactgccacctggaggaggattgagagaggtagaggctgatgttcccagagaagaactttctgtggattttgtccaagtgccccaggaggagagtcaggaggcctggcagtgccacaggaggcaaggcgcagatattagagaggtttctcctggtcttcttgcaaagataagtttgcagcttcccaataatgggccacagctgggaccctgtgctagtctgcaggcaccatggcaagcccagactaccacttggtacaggaaaggccaaatggcaccagagagaaaccccctagagaccattactcctccttatgggagtcttatggaatgctaaagcaatattctttggaatgtagcaagctgtacagattattgtaacatacatacttatcgtgaatagaagatgttgtctgtttaagtgaaaccttcacttcctcacttaggaatgctgacccattctttgaagtctgtattttctgcatggtcattcccaagctttgaaatggagtaaatgctatactcaaccatattttctgaatctcattatttaagattgacatttgagatcagcagtttatgagcgttccatttgttatacattcttgcctaaacttgttatcacttactatcagtgtttttgagtcattctaaacagtgtgtacttatatctcattgtttaatttgtatttccttgacgaataataatatagtttctttttacatgtttattggccatttggatatccacttttgtactgtttattaaagacttttgtctatttttccgttcagttatctctgttttttaaaaatttatttgtaaaacttatttatagatatttgatataagtcctttgtcagctacatgtattgcaaatgccttcttgcagtctgctttttcactctcttaatggtgctttttaaataacagaagttgtagtattttaactagtccattttatcaacctccttcataatggttaatgtttcttggatccacttaagaaatctttgtctaccccaaagtcataaagatattttcatatgttattttctagcagttttattgttttacctttcacatttatatcaacaatcctccttgaattaagttttgtttgtggggtgacataggaatatcatgttttttcaatctgtatgaataccaaattcactcagagccatttattgaaaagaccatcctttcgatagtgcattgctgtctcgcctttgtcataacgtgaatgtttctatcaggtagagtatgttcctggattctctgttcagttccatttatctatcaatgcttgcaccaaatatcatactatttgaattactgtggctttatatatagtaagttatgatatccagaagtataagtactctaatttcattctcatacttaaaattatctttgttattcttggctgttccatttcatatgaacttaccccacacaggtgaaagccctgctgggttattagctaggattgtatttaatttattgacgattttgggaagaactgtccaggtaacaaaattgaatctctagaatcataaatatgttttattctttcatttattaaggttttaaaaaatatttcttaagaaagttatgtagttttcattagactatatgttatgtatatacgaatgattgatttttgatgtgaatcttgtaaccagtgacctagctgagttcactcattagttctaataatatgtctccatattcttatggattgctttcatttacatgatttactacatatacacaatatggtatctgtgataacataatttttattctatcatttttcatttctccttttccagtagttctttttcttgcttcattgtactcgctaaaactcccagaacaatgctgaagagaaataaatgatgatggcaggcatcttaccttgtttctgatctccaggggaaagcttttcctgtttcagtgttgtgtataatcttagccataggttttccgtagtcttcttatagcaatagagctttcttctatttacagatttctaagatgttttaatttattgagtttaacttatgattttctattttatcctataaaagtaaattaattactttttgaatgttaaaccaacttttctggaataaagttctcttggttgctgaattcaattgctaatattttattagaattactaaatttatatttgtaaagaatgtcagattttttttttctttctaacaatatcttaccaggatttgatatcaacatcatgcttgtcttataaaatgggttatgaagcacttttctttttgctgttttctcgaattgtttttaatatattggtgttatttcttccttaaatatttagcagaatttaccaaaatgtctttcttgatctgagatttcatatcagaattatttttcatagattcagtttctataatcaatacagatcttttcagattttctatttcttgtgttaattttagtaaattttgtttttctagcagtttgtcacttcacttaaatattcaaatttattgacagaaagttattcataatatcctatttatttattgaagtctgttgaatccgtaatgtgattcctttttatttctagtattggtaatttgtgccttttctctttttaaaaaactcaatgttactaggggcttataaattttattaggtttttcaaagaaccaacttttgaccttgctgattaactctatttttttatttcattagtatctgttcttatttaacatgtttcctttcttcttttggtttaatttgctcttattctatacttttttgagactaatatttcacttacttattttcagtctttcttatttcttaaaacatgcatttaaggctatagattacttttgaatagtgactctacatgtatcccccaagatctgacatgttatatttttattatttcagtctaacatttttaaacatttccattgagattcttccttaatcctgtgttatgtcaaagagtacttcttaatttccatacatttggagattttatgggttctttgtaactaatttctggcttgattccactgtgatcagagaacatattcggcttgattatagtacagcatatggtcattttgggatcgtgatggctgtctgttattcagaaaatagctcacaatcttttttcaaatatgagaagctcctttttatgt

SEQ ID NO: 478209 - DNA, 685 bp, Homo sapiens
agtgggtgcagcgcaccagcatcgaatcctggtttgcgtgctgaagtcaaaatgtggtgctgtttggcccagagtttcctagcccctcccatttctcctttcgcaatcctggcgctcctggctgagatgagactccagcgtggacgcaatttttctgaacgatataagataggaccaggacaaatggacttaggcgttgtaaacatttggatttctaatattaaaataaagtacacagaagcttcaaaagaagcagaaaaccaatgtggaagaaaagaacaagaaccagaacataatgggtgcaaaggtaagataaatgcaggacagacaaaaggaaccattgtttatgaaatccagagtctgtcttctacattcccgcgttacatttctaaagcagtggttctcaacgtgcagtccctgagccaacagcatatgcttctgcctgaacgctggttagaatgcttattctctaaccccacgctagacccacttaatcagaaacatctgcagaacttttccagaatccgcaagtgttgctggcacgagcttcattgtcagtaggtaatgtgaaaattgaatttgttgttggtgataaagttcacgtgtgctttctttggggggacattgatttgggattatagtttactgtaacctggtaatttcagtaatgcaaatgcaacaaaac

SEQ ID NO: 478210 - DNA, 584 bp, Homo sapiens
tgacagctataattcttgcaagtttacttcaacaggtttagagtaatgaatgctgcagttttctgggggtctgctccaggccctgcttgcctcagattttctagtacctggaagtatcaccagtgaaggctgcaaaacagcaaagatggcagcctgccccttctcctggaagctccctcccagggagaagcagtctggccacattgttgtagagcagctgtgccatgctagggtatcacttccacctggtcagcttgggctctccaaagcccacaggctggaacagctgaattgcacaaattccccaaagagcaacaatggtggcccatttcatcccagatacttctctacattttatttgactttgacactgcctatcacctatagctcagatgctgttgtttactacaagtatgctctaagatcttcagaaagatgtgggaattccgctctaatctattaacaaatgcttaaggagcacctctagaaaaagcacatgaagttcttgaactttcactgatgcagtggctcttcgctttgctgacaatgaactgtttaaactgttgtttaaaaacaaacagttt

SEQ ID NO: 478211 - DNA, 916 bp, Homo sapiens
tgtcatcatgtcttcaatgtaatggaccagtgtgatatcttgtggaagcaaaaagcgatcaaggtctctctgaataagattatgacacaaagctggagagttgatatacccctgaggcaagacagtaaaggtatattgctggccttgccagctgaaggcaaattgcttctggtgggccttatggacaggaatggagaaaaaggcatttgccaagttagtggctgcatatcagaggactacaatgacattttgggtcccttggaatcaacgtcagctcagagccagtgtccagtagtccccaaaaagcctaattattttcctttccagaatgcacagaaagagaaagacgggctggtgaaggacaaactaagattggctaacggtgaccccaagaaaccaaagggcaagatgtctgcttatgccttctatgtgcagacgtgcagagaagaacataggaagaaaaacccagaggtccctgtcaattttgcagaattttccaagaagtgctctgagaggtggaagacaatgtctgggaaagataaatctaaatttgatgaaataacaaaggcggataaaatgcgctatgatcaggaaatgaaggattatggaccagctaagggagccaagaagaagaaggatcctaatgcctccaaaaggccactgtctggattcttcctgttctgttcagaattaggccccaagatcaaatctacaaaccccaccatctctattagagacatggcgaaaaagctgggtgagatgtggaataacttaaatgacagtgaaaagcagccctacatcactaaggcggcaaagctgaaggagaaaggaagatgaagaaggcgaagaggaagaagaggaggaggaggaggaggatgaataaagaaactgtttatctgtctccatgtgaatactt

SEQ ID NO: 478212 - DNA, 576 bp, Homo sapiens
attgtgagtcgtgctgcaataagcatacgtgtgcatgtgtctttatagcagcatgatttatattcctctggggatatacccatcaggaccctcagctgcaggtctgttggagtttgctggaggtccactccagaccctgtttgcctgggtatcagcagcagcagaggctgcagaacagcgaatattgctgaacagcaaatgttgctgtctgatcattcctctggaggtttcatctcagaggggtatccagccgtgtgaggtgtcagtgccatctgccacagctttgcttggctatgaaggggaattccctgaccccttgcacttcctggatgaggtgatgcctggccctgcttcggctcacgctcagtgtgctgcacccactgtcctgaacccactgtccaacaagccccaggaggaagtagagcaagatggtggaataaaaggctccacagatcatctcctccacaagaacaccaactgaacaactatctacacagaaaaaaaaaaaaaacaccttcataaaagccaaaaatcaggtaagcactcatagtacctggttttaacttcatatcattg

SEQ ID NO: 478213 - DNA, 795 bp, Homo sapiens
acaaatccagttataaacagaagccacgtctgtgtcttcagtggcacctgctgcaggggcggagccctcatggagaacctctacttaagggtagtatggagaggaaatgtagggttagagccctcacacagagtccccactggggcactgcctagtggaactgtgagaatagggtcaccatcctccagaccctggaatggtagggctgccaacagcttgcactatgcacctggaaaagctgcaggcactgaatgccaggccatgagagtagctataggggctgaaccctgcaaagtcaaaggggcggagctgtccaaggctttggcagcccaccctttgccccagcatcccctggatgagataattgaacgaaatgtgtttgtcaaatatcaaagggtccagcagaaagggagaagtgcctctgtgactcacagaggggctagattatgtttatttagcataaaccttataagctattgtgggtgaaggttttcagtagtattgtttttctcatgcaatcattttttttttttaggtctccagtgtataagctcatagatgtgttgtaacataggaaattgaaatcccataggcaaatggacatggtatcattctgtctaccaggtgtaaagctctgctcttttatgaattgtgttacctgatctccttgtcttttgagtgtaccagacattacttcgtaatgtgagggagaacttgacctttctgtatgtgatggctgtcttatttgtaggaatgagaaataggagacaaatgaattgtgataagtagattaac

SEQ ID NO: 478214 - DNA, 1043 bp, Homo sapiens
agagagagagaggtataggtatgagggaacaggagccaaaaagaaaaaagttttgcaaaggagaaaagagccttgaagataaggagcatagttgtcggccattggaagttgacaatgaccaactgagagcaatcatcgaagttgatcctcttacagctatgagagaagtggcagaagaactcaacgtcaaccgttctacagtctttcagcatttgaagcaaattggaaaggtgaaaaagctcaataggtcagtgcctcaggagctgagcaaaaattttaaaaattgtcgttttaaagtgtcatcttctcttattctacacgacaacaagaaatcatttcttgattggattccaaacttgcaccaaaaaaaggtcatggtcactgtttggtggtctgctgcaggtctgatccactacagctttctgattcccagtgaaaccagtccatctgagaagtatgctcagcaaatcaatgagatgcaccaaaaactgcaacacctgcagctggcattgatcaacagaaagggcccaattctgcacaacacgcgaccacacatggcacaaccaatgcttcaaaagtggaacaaattgggctataaagttttgcctcacccgccatattcacctgacctctcaccaactgactaccacttcttccagcatcttgacaactcttgtagggaaaacacttctacaaccagcaggatgcagaaaatgctttccaagagtttggtggggggtaggaagggtgggaaggggtgtgggacacaaacattcagaccatggcattttgcccctggtccccgaaaatccatatccttctcgcatgtgaaatacatgcattctatcccagtcactaacgtcttagtttgttccagcatcaactcaaaagtctaaaatccagagtcttagctaaatttcatctatattagatatgggtgagactcaaggtatgattcatcctgaggcaaatttctctccccagctgcgaacctgtgaaatcaaatgttatgtgcttctaaaatatagtgaggctctaagcat

SEQ ID NO: 478215 - DNA, 704 bp, Homo sapiens
tcacccgtcttctgcatcgctcatgctgggagctgtagactggagttgttcctattcggccgtcttggctccatcccccaaatttctccacattcttgccaacaattgtcattctctgtttttttcaatagtagccatccttatggttgcaaggtactatctcattgtagttttgattttcatttccctaaagattattgatgttaagcatcttttcatgcacttattggccatttgtatggcaaccaacagagctggagtctgcaggagaggaccattgagatttagagaggggaaactgactctgaaaagtcagaggccagtgcaaaggaggacaatagggagaggaatgggactgaaagcaaaagctaattttgatgggcagcaacgtttaggaacttaagtagtaaaatcaaaataaacaatttgagaatattgtctatgatgaggtttggattgatggcattctgtgttgccaactacggactggtccaacaatgtctgaggacaattagccatatcagtctagttaagaactagttccccttactggagaagtagcatggtcatttggataaaagactggttttttgagttgacagaagttcttgcactggttctttctcatctttgtgggctgatgtttcttcagtgcttgaagtttctaccctttgggttttttttaattctatttgatgacccta

SEQ ID NO: 478216 - DNA, 452 bp, Homo sapiens
taagtgacagctgcaatctagtcctgcctcctgtccaccatgaagtctccccattccttcttcctgtttgaaacactagttgtcccattgggaatccctcatccccaaggccttctgctcatgatgaataatcaatcagagagagaccttaaccctaaggcagacactgaagaggatttggggcatgaaataggagctgcaggttggagaacatcacaagcaagggcatctgtaacccaccctacccactttctcaagagacagtccagagagcgagtaaggcacaggggccctcttctgcatattgaaagtgagaagaaatgcctatgcgagtgtctaggcagagagcttgaaacagccacttgtgggtctctgcacctgcagcctggtgcagggatcagaagaatgtacttattctgtgcaacaagagccatgcctttgtgacaaagccc

SEQ ID NO: 478217 - DNA, 1239 bp, Homo sapiens
tctcccacaatgctccccactttcctgttgatgaacctcttgtccctggctggggatgtggctctgcagcagctggtccacttggagcaggcagtgagtggagagctctgtcagcgccgagttctccgggaagaacaggagcacaagaccaaagatcccaaggagaagaatacaagtttcgagaccactatggaggaggagctggggctggttggggcagcagatgacacggaggcagaactaatccgcggcttctgcaagatggaactgttggatggcaaacagacactggctgcctttgttccactcttgcttaaagtctacaacaactcaggcctctatagcaacccagacctctctgcagctgcttcacctacccttggcaagttctgcatgatcagtaccactttctgcaactcccagcctcatcttctgttcaccatgctagaaaagtctccacttcccattgtccggtctaatctcatcgttgccactggggatctggccatccactttcccaatctggtggacccctggactcctcatctatatgctcaccttcaggaccctgctcagccagtgtggaaaacagtggggctggtgatgactccacctgatcctcaaggacatggtgaagatatcatcagccacctgtcagaccccgagctgggggtggaggaagtgccttttcacaccattatgaagcagttcttctcctacatcatcaccaaagacaagcagacaaagcctgttatgggcaagctacaacatggggccaagcctgagggcaaggctataatagatgaatttgagcaaaagcttcaggcctgtcatgccagaggtttggatgggattgaggagcttgagattaaccaagcaggtagccagagagccccaacagccaagaaaccatccactgtttgtaggcaccagcctctggcttctgcagcctcagacaatgacttcgtcacaccagagccccgtcgtactacccatcggcatccgaacacccagcagcgagcttccgaaaagaaaccaaaagttgtcttctcaagtgatgacctaactgaactgcattgagctgctttcactttggaatatatgtttgccagtctccttgttttctaatgaataaatgtttttatatacttaaaaaaaaaactctcttcctccccagttcatctgcatctcattattgggctacaagaaacagcagcccgaccctatttggtccaggaa

SEQ ID NO: 478218 - DNA, 867 bp, Homo sapiens
gggagcacaatggagtctgctatagaaaaggatcactgtggggcagccaccctggacctcaaagaacctcccagagcctcagtttccttctctgtaaacagggatacagtatctccatacattgtcaatgtgaagattacaaagggaagcttgaacagaagccagcacattgcctggcctaagcctcaggcaaacttcatgatgcaggttttacatcagccccctgggctaggaccacagcgccagccagcttctcttcaacattctcaggacagtatgaaaggtgagagactgagaatagtgtcaacatcttcactggatgagggccatggccatatgggcacagacatatggggaggtgttgtagaaggtctccgaagatgtttccccaaaggcccagcagggtataggcttggagctgtttttctcttactggtgctggggctacactgtgaaagccccactctcttaggctgtgacgcagctgccacagcagggagactgatggccttccaggcagctgagcccatttgccatgaagagtgacttctcagggctgaaggatccaggatcgaacagatgaaatgcagctgagccgcataaactccgaaccctgcctctcagctgcccttaaattctgacaagctgcggtactaaaatgactcccgcgttgggcttcctggaacctctcgtgtcgcgttctcaccggctgccctcaccctataaacttaagctactgatgatgaggattttccaagcaccttatgttgagcctctcttaattttgtagtgagggaataagttgttttacatctttagaaaagcactataatattaattgctgcctttctgataatttaggacact

SEQ ID NO: 478219 - DNA, 783 bp, Homo sapiens
gacagcattaccaggtatccgaaacagagcaacatggcagacatgtggactgggcataggaggcagctgtggttgggattttggtttcaattccaggaaataaaaatgtatttgtgcagaaatgatgcctataaccaaattttcttccccccttgcctttcttccttttccctttatttactcttcttttctctccctctcttccttcctcttttcctctttcttctctcttccctccttctctttctccatccctccatctctctctcttcctctcttcctccttttcttcctccctcttttcctcttcctcccttccactctttctccccttcatttcttctctcccctttcctccctccctgccttcatttttttttcctgttaacataccaacatttaatgatgttcacaatgtataaaacactaggtgaggtgctaggcatacaaagatagtaacagtgcttgtcctcaagggaattatagctacagagacaaaaggaacatgtaaattgatgtatgtaaaacatgtgtgatagaatacaatggtagaaataagtgtaatctatttatatttgttgttataattcatatattttaatctgaaatctgttttattcttttgtggtttctaattttcatacttccttgattttcctttattttttatttttaaataaagaatatatatttttttcttttattattcttggtatatgttcccttttaaattccaatacctagtaccattaaattgttcagaagcattactcattttcaaaa

SEQ ID NO: 478220 - DNA, 753 bp, Homo sapiens
ggacatcctcatcacagtgcttacctcatcaatccagcaaggagagtctctagtgtaggtccacaggcaagatggagtctttaaagtataacataattatgggagtgacatccttttatctttgctatattctattggttggaagcaagtcacaggtcaggcctacgcacaggtgctcctcaaggggagaaggttacacaggtatgaacaccgggggtggaggtcctggggccaccttacatcctgtccaccactgtgacctacatatttcaaattttcccacaggtgttctagtggcaaagaacagtcagaagctcccacctcagagtgtctgctgcaaagctagccccttcgacttggagtcctcatctgttctcagcacttttctcccagacctgaacccgagtcccaccgctcatgtctcgaccttcgagaaaggagaagtgggaagagactcagtgctcatggaggaccgatcacgtgccagaaggttttcaatttattttgcccagacccatcagaggaatcacaatctaaggcagctatagctttaaaacatgcatgtcttaaatactatgagttgaaaatcaaaatgaatctttgatccatgggctacagaatgggtgctatattagcagacatgaaaacaactttcatctccttgtacatctccattagagttcttgggtgaccaggtgcagtgtcaatgagctgtaatgttttcaaaggaatctttttttctaagcagtaggt

SEQ ID NO: 478221 - DNA, 813 bp, Homo sapiens
tgttgacaagatgaatatcagttcaaatgaacatcttggaaagagacacagagaggccacagactgtggggagagagagaatcctattttatccacagtccctataccaaatactactctcacaaatccagaatgcgaatgggggcaaagtttgccttgtccaagcagaagctccaagagcctctgtatgtttcagccacaggaacagcatgtcccagagaggaggccgtttgttcagcctggatctcagaatgaagacactagagaaaatgctgccagaaagaagggatcggcagggccaggattaggtgaagggaatgagctgaatgcatttcaggcttataagcagttcccccggatctacaggcaaaaaagcttttcaccatccccacctcccccacgagtgaccaatttctcagcattaatgcatctgatggcaccgagccttagtggcctgagggaggacatggaacatggtcaactgagcatggtcgagtacgttccatctgcagatgagaatgtatattctgtggtcgttggatggagaattctgtagatgtgttttaggtccagttggtcatgttttaagtttaagatcagaatttctttgttcattttctgccttgatctgttttaatgctgttagtggagcgttgaatttccccatattgtgtggctgtctaagacgttttgagcagtccaagtcaaaagttaggtcaccaggagacccacaactccctggggacctgctggtcctctggacttgtcagagtcagagctggttgtggggtatgtctgtggttggactggtga

SEQ ID NO: 478222 - DNA, 829 bp, Homo sapiens
agtctgagtttgcacctggcccctattcacaaactgactatccatggcaagcattgagtgtggagcacccactccacagcccccaaagagctcagtgggcagagggaaccggacgtgcaaaggcacggaggcaggagagaacacagagaaatctgccaacaagtcccagtggctggaatatggagtccaaagtactgatggcagcagggattccactagaagtaaagatcagtttgcgagagggaaaggacccgaaaagcactctgagaaatttggctttgattcaggaagcaaaaaagaagtagcaagaattcttcattctgagcgttttagggagaaacgctggcacaataaagtgtgcaattttttcttgcacagacacaagcctccaggggtcccacagagccatgttctcacagtccggccacctccccaggggctgccatagggtgggactggatcccacactatttgtgccattcactgaccagagacctctccccaggatggggagtcatctttcattttcctgatttagctcttttgtcatgtaagatttcgaattgttttgtcatgttgcctgcaaaacatcctgtatatgttttattggaactgcatcttgccaatctatgaatgggaaaggataaactattcatgatacattatcttttatttaaaaatatggtatgtcttgccatttattcaagtcatcttttatatctgtttataaccttttgtaatcttatttatatagactgaagactaaacaaatatacatttaaataatgatgtaaattaactacatgtatttaaaggacagagaatttaa

SEQ ID NO: 478223 - DNA, 678 bp, Homo sapiens
aaaatcagaggcatgggtgtatgctgaataatctttcctgcttctatcaaagggcagtgaaagacgttgaagatcaatacaattttttttttatcatgagtgttatttttcagttgtctcaggacagttggataggacatctattgctgttgctttatcatctgccaacaatcccctcaattggattgcatggtcctgcaatgctgctgaccagaaccacttccactcacccttactccagccattggggtgggcacgtgaccagggcaggccaagtgcagttatcccaccccctggaccccatgattggttctgagacgggcgctggcctgacccaggccaatcagaatcattcagtggacttccgggcctctcaatttcctctgggctataggggttgtaaatccagacctggattcaaattccagtcctcacccatttcctgggggcaacttgtttgacttctttaaacatgtttccttatctgtaaatggggaaaataatacctcacagggttgctgtacaggttgctgtacagggttgctgaataagataatataatagacatcttatgtatgttaatttagaaacaggttttcaggactaattacttgttcataggtcaatcttccttactagtctgtgagcttcttaaaagcacttttgttccttgagtgt

SEQ ID NO: 478224 - DNA, 1136 bp, Homo sapiens
ctggaaaactgggttgacactcctgtcaatgcccatatcaataccactttttctaatagtacttgccacccagctttgtgtgtggcataagtgcacagtgttgataaagtctgcagtagtgcacagtaatgtcctaggctgcacattcacccaccactcattcactgactcacctggagcaaattccagttctgcaacctctattcatcataagtgccctcttcaggtgtgcaacttttttttatcttttatgccctgtttttactgtacattttctatgtttaggtgcacacatacttatcattgtgttacaattggctatagtattcagtacagtaacgtggtacaggtttgtagcctaggagcaataggttataccatacagcctaggtgcgtagtaggctctaccatccaggtctctgtaaatgcactctatgatgttcattcaatgatgaaatcatcttatgacacatttctcagaaccttttatttggctgtatctgtgttaccgttgatctggctacataagaatgctggaattcaaggtttttctgtagattcttcagctagatgatccaagataatacaagtaagcccctcttctgacaataggttttaatattaaaacatatattttatttatttattctataaaggatttaagataacttatacagaaaaataaaatatgtcatagtgggaacacaaaatagatgtaaaagaagaaagaaaacaaaacaaggcatagaatgggttaagagccctccaaatgataagtaccattttgagattcttcatatttggatttccagataatactgtaacctttattaacttatttaattataaactatcaatcatcaagataattgaagtttgtcttaaatgcacaaatggcttagagaaaatgttcttatagaaatagactaaatttctctacaaatattctcagatgggaagtgttcagaaggcactgatcccaccttctgctgagttgttggaaaagacaaatgataactactttgggtacaactatccctcataacagaaggcaacaggcccctttgcttcttgttggaaaattcaactttaaatctggaaagacctctgttacgaatggaatgtttctcccttcc

SEQ ID NO: 478225 - DNA, 661 bp, Homo sapiens
ttttgttttctaaatctatgctggcatggtgtctggaaagaagaaatatgggttccgacggggtttagggaacagaaactggcacttgaacaccaactgtgtatcagacacaaagctgggcatgttcacgttcctctccttccttctcacagcagctctgaaggaaagatgtcacagtcattttattgcagataaggaagagaagcttggagaggctgggcggcctgctacagtcacacaggtggcaagccacagaactggaggtggtgcatctgagccagggcccagccatgatgatcaccaggcgctccctggaggaagccaggccgctttgacaacagcaacaggctcaatggtctctgctcctgtagcccagggaatgacagggggtctctcttgctcagggtcatgtgtccctttccttgaccccctttccttgccaggacttgtgatccaatgtgagaggtgctgggtccagtttagacttgaaatgaaaaggtggatttgaaaaggtcttgaagaaagtgttaaacattgttaaagagattgaaaatgagaaagagagagaaaaaaaaaggagagagagaatagtcactttgaccagagaagggggacgcagttgaaacgcagtcaactccttatttttgtatgcattgaaaat

SEQ ID NO: 478226 - DNA, 484 bp, Homo sapiens
tttggagccaccgatattttccatgctcatcacaagggagaggggagctataatatttggacatcacaatgagcgtacatgtgcacaacatgcagctattaatagaaacaaactcttgctgtttatttatgacagaacacacgcaggacttgaaagatgttactaataatgtccactacgagaactatggaatcagaaaactggcagctgtgacttatcatggagttgataacaagaagaataaagggcagtttgctaaacatttaatgattacccttaatattcgtgacaggagccctctggcacaaatggaagaagaaagaagggagcaagtagctaaaattaagaagatggagatggagatggagcaggtgtttgaaatgaaggtcaaagaaaaagttcaaaaactgaaggactctgaagctgaggtaatcagtccaatattccagctcttagcagacattgtgttcctttttaaatagta

SEQ ID NO: 478227 - DNA, 882 bp, Homo sapiens
cccagcggatggaggggcagtacggcactgttccccagggcccgcgaacaaacgttaacaggctgaatggtacagaatttctgtttggggagatgtcatgcctgctactgaattgccaggggcaattgaatgacttaactggagtcatgcaaatggaaggcacaggatttgagcccatcgcaaacccagcaggaccagtgaggcacagctggtcaaggaccacagacggcatcaactccctgatggctacagagggggaagatacaggcctgtcctcagaacatcagcctggccattggaagtggagcactggattaagagtccccagtgacctcatcatgtccttgatggatgtgggacctctctggagaaaggcagtgtgggagagctggggacataactcccagtgggcaccaggaggcagtgcagccccagcatcaggcccttcccacaggggagccctggcttcagcagctgcagaggcagtaaactcctggggctagatcaacgtttttggattttaagaagtaaaagacgttttgagggtcatgaacttggaaaagagccagactttcctgttcaaggtcttgacccctgttccagccccacttatagccaaaagtaggaatgaagatggccttgtggttttaaggctgatgccctgtcatggcaaaaagaggcagaacggatgccttgtgttgtggagactcgaaaaggggtggtggcctgaggctgtcatctgtctcctgaggactggagagagccagccttcccttcggcatggcctctgaggagaggtcagctgttgcatactgtggggcctgcgcaggcccagtggggagggcgggggtggcctggagcccttctccttggcactgcccc

SEQ ID NO: 478228 - DNA, 726 bp, Homo sapiens
gtcttgttttcaacagctttatatgactgcaggcctgacccaggccagaggagtggagaagcgcagcactgctgtcacctaactgagctcagaccctcaagccagagctgctctgaagagcagcggggaagggggcagccagacggatgttcgcctgccagagagagaagacacagagggtccttggtctctgcgcctgcagcagcaggtcctccttcaacagctcagagatgcccaaactgctcttagctggaacgaattacttcttgccaggcttgaaattcgtttcagtacctgttccacctgcccagtttgctctgacccagagcgactctgccttcagacctcatccctgggtcttctcctggaaccagactcttgcaggccatttgctagaccatccgctcccctggcattcactgctttgctggaatacactcagaagtggtttagctcctccagaacgaccaccttctcactgccctgtccagtgcctctgctctcgcagagttcaagccaaaagacaatgggatcatctagccaggtgtttcctctactattgatcacctacagtcaagcactgttgtagacatggagattaagaaaatttgtaaagatttctgccctcactgttgacttgtgccatatggcaaattagtttatttcaatatggttaaattgctttgctttttgttattattcacccacacgatcagagctggcacc

SEQ ID NO: 478229 - DNA, 763 bp, Homo sapiens
ttcctgtctggtgccctgagctgccaggagaggctccagccacctgagacccggaactggaatatgtggcatccatgtttgaaaataagttggactttatcataccagaagcagggcttagtcaccctcaacacactgtccagttctgcacctcttcccagtttttcaatctggttgatctagatatctgccttatacaactgcctcctggtgaccacttccccgtgggacatatagatgcctgcttgactcacccaactgactcccacaccccacagggactgcacagatgtgccacagtgacacctctgttacagtgtgcctccacagagctggggccagctagttataaccccatcaccactaacaatagtaatcacttcaatctgagctctgcctttacaaagcactggggtgcctttgaccatcgtctgaatcagctcatgcatttaataatccacaaaccacgtttttcatattcaagtcatcttttctctcatcattttgattgcctttcaaaggtataatgttctctcaaattctgttatgtagaaaacatatttttcagaaatgttgtttgcatttggctgttgatggtctgttgtgtagggagatgttttctttgattccttgtgtaaagttctgtcttttgaagtactgaatcttgtcaaatgtctagtgattttccttcatttgcttcctcttagagagagaagcctttctttctcaagtatgagtagcaatggtgatttcagtccaacat

SEQ ID NO: 478230 - DNA, 578 bp, Homo sapiens
acatccgtggaaaaaagttgtcttccacgaaacgggtccctcatgccaaaaagacttgaacttggactggaacttacaccatcagctctcctgattctcaggcctttggactcagtctggaactctaccatcagctctcctgattctcaggcctttggactcatttcctcatcatcaaaatcatcatcatcatcttcttcatcagcagcaagttttacttttttctgtggcaccttgctaccacctccaggggcaaatcactttccatatatacttaagagtttcacatcctcctgttcttcatcttctgcctctgaatcttcctccacagtgactaagtgctgtccactaatatgcactggccctgaaccacacttcaaccatcaagtttctgggtccttaatgctgagagctggaaaaaagcccctactccctgatattccccctgtggggagacagccttctggactgcccccaggagtagccctcttcatcgccgtctgaattgctatcccgagaactttttatgtgcagacactttgtcatgaatttagggtttatagggaagtaaaagaaca

SEQ ID NO: 478231 - DNA, 788 bp, Homo sapiens
ccagttcagaaatacctacattggctctaccggaaaagtcaaaggcagctcatgctggtttgcctccagtcttcaaacagctctggggacatagagagttgcctcagctccaggaagccgctacaccagggataatgagatctgggcagcaggcagacacctgcaatttagagccactagggtcagccctggaacaagcagaatgacacggagggctgctcttgcaactggtgatcccggagaagaagaaatggattgccaggtggacatgccggtagtttatctccagtgtgtggtagcactccccctccaggagatgagaggatacctggagcccctccatttcaacccaaaccttgccttcaacgctgatgaaatgcagggctccggcgtcttttatggcagcagcccaacaggaaatctgactaaccaacaagtaattcttttgcacctctatggaagaaaacattctccgagtgttcagggagaatccaggcaggaaaagcaaagccatcctcatgtggtcatgggagaacaattaagtatcaggttgtgtgatcctgaatatgcttctctagcacgtaaaacaccagccggcctggtggaagctccaattgttgtcctctcctcttacagcttctttctaagtagaaactctgcattaaattaattctccccatacagtttgatgagaagcagtcagttacccagagcatatctttcctcttagcctttaaaaggggaacacaataaaatactgactctattaagataagaagtagttttgt

SEQ ID NO: 478232 - DNA, 545 bp, Homo sapiens
aacaactctggacgcgccatctttatgaaccgtaaaagtcactgcgaggttaagaatcgctacacagcacattgtctctgccctcaagacctcagttgggtgggagcaaaaacagacatgggaaaaaacagtttcaatgcaggacccatggaaacaaatcctgcggagagcctgagccaagtggaatttgcctctggagagctgtgcctgcctttcacaatggagttccacacaggcaagttctttctccctctcctccatgtggaccggataaacacaacatccctgctctgccttactcagctctattgctcagtccagagacatgttgttgttatgagatctataatcaacagccagattcgactttctgtatgggattttctatcaaggaaggttgtttatgtcttaatcaactgtagcatgcaactcctgccaacatatgtgtcactgtgatttccatattgaagacttcccttcctcaaaatgatgtttatttagtctgtacactttgtttagattctcctcatggaaattctggtttt

SEQ ID NO: 478233 - DNA, 653 bp, Homo sapiens
tgagaatctgcgccctgacgaagatgcaaaattattcttcatacagagggaagcctcacttcctgctgggggctctgggagaagtccacctcacaggatgccctgctctgaacagtggtggcttcatccgagtaagggggcagccctgccagtttgcaggagggagggacaactgtttccagtacccctgtccctccagtagtttatccagaactgcttccagtacccctgtgcctccagtagtttattctgttagtaggtgccaaagccaagacaccagtctgggcagtctaaatccagaaactgaacacggagctaccaaactgtgcacaggcagaatccaggttggagagaatgactgctatttccaaagtgtagtgagccttcttccaactactaatgctattgtttccccacctgagcttaaagggcctccaagcagagtcagacttttggagaggctttcgttttgccatccagcaatgtgcaggttggtgcagacccatacagattcgccaccactcacatactttggtgccgcctgctcagacacgttccctaagcgctaacaattatgtgagagggaaataaaatcacaggaccccaaactcactatgctaaagggacacagattctaccgtgatttgtgtttc

SEQ ID NO: 478234 - DNA, 552 bp, Homo sapiens
agcgtgggcgttatggccatcatgaacatgtcacagttttatgttcttggttttgtgtctagaattggtgagtttcttggtctcgctgacttcatgaataaagctgcggaccctcacggagtgaagctgcagaccttcgcagtgagtgttacaactcttaaagcagcgcatctggagttgttcattcctcctgttgggttcgtggtctccccggcttcaggagtgaagctgcagacatttgcggtgagtattacaactcataaaggtaatgcggacccaaagagtgagcagcagcaagatctattgcaaagagcgaaagaacaaagcttccacagtgtggaagtcgaggtgggttgctgctactggctcgggtggcctgcttctattcccttatttggccacactcacatcctgctgattggtccattttacagagcgctgattggtccatttacagagtgctgattggtccgtttttacagagtgctgactggtgcgtttacaaacctttagccagacacagagtgctgattggtgcatctacaatccttt

SEQ ID NO: 478235 - DNA, 755 bp, Homo sapiens
acaaccactgtccaaggttaagtgagccctgaggcaccagaagatctccaagaaagccacatggaaatcataaaatggagctgaatggaggaaaagagaagccacaccctccagaacctgaccagagtcgtctagccaccaggtccgcactttcctgccttctccttgggtacaccgccccgaagacaggatgtcactgctggaagcatttgccttctcctcctgggctcctgagttgctttggacttggattatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccagagagataataataccactgcctctcaacgctggtgagaagtgtgaaggaagtaatggaagaaaacgtttagaacaatgttagcaagtctacaatagatgtttgatataacgttaattttaaaggcttatgattacacataaaaatgaactttatttaaaaacacccctctctgtgacatagtgttcatgagatagttctgaagtccaaggttcatgggga

SEQ ID NO: 478236 - DNA, 921 bp, Homo sapiens
ccaagaccccagagaggaaggcatgctgttggctctagctctgcttctagctttcctgcctcctgccagtcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctgggataggcacagtgattcagacctcagaattcattccatgtcccctctggatattagactgataatttggatcaggtctcagcatgggccattgaggaacactacagccctgctgagagataaaaaggattatccactcaaggagttcacacctccgggccgacatggagaacgtgcctagaagcagacttggagggtgctcagtggtgggttgtggaatgtaagcctgaagaagcagagtttaattctacgggggtgctttcataatttagtaccctgacagggctcctggtgttggtccttagacactcctgggatggctccctggaaacatggaggaaaccttggtcgcatgacatgatacggagatgttggagctgcctggacacagttacagagggaggcattaaaaggcttcgagagaaccctaaaccttgaatcagccttatagtcctggctcctagaagagtgtttctcaaagtgtactccacggaccacctggataagaagcacgtgaggcttttaattaaaaaaaaaaaaaaaagtacaggt

SEQ ID NO: 478237 - DNA, 1592 bp, Homo sapiens
acatcacacactcgggcctgtcatgggggtcaccaccttccactcctccccagctctctccagtgtgtgctgcaagacctgtgtgctgcagttgctcacacatccaactctccctggggagtgaatcagcagcccaagcattgtcctagtgaactgcttccaacagtccctgacctagaatcacaagaggcttggggagtggggtggctccgacactgcaggcctccagaaggacccctcaccgacaccctgtctgcctccaccatgtccatcagggtgacccagaagtcctacaaggtgtccacctctggcctccgggccttcagcagctgctctcacatgagtgggcctggtgcccacctcagctccttaagcttctcccgagtgggcagcaccagcttccgggctggcctgggcagaggctatggtggggccagcagcatgggaggcatcactgccgtcatggtcaaccagaacctgctgagccccctgaacctggaggtggaccccaacatccaggccatgcgcacccaggagaaggagcagatcaagaccctcaacaagaagtttccctccttcattgacaagatacgtttcctggagcagcagaacaagatgctggagaccaaggggagcctcctgcagcagcagaagatggcttggagcaacgtggacatgttcgagagctacatcaacaactttatgcagcggctggagactctgagccaggagaagccgaagctggaggcagagcttggcaacatgcagaggctggcggagaacttcaagaaaaagtatgaggatgaaatcaataagcatgtgggtgaagcttacatgaacaagatctcggacacgtctgtggtgctgtccatggacaacagctgctccctggacatggacagcatcatcgctgaggtcaaggctcagtacaaggtgatcgccaaccgcagcctgactgaggctgagagcacggaccagatgaagtatgaggagctgcagatgctggctgggaagcgctgggatgacctggggcgtacaaaggctgagatctccgagatgaaccggaacatcagctggctccaggctgagattgagggcctcaaaggccagagggcttccctagaggccgccgtcacagacgcagagcagcccggggagctggccatgaagggtgccaaagccaagctgtctgagctggagaccgccctgcagctagccaagcaggacatggctcagcagctgcggcgaggagagctggctggagtctgggatgcagaacatgagtatccatacgaagaccacctgtggctatgcaggtggtctgagctctcctacgggcgcctcacaagccccggcctcagctacggcctgggctccagctttggctctggcgcgggctccagctccttcagccacaccagctccaccagggccgtggctgtgaagatcaagacccgcgatgggaagctggcgtccgagtcctctgacattctgcccaagtgaacagctgcgacagcccctcccagcctgcccctcctgtggctgccccagagccggggagggaggccgctgtgcattagagtatccaatat

SEQ ID NO: 478238 - DNA, 571 bp, Homo sapiens
tcaaggaaggcttttggaatgtagagatgccagagcaggaggaagagggcattgggggcaatgagcaggaagggaggctgagtgaggcacatcaggagtgcaggaaggtgactctgggagatggaggggttgttctcagagcagagtcctgtttctcgcctcctaatcagacggcaatgcaaaagcttggtctattgagtaaggagacattaacagacctttgtaagcagcgggaaggatgctcaagctctaagacagcccaggtcctgcatccaaggaggctctgcataggtggagcagatgacagccccagcaaagaccctagcagacagccagcatcaaccaccacacatgagagtgactcccaaaatcaccagcagggagccggcaggtctggggttcaaatccagacactctgcagtgctcaagtatggccagcggctgttgtaatggagggtgcagacccagaagcttttcgataaataggtataacatctacattctgtaccatgaacattatttttctatttttaaataatttactgtttagtctcagtcaggggtggccacc

SEQ ID NO: 478239 - DNA, 607 bp, Homo sapiens
agttgcaggaaaacaagctcagggctcccactgattctatattatgaggaggctggtggggctgagaagtgggtgggcatgggtgctagagaagtggcccatggccagatctagtaggccattttttggccattgcaaggacgtggaatttaattccaatcatgagagaaaaccacttgagggttttgggcaaggcatgacaaggtctgatgtgccttccaaaaggctgctttgtggggaggcaaaagcagaagtgtggaggcaaaagcagaagtgtggagggagatgcctgggtccactgatacgtgaattttctcctgcatctgccacccctgaaacagcaaaactggcttctacccttcctcctcctcctcaacctactcaaagtgaagaggacaaagatgaatacgtttatgataatccacctgtacttaataaatagcaaatatattttcttttccttaagattttcttaataaccttttcttttctagcttactttattgtaataatccagtatataatacatataacatactaaataagtgttaatcgaatgtttatgttattggttgttttcataaatataattttttaaatgaagatt

SEQ ID NO: 478240 - DNA, 551 bp, Homo sapiens
gcatctgtgatgcattgccaatatgcaatatgggcagatctgtggaacgctttcctcaagatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcgttttcccctatacttgggctagaatccaagttccagtgtcttcttcgatgctgctatttactgagcacgggagacaagaagattcctcaggatttgcgcagtttaattcagagaatggctttctccttgggaatctcaaggttagcaactccaaagatgtgagttcaagtcccaagcttcataagaatagaaattctgcctatcttgttcactattgcattcttattgcctagaaaggtgcttagcatatagtagttgctctatgaatatcagataaaggaaatttgacctaaactgatttaaatatacattgttatgta

SEQ ID NO: 478241 - DNA, 1033 bp, Homo sapiens
agagagagggtctagcagacactcaaccacttaccagatgtccctgagtctactgctcaaagtcaagacagtctttccttccagggacagtagtatgaaggagaatttgaacctcagcataagtgacttgcccacgggaatatgtttgatttgtgcaagtggagatctgaacacaaagtatctggatctaagcactgtcctcttcttgccccaaaacaagacctccttgccgcttcaccttgctcatcctcagcagagcctgctggcgtggaaagaatgtctgagaaggaaaaagagctacgctgcggagactgctttttcaagccaggttcccagccaggacattttcttctacagtttcccagagatcaagccagcagctgcttcctgccccttgctgagctgtacctgggggctgatggttttactgttctttgataggttggaggaggggggcttacagcctcaaaacaaccctgctttccctatcacggggccagagggagtggagctgcttctgaatgcttgctctgaattcagccttgctgagtgctactcaaggtacagattgccagcccacacctcaggaatctctgatccagcagttctggagaaggtcctgatcatttacattgcttacaagtttccagatgatgctgatgctgctggtccagggaccagaatttgagaagcactgaccaagaggatgaatgatggaatgtggacagagtatagtaacattattttagaagattgttgtgctgcttcaacaggattatgtgtgggtatctgctacttggtatatttaagccttctcctgatcacaacgcattactagctgtcaaaagattggcagggagatctggaccaaattgaaaacagtactgaccaatactatatcatcatttgtgctcaatcagagactttggttagtttctctgccagctctcgaaactctgtattaagtgtacgtaataaccccttaggacttagaaacacggacttccagttaacagaagaaaaagtggtcatc

SEQ ID NO: 478242 - DNA, 539 bp, Homo sapiens
ataatctaactcatgtccgtccagtctacagcaaaaatatttatatttattgcgtgcttgaaaggaggggagcagggaggattttcaatgggaacccctttaaagatggcaggagtgagaatgacctttgatgtggatggttggcagacacccagcaagagacccctcctcgcccccagagacttccccatggagctgcatctcccagcagaggaaagcccaagatacttcacaaaagcagatatacagatggcaaataagcacatgaaaagatgctccacatcatatgtcatcagggaaatgcaaatcaaagcaatgaaataccactatgtacccaggagagtagccaaaatccagaacactcacaacaccaaatgctggtggagcctcaagctcaaccaccatgctgcccaccttacagtaattcagacagaacacagaaatcctgatttctagatgtattcacattaagatttttttttcagaaaagtactgtaccattagcatagagacagaagccttaataacacaaaattatc

SEQ ID NO: 478243 - DNA, 521 bp, Homo sapiens
gagggctgccagcatgctgtcacctctcacaaggctgatgcagaaaaggactttgacaaaattcaacatccattcatgctaaaaactctcaataaactaggtattgacggatcatctctcaaaataataagagctatttatgacaaacccacagccaatatcatactgaatgggcaaaagctggaagaattccctttgaaaacaggcacaaaacaaggatgccctcaaggtctcaccactcctattcaacatacaattggaagttccggccagggcaatcaggcaagagaaacaagaataaaacttacaagggatgtgaaagacctcttcaaggacaactataaaccactggtcaaggaaataggagaggacacaaacaaatggaaaaacattccatgctcatggataggaagaatcaatatcgtgaaaatggccatactgcacaaactaatttacagattcaatgctatcctcatcaagctaccattgactttcttcacataattagaaaaaactacttt

SEQ ID NO: 478244 - DNA, 533 bp, Homo sapiens
tactatcagccatggtcaaccacaccatgttcttcgacgttgctgtcgacagtgagcccttggaccacgtctcctttgagctgtttgcagaaaagtttccaaagacagcagaaaacgttcgtgctctgagcactgaagagaaaggatttggttataagggtccctgctttcacagaattataccagcatttatgtgtcagggtggtgacttcacgcaccataatggcactggtggcaagtccatctacggggagaaatttgaagatgagaaatttatcctaaagcgtacaggtcctggcatcttgtccatggcaaattctggacccaacacaaactgttccgtttttcatctgcactgccaagacggggtggttggatggcaagcatgtagtctttggcaaggtgaaagaaggcatgaatattttggaggccatagagcaatttgggtccaggaatggcaagaccagcaagaagaccaccattgctgactgtggacagctctgtatcctagaatctttgtgcttccactgcaa

SEQ ID NO: 478245 - DNA, 1411 bp, Homo sapiens
tgttctagcagccatagggggcagggtcttctgcgaggggcggttaagtggcagggaagcgcagatcccgctgcacgccgcagcagcccgggtgtggagcgcgcagagggggcacctcggctgagtttcgggcacgctgcgcacccacgggaggatttcagggaggcggtggccaagtcggggagcgcatgccggggccgtactccctcctgggacagcgagccttccgaaagtccgagccccaagaaaagttgaccctgggtctgagagtaagagggaggagccgagagcatggactagagaggcacggagcctcccgggccctgaggctgccgcctccctccgcagcagccacctcctcccgccctttacaaagacaagctccttgctcccaggagtcggcctgcccatccctgaaatgtgcacgtgaaggaggtagccttggtagccagggaaggtgcggtgcccgtgccggggccgcggggcgtgcgggagtcctgggcgtcgccgcacctgccggtctcctctgggagtcctgggccgaatcctcagttcgggcgccctctggcgccgccgtggggaaatcatccggcgccaggcgccatgccgcacaacactgtggagcagccctgccggcggggtgggtgcctcctatctaaggcactggaccaggggctctgccagcaaacatggttcttccatcagcgtgtcggggttgcagaacctcagggcatggtttccctcggcaaggtgttagacgccaattatcttcccccgacagacttctgtgagacttcaaagggaagagaaaggaggatcccaagacttccaactccctcttcctccctccctacacacgcgcgcacgctgctaagacctgaggctttagctgtcaaccctgcttctgtttggggtcatttgctgacacttgccattaactccttcctgtacggctgccagagactcagaaaggtggaatcactcttgcctgtgcccaccacaccctctttggccatagaaattactcctccccaatcctccttagcttctgttcctccctgccttctcacaccagatagctttttccctgaatgtctttcttcttttactggatcaacacagtaccattacaccaaaaatatggaagacttaacaaccaaagttatactactgctttttatagggtgaataatttaattccatgttaattaaaaaatatatgtatatacctttatatagccatgcttagaacaaacactggaagcacatacatcaaatttagcagtggttatccagaggtggtaacagcatgtgtgatttatctcattttaggctttcatgtgttttacactgctgcctcttttatctccttctgctcttttaaagcaagcaaaggaggaaaatacacatc

SEQ ID NO: 478246 - DNA, 1409 bp, Homo sapiens
cgacgacaaaccatgtaagatgacaaaggagctggtgaccatgatcctgaccctggcagaggcatcacatgaagcaggctgtgccttggaaaaatggtgtggtcatactattaggctgaataatgaggatggaagcaaaagtccaggaggccatggaggagacagtggtccagataatttccatcatcagagcgttaggctttcaggcagaaaacagcctttcaaacaaagtcccaccttggctcatggcacatatagaataaagatgatttttcacttggacagttctcatattcggacacttcagtatttgaatagtcctctggtgcctactccacttctccagactgggagaagggagagtattatctcccttcattaccatctggccaggtgtcttcccatttgtaatcccctgattgggtagtgttcttcccctctgtgtgcatctagtgaactgagaagaatatattcagtgtcacccagctgtttattccattaaattctcagtgtttgccgtatattagctgaagaaaaatattaacatcctgtggctggattgtaagctattatagtatattggttacataaatgaagtgtacagtggaaagagattcaaactggtgatcataaagcatgaagaaaaacattttaactgtgtcattagtattgtaatttattcattgatgcttggtttgctgctgatatgttcgtaagtaactgcttggttcatacctgtctctactctgagaatatggtgatgagaagcttccagttgtctccagaaaagcatccttagcatcaatttgaaataaaggtgtattaggttaataaaggctaagctgctataacagaaactcccctagctccccgccaccaccaaatatagtggcttaaataagattgaattttatttctctttcacatacatagatagtgggcagttctgctccacaaaactgtcgagggacttagatttatttcatcttgctaatatgtcattcctaaaatgttgtctttatttaaatgatcaaaaatgacttattgctttgcctggttttaaactcttgagaaagagaaaaagacgaaaaacaaggcaaataattttctttctgacaagtaatgtggaaatcgttcacatctctgaagcttacatttcattggcaaaaaagtctttgccacatagctatacctaactgcaaagattgttaggaaatttagtctctagctgggaagctatgtctccaggaaaaaagtgaagataaatttgaaaagacaaatatacctcacacatccaatttgaaatcaattacaattaccattagctctataagaccgtataacataatggttaagagatctagttctggagacaaaaagcatgaagtccagtttgggctctaacactt

SEQ ID NO: 478247 - DNA, 975 bp, Homo sapiens
ccatcatagcgtcagggtccgggaagcaagcagggcggctcatggacgaggagagcagtttgggtgtgcaagacaaggtctggattcaagtcctgctcagtacttaccaggtgggtaaacttgaggtactttacttccttcttggaacctcttttttttttttaatcttttctgtagaacaaagctctgaaatcaaatgggagaaaacattgaaaatgttaaataaccgaatggaaattgccgcagtaattccaaccttcagcaaccaacactctgatcagtcagcaaccatccgcatcaaagcaagaccctccaccagcaaagattacaacttgcagaaggctcagatgatcattggcatttttaaacaattaagaaattttaaattaagaagtgccacgacaggccactctccaaaagctggagacctgtgggatcccgctggtagggtggctgtgtccaaatctgacggcctcaaaaccagggaagcggatggtgtaactctcagcctgaggctaacagcctcgagacctgcagggactgctgatcaaaagtaactttgtaactttactttgcaaagtaactttgtaactttactttgcaaagttactttgtaactttactttgcaaagttactttgtaactttactttgcaaagttactttgtaactttactttgcaaagttactttgtaactttactttgcaaagttactttgtaactttactttgcaaagttactttgtaactttgctttagcaaaagtaactttgtaactttggcaaaaatctttgtaactttctttgatggtgtcctcagcaggacagatggtctgataccaggtactccattgagctggaagcggaagttatcttcaggtcatatttctcaagtgaatgctatttcctggtgaattctgaagacccagtaagactagattttgaagataattgagtgctcacattgggatttatgc

SEQ ID NO: 478248 - DNA, 587 bp, Homo sapiens
agtgccaaggtttgaccagggtcaaacatgagtgcacagcttgtagatgcatttccatccagtgagggtgtggttcagtcctcagcacttcagctcttctcagtgttgacaggcatctcctatgcattttaccaaggggtagggccagaactcaaagtcaagtgccagtggccttggagatggggcccattcgaatccctgcccctcaaagcaaggtgtggcttgttatcaagtctgggtctggcttctctggactgtgacacagccccctgttttgaaactccatttttccacacggggttaatccaaagagcctgctgggagaagagaggcggccgcaagccctgccagcatgttacacgctgcttagcaaccggtgaaaacaagcaggaagggaaaatgagcctcaggctgccggggaggagtgaagaagggggagactttggtccctgcctaatctggttgggtttgtgccgcgatgggcatgcgctaatctgaatgctttccccttagtgttacctggtccctgtgctgaggagatgccaggaccaacaaggaagatagaaaatgaaaagacctcatgacct

SEQ ID NO: 478249 - DNA, 547 bp, Homo sapiens
ttgactgttttgtttgtttttgtttcttgtttttttttttgtttttgttttgttttgtcatgtttactacatcagcagccatgcttagcgatccctggggacttaggaaggggctggggagagagatgttcagctgcaagaccaccgaaggtaaccaactggaagctggagcagctgagcaaagtaagagcagctgggaaataactggaagtgcttatgaagatggtatgaggccttcaactgactggataaggtacagccacattatggatggtaatctgctttactcagagtcccatccaaaaaatacctgcgtagaaacacctgtgatgtttgaccaaagatccaggtctctatgcccttcccaaaccttcagaccttcagacctagcttggtgcttttccttgagcatcctagctcacatcctagtgagaccgctcctggggctgccgctgctggcacagatgggtggggctcatagcacatccctaaaccaggcgctgtgctaggtgtttccttgtggattctttcatttcttattacatct

SEQ ID NO: 478250 - DNA, 618 bp, Homo sapiens
tccctgacactcagggcgctttctgcgtctttccttagacctgttcaagagggaacccgaccattatgcagcaggggaattgtgtagtgaactgcggtgttcaagtgccaaggagcaatgttcagtcaattagccattatgatgatgatgatgatgatgatgatgatgatgatgatctgatgcttttaaaaattgtttgccttaaatgttccgtgttccataaagtgttcaaggagtttacaaaaatagcaaacaacataaaattaatagataatgaaactgagcccacctctgagtgggtggtcacagcctgctccctgctggcaagggatgctggggaaggagttcctacttctggctggaggaggtgggactcacaatgtgggaaattcctccagcatagggccacacggccaggaaaagggaaaggtggaagcggaacctggggccgcctggttctgagagcaggtgctgtattcgggcctcgcgtggaagtgagtgttagttctgtttccctcaccaccctctaatggtgcttggatgtgtatttcgatgctgttttgcgatagttcatgaattgggagaaagtataaaagcctttgagaatctgtcctttta

SEQ ID NO: 478251 - DNA, 517 bp, Homo sapiens
cctgaggaaaggcttttagggctatgggagacccaaatcagtggagccttatttgtctctgccgtcagggagctgagagagaagatccagaacactggtttgaggtttgggacaaaaggagcgctggaccaggtgacattccatgtcgggaagatcaaaggccatctgagggccagggatgcccagtgctcagtggagacaagcaaggagagaagaggcccaacactcacaagagagaggtggaccagcagggctgctccataagaggttctctgttacctgacaagggagtttcaggatcaagaggcctcttgggagacagccaagaggcaagtgtaaaaagagcagagatcagctcaagccaaggtcttgaggtgagcaccagcatggaaggctcaaggagtggaaagtctgggctggtcactaagggccttatgcatcgtgaggggatttgaatcctcaggattcaattcaaatggatgcagcaaagaatgacacaattaatgatacatctttt

SEQ ID NO: 478252 - DNA, 483 bp, Homo sapiens
gcacgtccaagtcgagtccctggttttaaaagtgcctgctcaacacgatgtggaagctgccaaagccagggcttccaccctctgaagccacagcccgagctctacattggcccctttcagccacggctgcagtggctgggacacagggtaccaagtccctaggctacacgcaacacggggaccctgggcccagcccacgaaaccactttttcctcctgggcctcctggcctgggatgggaggggctgccgtgaaggtctctgtcatgaccaggagacattttccccatggtcttggggattaacattaggctccttgctacttatgcaaatttctgcagcaggcttgaatttctcctcagaaaatggatttctactgcattgtcaggttgcaaattttctgaacttttatgctgtttcccttttaaaacagaatgcttttaacagcacccaagtcacattttgactgctttgctgcttagaaa

SEQ ID NO: 478253 - DNA, 614 bp, Homo sapiens
tcctcatgtaggtggttcatggaccacactttaagaaactctgggttgagccggcctccaggctcaccatgtcattcactatgtctacagggagccaagattcatcacaacgtgactggaatccccagtgtttagcacagtcctggccttctagaaacctttgtcgaatgaatgaatgcatgggtcatggggagatgaaaggcagtgttactctttctctggggggacatgggaaggctgcttcactctcagatcagtgcactctcattcatgtgttgagtggcaggtgctggaagtcagagcatctgaaatgcaagctcctgtgccccttccctggacctcaggtctccaacattggggcatgtgatgaccatccagaaagtgtcatcagccaattggaaagtcatgaagcagacacagccctagactattctagtgggaaggcaagaacatgtgctgtgtccccgcctgctttccaacctaaggtagaggctgtcccaggcacaagagcactttcaggtcactggtgtagcttttccaaggctgcctgcctctgcaccatctctgggaagattccgaaactgccccattccagtggggtggcctaggggcag

SEQ ID NO: 478254 - DNA, 634 bp, Homo sapiens
aaccgtggtttttctcctctcaccagtcctgtgttctccctcaagaacatgctacttgattggtctgagtggtggctgaaggcagatgttttggggagtacagcagatggagcttgggtccccaaatccttttcagtacaagatggagctagggatgggaagagaggtggggcaggtggagtgcagggggcttccagctgtactgttgccctggccaccactaatgttagaggcaggcctagtgccaggattcgatgccaatgcccacataccgaaggactgacagagctgaaggtggactgtgttctgagactctgcaggtcactctgggctcggagactacccattgcatacaagaggagaagcattgctacttcagtgacaaaggccaatgggattctgatctgcagaaggcccttctctgccttaggtgtaagtcaatgtaagggtggagctttcccatccctgcctcctgattgaccgcgttacactcaaactcaaaatgatctcccttatggaaagtgattccttcgcagtaggatgcaaaaaaaatgaaagcctctctgtagaaataaatcacagtgctggaacttatttcaatactttagcatccctgaaaaataccctagctttg

SEQ ID NO: 478255 - DNA, 591 bp, Homo sapiens
atatctgaggcggtctcagttaatttagaaagtttattttgccaaggttgagggtgcttacctgtgacgcagcctcgggaggtcttgatgacatgtgcccaaggtggtcagagcacagtttggttttatatattttagggacacgtgagacatcaatcgatatatgtaagatgaacattggttcggtctggaaaggcaggacaactcaagcaaggatgtcttccaggtcacaggattctgaactttatcttccatgtcagagatggcagcctgagaaggacttgcctgagaaggactcggccgacattgctggctttgaagatggagaaatgagactgagccaaggaatgcaggtggcctctggtgctgcaaaagacaaggaaatggattctcccacagaccctccagaaggaatgcagacctgccaacactatgattttagtccaaagtttaactatgatgtgacttggtgtgaatttcttcatgttaggggttcactccacttcctgaatctgtaggtttatgtcttttgccaaacttgagagacattttagtcatttatttgggtactttctcagcctgctctttctc

SEQ ID NO: 478256 - DNA, 939 bp, Homo sapiens
tcctcggagctcccacatcccagagagtctgagcccggcacaccagttctcacctctaggttcaggctcatccttgcagatcttcccaacattcctgggggctctctggggacagagaatgggcccttcattttcctctctcctcctctttctcacagaggagcccgaacataacaggagggaagtccgagtttcttccttctctttaggaaactctcctctcaggacccgcggggaggctggctggaaggaggacaccggggtagttgggggctgcccagaccagcagccccttctccaccagccccttcggctcgctgagctccagtcaggccgcaggggtcctgcgtccatctccagcgtcagctcaggcaggcagcaccgtcggcccagccagggctcttggctgcagttagactgccacctggtggccaggatgatcattgcgcttctcagcctagctcgttgcttcccatccagtgtccctgttgtggaagctggagtcctgagagaggaagagcttgccagtcaaaggatctgcccaggaatctgcatcgtaggcccagtctgcgaatccctgtcatgggagagacaagagaagtgataggaatttgaggctccagttgaaactaaaagggagcaagtggtgaacctgcagccattgtgaaacctgtaggcgagggatggacagttcacagagtgagctgcttctgccactgccaatatcatacactcactgctgacactaatggctaactaaccaccaactaacattaactaacgctaaccactcactgctaaccagccactaacactaatcactaatgaaccaccaacactaactagccactaactactcactgctaactaaccagtaacactaaccactaaataacattaactaacactaacagctagctgctaaactaactggtaact

SEQ ID NO: 478257 - DNA, 1348 bp, Homo sapiens
gtggccttccctgctctcccacagggtgctgctaaggacctcctgagcttctctctacccttgtctatacagagggctcctgacacttcttctctgctctacacagcacactggggcccaagacaaggctgggggtagcaggagagaaagccagagctgtgtgagattagaggaggaagagcaggccagggaggaggctttctgcgggcgagggcatggctgggaggaactgaactaggagtgtgattattcagacacagaacctttgaagaggtaatcacgttaaaacgagttcactggggtgggctctaatccaacatgacggatacttgcttttactgtgtgatattcaggaacccagcccttcttcctgatgttacttctatagtgaaaatatggaactgcaacgaggcatccactgtgcatgtacaaggcagctcttataggtatggtcatctggagcatcctgagggcagagaagtggcaaatgttccaagctcagtgttactctcctgtaatgcgatccattgggtgactcaccatcatgggccctttgcattgtctttgtgggacttgggtgatgtcggagaaccgaagcaatcctatgcagctctggctagtgcttttgctgggatgctgaagaaggtgactaaggtggtttccaagaccctggcctggaatattcccactgcccttctctgtgagttattctcctctacggctcctgcatcttcagaacaaacaacagcagagcacgtgactgctggaaacgcccagatggctccagtcacaggatccctgcatgtccgggccagaatggccagcacagctgtccccttccctgttctcagtttttgattgaggacaagcactgtcgaggccattacacattatgactatgcattcttttttatacagccctcctttgttctggagttaataacccctttttaactcgcctgatgtctacttaaatgtcactcccccaggaagccttctgcaactctgcagccctccccacctcaccaaaattgcatgggtgccccttctgcccatccttcttcatactgcaacatcctcccctggtcttgtcctgtcttcccatcacgctgcaagctctgtgaaagcaggctcctgactgccctgcccagggtgtgtgaacctgcccaccctgcctccagaggctggcctaggccagaggactagaccaccacaggcctgagtgtgtcctcattcctgccctctcccaggacttagaactttctctttccaggagtgcaggagtactcagactgaacctgaattttatgctgcagctcagacctctgatttcatggatcgcttatga

SEQ ID NO: 478258 - DNA, 772 bp, Homo sapiens
gtccagtttcaggattagggaaaacttgccttgaaggtcagtttacaataggcttgagctcctgtgagaatcaaatgcaactgctgatctgacaagaagcggagctcaggcggtaatgcttgctcatctgccactccctcctgctgcgcagcccaggtcctctggtctaaaggaaggcagccaatacctctttccacattacaacagaccaaatgtttgcggccccctccccacccaaattcgtatgttgaaacttaaccgccgttggatggtattaggaggtggggcctttgggaggcaattagatcatgagggtggagacctcattaatagaatcagtgccattataagagagatccgaaagagctcccttcctccttcttgccatgaagtagatgcttgtacctacatatctcatcacctcaacgcagcagttgcaagtgcagactcttgccgatgtgccagtgactcaaagaccactgttgtcactgacatgattacccagaaataccaacacatcttaggaaagtttttgacaagagagagtttaatccttcctcgattggcaaagcagacattggaaagttgtgcaggatatgggacagttctttctagtgtgacctgccctgaatactgcaggacatccactatccctgaccctgccggataatgcaagtaacaccccagctccaactgtcatgatgatgaaaaatgcccccagtattgccaaagtggcccttagaagctggtttttcccttcttgaagagcacc

SEQ ID NO: 478259 - DNA, 520 bp, Homo sapiens
cccctcacactgttacttcaaaaactgaattcttgatgtttagatgtgtctggagtttgtttcttctggcgggttcgtggtctcgctgccttcaggagtaaagctgcagaccttcccagtgagccttacagctcataaaagtggcgcagatccaaaaagcgagctgcagcaacaattattgcaaggaacaaaaaaacaaagcttccacgctgtggaagggcatccgagcaggttgcagccgctggcttgggtggcctgcagatgccatttgggagccaaggcctggaatcagggaccacaagagcctgcttggtgttctaccccactgtggccaagctggtacctaagaacttcacataaggcccttgacatagtacctggatattgctgctggttcttcaatgcccaagggctctttagtcagcagatgatgaatcatccaggactgagcccttcccttcaaggcaacggattcccttctggccttgggtgtatctagaaatgttgtctgggtgctagg

SEQ ID NO: 478260 - DNA, 736 bp, Homo sapiens
agtgggtgcagcgcaccagcatgtcacatgtatacatataaatgggtgtcgtcaacttccaagtctatttcagcgaatcctggtttgcgtgctgaagtcaaaatgtggtgctgtttggcccagagtttcctagcccctcccatttctcctttcgcaatcctggcgctcctggctgagatgagactccagcgtggacgcaatttttctgaacgatataagataggaccaggacaaatggacttaggcgttgtaaacatttggatttctaatattaaaataaagtacacagaagcttcaaaagaagcagaaaaccaatgtggaagaaaagaacaagaaccagaacataatgggtgcaaaggtaagataaatgcaggacagacaaaaggaaccattgtttatgaaatccagagtctgtcttctacattcccgcgttacatttctaaagcagtggttctcaacgtgcagtccctgagccaacagcatatgcttctgcctgaacgctggttagaatgcttattctctaaccccacgctagacccacttaatcagaaacatctgcagaacttttccagaatccgcaagtgttgctggcacgagcttcattgtcagtaggtaatgtgaaaattgaatttgttgttggtgataaagttcacgtgtgctttctttggggggacattgatttgggattatagtttactgtaacctggtaatttcagtaatgcaaatgcaacaaaac

SEQ ID NO: 478261 - DNA, 578 bp, Homo sapiens
gctattttttttttttctcatagaaggcgactaacaatgcttaagcactgccctgcactgattttgagcccatccatgcccctaagtccacaactgcagctcagatctctcttcaacttcagacatagacagctgccattcaaccgcctagtacataactcagtcaggactttccacaagagacttagtctcgacaagttcaaaactgagggtctcatcgctgtcccaccccagcctgcccgatcgaggtcacacaggactttccacaagggacttagtctcaacaagttcaaaactgagggtctcatcaccgtcccaccccgacctgcccgatctaggtcacacatgtgtgtgttcttctccctctcctctcttcctcagtttccagattcaggcagtgcatactctcgcttctctctattaatcacccctgaagcctctcctctcctttctaactcactgccatctttcactggagctatttcctaattggttccctggttcaggttgcagctttgactttgctaccatagcacagcaatccttctaaaatgcaaatctgctgatgcattcctctg

SEQ ID NO: 478262 - DNA, 676 bp, Homo sapiens
cagcgtgggccatgaggcatggagtattcacaattggtgagaaaattcatgtgccaggaacacagctacagggaaaacaaagggccgtggaggcacatggctatgatattgtagaagctgagggccccgacaccaatcccaggtcgatttcccctataccacgtggccggctccaagttcatgacctaaaaccatgtgtggatttaaacagctgctcttctatcccagtggttatttcttgggacaaacccactgatgttgagcgtggggcagaggaggtgtggaaagggagaggacgagtccagagatgcaagacttggcagggcttggtaacggagtggctggaggaagaaagggagcagctgagaatgcccaggggacctggggacctgaggcagaaatgtgaagaacatggagattcaaatcacatgatttctctttactagcttgtaaactgttcatgcactagtcatgtcttggccactttattcctcatatacaatgatcattgaggtgacttgaggtccaagctctgagagtgtttaaatctgctgcccacaaataaatgaccattttagagatgctcctaggaggccttgcagtgtgctcttcagggtcagttggccaccaaattgtcaggttggcagaggttgtccttagggtctccaaactatcc

SEQ ID NO: 478263 - DNA, 2945 bp, Homo sapiens
ctcggtctcgctgacttcaagaatgaagccacagaccctcgtgttaagtgtcacagttcttaaaaatggaataagcagcaacaagatttattgcaaagagcgaaagaaaccaccattcccagagaacaaagcaaacctagcagatttcaggttttggttcgggtggcctgcttttattcccttatgtggccccacccacatcctcctgattggtccattttgcagagagctgattggtccattttacagagagctgattggtccattttacacagcgctgattagtccattttacagagagctgattggtctgttttggcagagtgctgattggtgcgtttacaaacctttagctagacggaaaagttctccaagtccccatcctcccagaaacccagccggcttcacctctcaccaacagtggctgcgggactttccagcacctagcctgggcattcccacagcccagagggagctcgtcccagacaaccaagaggaaaagaagggaaacaagaaagagatggagacccatcattgtggccaacgaccccacgaagagggaatagcggtccacgcacgggacccagcctccgatcaagcccagcaggcgccgggtgcgcctgtgctgggaggcagagcccacgcccacccggaaccgcgccggccagcgaggtccgtgcgcagccccggctgccgcctgcgcttctccctccacacctcaccgttagcagagggagccggctccggcctcagccagccccagagacaggcccccacagcacagcggcgggctgaagggctcctcgagcgtggccagagcagacgccgaggctaaggagtgtcgatgctgttattagcattcatgctcacaagataaaggcactgctgaagagttatgtgtttccttgaaagacccaaaacctatgtgaagctaaataactaaaatttcagtgagtttttaaaggttattttgtttaatgttatgaattctagtataccaaacaattctccaaaggttaggaacataattcagtctgcattattctgtcttgtgttattactgaaatttttataatttgctaccagcagatattcctaaagttaactggctaaaatattgactgttaatatagatataactattttttcccttaatttttaactaattgaaatgtcttcatttttgttttttaacataaaattgacagccatcataattattgatttttgtagtaatttaaaattgcaacaataaatgtatatatttatacctgacagaatttgaatatataaagcacgtaagaaaattgtgctgccagttgcatctagaacgctcacctattcttgaaagaaaatatttacatttgtaataaatctgaatggtttgccttttgcaaacagattagaaatgatttacatgtcatgtgatcagtgattatgcattaagtttagggatcctagaaatgctactgaattacagtcttttgacaagtttacacttcattctcaggaaaggctgatcatggaaaacaggagattttgccttcaggaaaaaaaatgaatatgcttatggaaggaaacatgtgactaaatatgtgggaaatagtgactgagtggcggctgagtaaacagggtagcatccttttagctggttgtgctttgactaactgatctgttctttcttacttgtagaagattccaagcaagaaagtattcagcagtggctggactctggattctttgtctctgcaaatgaaaactttcaacaagtcattgaccgcactggtaagacaagagaagcagttatgctttgggaagctgagtaggagatatattcaaatatctacgtgaataaatcttcttaaaatgagcattatcagaggcttctagaaatgatcagccctcaaaaactatccagctcaatctcttcatttgacatatgactgcgacaaaaatgataggtgcttccccagcagcaggttaagggccgaacccagggctcttgccatatcatcaatggctcagagtatagcataaactcactgggttctatgaagacatttgcaaggatgtagttatgaaaatgaaattgtttaattttccccatcctgtattatacttttatttctgaatctagattttttctattctttggtctcaaaattgcacttacattctctctttctaataatgcacttgttctcaagaagaataaatgtctgaattctaaagcaaacagtacaagtatttctgaaggagaaaatgtatcacacttgtttcactgagatttgataaaagcagtataaaaagaaaaagaaatttaattacaggactcacagtttccatcttcattaaatgcaatatcatattttatagaatctaagacccttcaattataaaatgcattcatattttaagtaccatttagaaaaaaaaaacaaaacctggcaattacaaacagaaggcaatattgactgtaatacgtatcttgatttcacaggtgttaaaatgtgaaaaagtatgtttcaaaatggatgaaatattgtgaagaatttgtgtgaaaaaatgacataaattaggaacttaatggttagatgaaaaaattattagtctaatagtcacttactttgctggttttaattatttcacttcctctactgccatcttacattaagactgaccgttggctacaaatcagtttaaattttgaatttttttactacttttaaaagaaaacctatatgtatcattgaaatttcccttttcaccaaccttctttattttttctaatataaaagttccatgatgccaaatactgtaaagatttttgccaataaatcaaatgtaagtacctctctgctcataataattcagactcaaggaaaagcaaaaacttcagaaaaatagccagcatttcatatccccctaatgttttctcttgcccc

SEQ ID NO: 478264 - DNA, 1250 bp, Homo sapiens
attgggtattgacttggtagttttcaaactctggctcctgaaggtgcctcacgggcaactctcgctttgttgaagaggaaaatgagagccaggttctgtgaccaactcgtgcttccaggctttattacaacagtgactctcattcctgaatggctggaattttgggagatagatccagtggagattctcttggatctggggtttggtgctgatgagccagacatctgcatgcaaatcccagccagattccttggttgtggctcagcagccagaggaatcaacatccgtgtttttcttgaagctcaaaagcagcgaatggacattgagaaccccaacttgtacggtcgtttccgacagctggaaatcctggaccatgtgaccaatgccttctcatctctgctgagtgatgtcagcatcctgccaaacagagctgaagagaaagctggaggagagagtgtgcaaagaacctcagtgagtgccgccaaagagcatcgaagaagaatgggtaaactcttaaggagagcttccaaacagaacatcaggcgggattgtaacccagaggtatcagagtccttcaaggtgaaggatgaagtttttgttccctttacaaaaccatgggattgtggagcagagctagcagcaacctcaatcaaccacaagcaaaatcatttgtctctgtcagtagaacatcagtctctccaagcctgtgatgatttgctaccttatcctcctcatggtcttctgagcaagcagtggccttgctcatctatgccggccaagcaggctcctccttcctgtgtgtctgaggggtcagtcaagggcagaactcagaaggagaacttatttcagactaacaagctcaagagcttgtctcatcttgcaggcaaaggaccagactcatttgaaatggaagaggtcagtgctgcaccaacgtaccagcctcctaagggaaataaccttcactatgacacccttgttttccagccctcatttcaccacttcatcttttaatccctcagcattacttcttagtgttctgagtcagtttagtgatttaaagtcattctagttgcttttgttggaaataagctagtaggaaaccagcctctgcttgctccagtatctttcctttcttcttgctcgcagttgaatccgtgggtcatttctgactttgctttggctcaattgttttatgtacctgtatgtatgctttttatctattctctaacttttcatgttttatcttcttc

SEQ ID NO: 478265 - DNA, 762 bp, Homo sapiens
agcatcgtctaaagctgatgccagcactggggcacaggagaggactgggtgacagcagcggaaaggtgggcagggatagggagtacctgctggtacaagacctggaacgagagtgcgtctttgcatgtgcttggctgttctcatgggcgttcatctccccactgactctacaatcaatcagccctttgtatttgtgggtactacagccttgtgttcactcaactatggattgagaatatttggggaaaaaaaatccacaaaaaaatttgcacacagcaatgcactgttgaatccacgtgaatgtgtaggcattgtattagctggtaccaccacaagaagagaacaaatgaatggcagaaaagattggaagaaggaagagctttcccagggaatgtctcaggaaaatgaagtactaaagcccctcctcccgcacctcgcatctgggctgtgcggggccgcacaaccagcgggaatatctgagtgggtgtgggagcatctgcgtgcaggcgtcctctgggaagcaatccatctgggttgatacaccctcctcatcagtatttcctcctccaatggggcgagtcctgctgtgtaacatcccactttatcagggtcagaactggaggaggtgctggagcactaggaaagaatatgggccacattggctgacggcaagagattagcctgggggaaggttggcaccagacccgggtgctagtgaaaaggaacttctggaaatattctgcctgctgattgaaaactgcc

SEQ ID NO: 478266 - DNA, 950 bp, Homo sapiens
tcctatattgtcaccagagctgcatcttcctgaaacccacgaccacttgacagggaggtaacatgaactacaaggcagctgcagcctgcgtcaccctgaagagagcatccattgctcaactcccaacatggccactgcctgaagatctcattaccactgctgcccacagtgctggcaagtcaatactcagagatctggaaggactagaagatcctgctaaggaggctgtacagggcgagtcagtgaggaatccagagattacagtgcctcggaaaccaggtgaagaaggaaagagtggatctttgtatgtgttgttctctctgcctggaacacaaccccatcctccaccccccatccccactccaccccttgcttgcctaactactattcttccttcaggtctcaacttacaagtcacatcctcagaggagaggcctcatttatacatcaacgtagccattgtttactgggcacctattatggaggcgatagaccctgtgtactcttcaacagagaccacctcggagctccctctcaattgccgatgagcttttaatccagtgcaggtgaccttgaggtgcctcagactcctgctccctgctttgggccactttatgtaggtttaccttttccacagaggtatggcagcacttccattcatttgtccagttttctagttcagaaagtttgcgggagtatttttcctgataataatgctaacaagttatcacttaaattttttgaaaaattaataagagaaaaataatggtcatctatacttctactacccaggaaaaatgagcatatcctcttcaaggctttgttatttctttttccctttatttttagtgttggtcaaagggctcaggagaggacttggttgaaactagtgtatacagaagggaatgtggggttttctaattattcaagcttgcattgtcctttatgcc

SEQ ID NO: 478267 - DNA, 1254 bp, Homo sapiens
gtcaaagccagttcccggcccagtctcgtcctgcagcagcctgccgcctgcctcctctttcctttcaacatgacagatgccgctgtgtccttcaccaaggacttcctggcaggtggagtggcagcagccatctccaagatgggggtagcgcccatcgagagggtcaagctgctgctggaggtacagcatgccagcaagcagatcaccgcagatatgcaatacaagggcattatagactgcgtggtccatattctcaaggagcagggagtcctgtccttctggcaccgtaacctggtcaatgtcctcagatacttccccacccaggctctcaacttggccttcaaagataaacacaagcagatcttcctgggtggtgtggacaagaggacccagtttgggagctactttgcagggaatccggcatcaggtggtgccgctggggccacatccttgtgttttgtgtaccctcttgattttgcccatacctgtctagcagctgacgtgggcctcggtaactgcctggttaagatctacgaaactgatgggattaagggcctgtaccaaggctttaacgtgtctgtgcagggtattatcatctaccgagctgcctactttggtatctatgacactgcaaagggaatgcttccggatcccaggaacactcacatcatcatcagctggatgatcactcagactgtcactgccattgctgggttgacttcccatccatttgacaccgttcgatgccgcatgatgatgcagtcagggcgcaaaggaattgacgtcatgtacacaggcacgcttgactgctggaggaagattgttggtgatgaaggaggcaaagattttttcaagggtgcatggtccagtgttctcagaggcatggatggtgcttttgtgcttgtcttgtatggtgaaatcaagaagtacacataagttatttcctgggatttcccccactgtgaacagtcatgttgtattatataacatatcttgagcattcttgacagactcctggctgtcaatttatcagtagcaactatttactggttgaaaataggaagcaagccagcttctcttgccattttttgtactgtctctaaacagtactggcatataatgggcactcaacatacatgacataagaggccatagctcagtgagtttcaaatgaacccatatgttaaataagtcaagggctgcatttaaatcagacgctagaagtgtctcacccttacactgtccactttcaac

SEQ ID NO: 478268 - DNA, 3011 bp, Homo sapiens
cagtgaagcgcgtgaagggcgagcggtgatgggttctgcgccagtggggctgggagcgtgtggggggctgtacgtgcagctgccgcaaggtggagagtgcacgtgtgggcttggggactacgcgcaccgggggctgaaggcgttggggagggtgtggggggctgtgcgtggggctgccctcactggaagctgcacgctcagggaagctcggaggcgggggtcctgcgagtgctggggagcacgtggggggacacgcagggactgcccgcgcaaatggcttcgaacgcatgctccccaccccacatttcacagtcgccatgacgaccaggaggtccgcaagggctgcggggacaaccgctacaatcttcccgccctggagccagaggtggaaaagtcggccctatgcggcgggaacctgccaaggggcgccccaaggtgctccacgcggaggatccgaaatctgaaagcacaaaaaggcttggagctacagttgggggccaagacccttcttctcggccccttccaggcagttagtagtataggaaaaggtctggataagcatggttgagaatttcaacattgcaattttttaattttaaaaaatttaatttcttcaacaattattaaattaatttgcatttattttgttagccaagaggagtaatttttgaatttttaagaggctattattggtggtttataagacgacttgccaagtatatttgggataaccataagaaataccattataaaatctcagaagggaggtaggacttctggaatagccaaggaaatgcactcctccatgatgacaatgaaaatacttggaaaattatcaaaatcattttcttcaaaactttggaagttaaccaaaggtttacaacaatctaaagggcattaattcaagaaaagctgctgaacctctataagaacagcaaagtctgtggtgttttaacttgttctattccccacttttctctctccagctccatggtacccttgaaaacaagcaattccccaacgaaacaggggcacaggctgcgtttgcagctctggtaaaagctccatacccagagcagtgtctcccagctccctggtgaagtcttacgtatacatggggtgctggcacaggtgcctccagataagtctcctaggccatctagtagttcctaagtctgggcgcttgcaaagagcttgcaattcatcaagggttgagttgcacaatggggcttttagatgtgctgctgaggaagtgattgcctgcatttaatcgtcttctgatgaatgctagagaaactgatctagagtggcacctcttggttagaacgagctgaagcatactgtatatatttacttctttaaaaaatttcatataaaggaatagaatactaaaaagaaaaaaaaacaaaaaaggtcacaatattccataattccatcactcctaccaattaactgaagtaaaaaaaccctctcaagtctctccctttgcttgtcaagccctgctgcagagaggtaagctctgttcagaatttactttgtgtcctggattttttcctatgctcatagagacaggattagctggccatcttgctttctgtgctatcttttctagacatgtaaaataatacatttgaaatacttgttttaatggtattttataataaagcagcttttaataacttttctcttttccagccgtctttgtggcaattttacattggtaagatttagtttcagttcgaaatatttaaaaacatttgaattaaaaattgccatcactctttgcatacagtaaaacaataacttctggctatatttgtagaacatctttatgtacgccattttatacatatattttgcttttttacaaacctcatatgtgaaacagcatttacaaaatagatgcattgggggaatataaagtgtttgagattatttttctgttacttcattatctctcaccctttcctaatgcagacttctttttaagataatgaagatgaattatagtagctgaggaaggaggacaaagaaagcactgaagaagtgataaaggggaatgaaatgagatgttatcagaaattgctttttctttggctacagttgggaggtcccatgttttactgggtcttttactgatgatgattattatttggttctcttttgatttcaagataatctcttttaagagatgacttttgatataatttttaaatatttttctgtttttcgatacttaatctttaaaatggagttttctgccatacacatctcacataattattgtgaggagtaaatgggatagcgaataccaaaattgtgcaattttacatttagaagacaccacaaccgtccatcttccagatctgctcccagctggtcgggggcctactgaagcattgaagctgactctcctcactctagccattgctttttgtttaaattatggtgaaatttagatttaagtttgtaatagaaaaatgtcaatggttatcatttaagcgtacaattcagtgacattaagtacattcgtgttgtcttgcaactattaccactgtccacatccagaactttttgctatcccaaacagaaactccacccactaaacactaatcacactcagctctattttctatctctatgattttgcctatgccaggcccctccgtcactgctttttaattttcatccctatattgcccctataaagtttcaaagcattggatacattaacatatgtatgacatttgaacattttaaagagaatatttaatatttccctaaatatagacttttgcatattagatatcctttaattattgtattgctttatcctcctaagcagaaaggaaaattctttatgaactcatattttgccaatcaactatgaggtaatggcctttcagacatcagctaaaacagacgtttaatttagtagttactcgtgttggatgaggcagatatgattatagcatatagcattttttagggagaatgcattttaaacaatg

SEQ ID NO: 478269 - DNA, 705 bp, Homo sapiens
tatgtgaacagcagtgagatcctccagactgcagaagatctagggaggtcagaatagagcagggctcccacatctttgataaaatgtgattttgtaaactagaagaaagggggaaatggcaaaagcaggcctttctctaaaaggtctaataaacgggatgatgccggggtactttccaggcctccctcatgccatctctatctctacgattacatcacaagccccagaacaccctggctctacacgcaaggcaggccacacactggactgcttgcatagacctagagcagttcagtggctcactacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcagagagagaatctggagcagcccagggaggatgctgagataaaaagttttagtgcatacacaagtgtgctcttaccgcccaggaaagttaggaatgcacaggcccaggctccctgtgtgtccctgtgccgcctgatcatcctttgactccaggagggcaacac

SEQ ID NO: 478270 - DNA, 453 bp, Homo sapiens
cgcccccctttgttcagtccaccaggtaagacccatgggctctttccagcaggaagaagagatcagaggctctactggaggagatcatcaaatatcaagatattctgagaatgaccagggcattgctctagagacccacttatgcctcacctcatatcacacactggggaaattggcatggctagaccacctgggaacaatcaggaataacagaaagaggcaggggctctcagcagccagtgcatacagatctcagaggcagtcccacagcccctgtgagcagccttgcctgactgtggccctaaccaacaactccatcaaaccaaagagtcaagtcggctggctccacccaactatagagctcagagagcaggctcacataaccttagagcccaggcaaccagccccacccacctgtgaagccctaccagacaaccatgctcaaaagtaaaa

SEQ ID NO: 478271 - DNA, 780 bp, Homo sapiens
aatttcaggatgtatttgaactcattcctgtcaagtgtcagagatattccattagtcagcatatccttttctactggtattctatccaagctcaccatcagtgaaagttttaacaattgtactatcatagcatggcaggagctatccatactacaactactatcctcattgccagcttgccaggaaaaggggctcctccctaacttactctatgaagccagcatcgacctgataccaaaatctggcagagacacaatgaaaaaaagaaaacttcaggctaatatccctgatgaacatagatgcaaaaatcttcaacaaaatattggtaaactgaatccatcagcacataaaaaagtaaggggccctcaccagattccgaatttgctggcacctggatcttggatttctcagcttccagagctatgaggaatacatttctgttgcatataagccacccaaaccaataataagcaagagaactgccatttgggaagtgtaggttaaaaccacaatgagatacactaggtatttattagaatgtttacaactgaaaagtttgaccaaccaagtattggagagagtgtgaaggaagtggaacacatgtatattgctgggagggaatgtaaaatagtacaaccactttgcaaaacagtttgtcggtttcttcaaaatattatacctacacctactgtaagatttaataattccactcttcggtattcagtccaagagaagtgaaagcttatgtctatacaaatacttgtatatgaatgttcaaag

SEQ ID NO: 478272 - DNA, 773 bp, Homo sapiens
agaaactattagttgagctctgaaatacatgaatacattccttgcaatcacgggtgaaatgatggagggagtgagtgatgcagagataaggctaagaagagctggcaggcaggaatgtttaagtcagctgaagctgtgcccacagccaccccttcccccaggtcctctgtcccaggcagatggcagttttatctataagctcctgactggggctgctgcctttttttcagagatgccctgcccagagaggaggaatctagagaggctgtctggctacagtggggccctggtggtgtcagcacccaagggaatctcctggtctgtgggttatgaagaccatgggaaaagtgtagtatctgggccggatagctccatccctcacggcacagtccctcacggcttcccctggctaggggagggagttcccctaccccttgtgcttcccaggctcattgcaaatcttaaatgatccattttatacaaaaatgtgtaacgtgtattcttttattcaacaaatacttacagattgccaatatctgccttttactctgtgccaaaaaagaaagttattgatcttataattttatcttcaaatttcacaatttttctcctggcttcaattacctggaaatattattattaccaggaaagagtatgtaatatcatatgacatactgatatggtccatgcatgttattcaatgatgaaatatcttcattatcttcgtgatacaccctttttttcctttgtggttgaactgttctctccatatg

SEQ ID NO: 478273 - DNA, 672 bp, Homo sapiens
gcctatacccaggaatgaacaaggacagcttggaggttagaaggaagatggagaagcttacggtcatagaaaccaaaagctggagagctgcgattaccaaattagaaggatcttcaatggaatgggaaattcttcacacagtaacaactggtatgatactctctcacaatgctggacagtgtcagaaagctgaagttcccagtcagccacaccattctgatggtttcaatattctctatttttccttaatttttgaaaatttgatttctggtgagatccatccacttgatcaaaacatggtggagaaagctaaaggagaagcagacatgtgcaaagcggcaaaacctaatgggcatcctgctttgagtatagaaaacccagaggaaaaactggcaattaaaaatcccaacaagagaatgctggataacaacacttttttctctataaaccactttattttaaatttgtgaatagtactgacctacactaagcttcgtagagttttttaaatacttgtctttttaaaaatagaaagtcaccaatgcttcaattaattgtaaaattccgaggtgcttcaaattttctagtgaaagttaaaagtgtaaacatattttcaaaatttacctgttttttccctgtaaaataagtgatgccttggcagagaatatgcat

SEQ ID NO: 478274 - DNA, 691 bp, Homo sapiens
caataacaagaaggaacgattaggatgacattttgcacaggaagctgtttccaattccttattcatgtaagactgcgcaagaacagaaaggaaatttttttgcctgtgaatgagcaatacttgcacaatgcctatttagcatacttctgcagattgtggttgaccatggctttggggaagacattaactgatatgcttaaagcctctgaacaacttgtacccatcctggctttcaaggaccctcccatgagagagtaccaccctataaactggaggaaggaatgtgaatgtcatgaagcttccataaaaacccaagaggacagggttcagggagcttcaggagctgatcacgtggaggttcctagagggtggcacagccagggagggcatgaaagctccgtgcccctttcccaataccttgccctatgcatctcttcatctgtatcaattgcagtaacctttttaataaactggtgcgcttaaccttcagatttatattaactgcgaaggtcctgttgaagaacaaaagtctactatgaaatttaagaaactactgggccatgaaacaatacactatttaacttacttcatttgcccaactctttatcactcttacgaagtatccataaggttccctaagttttgcctgtgggccaacttcacaatgagctgcaggtacaaattaaaatgc

SEQ ID NO: 478275 - DNA, 3146 bp, Homo sapiens
aaggactgttatgctgcaggagctatgggtagcccctggcactggggcaggtctggaggtcattccacaggtacttgcctggaatcaggggtcatgggagtctgcctgatgatgggcttttctgtggcaggcctggttttagggtccaagaaaaagtcctctgcttacttgcctctccttcccccaagcagacagcatatctctaagtgtggtgctacctgtggagaagtcaagccagctgcagaaatttgcataagtaacgagaagctgaatgttaatcaccaaaacaatgggaaaatgtctccagggaatgtcagagatcttgatggcagtccttcccatcagaggcccagaggcctaggacagaaaaatgttttcatggtccaggcccaaggccctgctactctgtgtagccttgggacttggtgccctgtgtgccacctgctccagctccagccatggctaaaaggggctaagcttgcaccatgcactggaaaagctgccaacactcaatgccagcccgtgaaagcagccacagaggctgtaccctgcagagccacagaagtggagctgcccaaggctgtgggagcccaccccttccatcagtgtgccttggatactcctgtctctccttatattgtgggccagttggtggctctgcaaacttaggtctcgttgggtttgaaaaaaaattacgaatctgaagtttatctcattcctttttgctagagtcagtttttaaacactaaccagcataccctacatgataaatcataggaatatgggtaagaatctcagatgaaagctaggaaattataggtaaaaatatgaaaacagttaggaattaatattttttgtgtgtacaaatggctatcaacactgaatataaaaccaggaaaatatccagaaagtgaatatacatggagtaaaaaacagacaacgctgatcttgcaaaatttttattctttgggaaaattaggcacaaggatgaatgaatgaatgtatatcaacagtgggatggggcagggtgcagtaaaaaagcaagcaatagtagatataggacattttctattccagtaatttattcaataaaatgattctaaaatttatccagggtagttcaaagcgtcattttcactttatggcatgaggttaagcataagattgagaatattttgttttagattacgtatcaagtctaaatttttaaaaatctacttgcaaatattatgaacaaactctctggctgtctttcatacttcactgagaaattggaggtgaatttcaaactctttccacctttaatcatacatatggatgaccttgtttttaacaataatattttcaacattattatcaatcaagactttttattttcaaagactcttgctctaatcttgtaaagttataagagtttaatcaacacagtcaggacttctagatttattttcccataactgaagccagatataaagggctcttgaatttgttcactgaaatactatttttcctcaaagtgaaaattgtgctctttatgagaaagttaatatggaaaagcacatttatgtgatcataaattgaattcgaaagaatgtataaaattaaactctcacttttctcctgtaccaatgaagatttaatacagctccactgaataaaaaccaaggtttccaatttacataattgccgattttgatgttacccaatgattataaatacctcttgggtaaattgtgtagctctcctttttttctgcacttctcaatgaatggtctgtctggaaaatagccaataaattgctgtcaataacattttgaaaatggaatattttcaaatatcacataattgaaattcaaagtgttttcatttaattatattgttattcatattggtattaatggctataaattagcaatgatatgaatactagaaaaataattagatataatggttgtttacaaagaaaggtacaacttctttgcttcttcatgtcaaaatgtcattatagtatggagtataaggtctcctttagaacatattcaactagagaccaaaagtttaagaaggtttttatggaaaaacaattttccagtggatatgtaatcatgtaatcaggtgatccttttaccactgctatgtaaggcataggatacaattgtaatatatatgtgtatttattttacaattgtattatatatgtgtatctatattacaatcatatcattgtgtgtgtatatgtatctatacacatatttttacatataattttcttaccaataacatagtcatacatatgctcctatcagatattgtttttcagcagccttggcaagcaatagttcattttatttaaaactatctgtgttttgttattgctgttcctctgctgaagctgtctttattgaggtaatatctacatttatctctttctatatgtttctcaatacatttatacaattattttgttttcctgatgtatttgctataaaacgtttagtggcagttgtaataatagtaacaatatttccttgagttgtcttcattttgtccaacctccaaaagttgtctttaaaaatggcagtttattaccttccaactgcaagttcagacacatttctattataagttttaatattcaggtcttattttaatagaactctcaatgtatgtgaaggatagtttccaaagactatataaggaggattatcactgcttttgtcacctctacattatcctcattaattttccccaagaattactttttttcattgttatacaatatttatcttacttatatcctttcacaaaagtaattcgactcagtaacagtgatctgtatataaagcatattcagtccaacaaaatatggaggaaataatttgttaaagtgtttgtatttggcttgagctgttgaaacctgtgattgtgcctcattccctctatgaagtaactttgaaaaccaaaaacttaaagaaactagatctactcctcttcattttcccatatttattttttcttttaattgaattgccttctttgtgttgctcttcttattttccagtaattctcttaaagtctgagacagagtcttgtttgaaggtttttttcaagtgtttaaaactttgatagaaaaggtttgtgtggac

SEQ ID NO: 478276 - DNA, 744 bp, Homo sapiens
aaggactgttatgctgcaggagctatgggtagcccctggcactggggcaggtctggaggtcattccacaggtacttgcctggaatcaggggtcatgggagtctgcctgatgatgggcttttctgtggcaggcctggttttagggtccaagaaaaagtcctctgcttacttgcctctccttcccccaagcagacagcatatctctaagtgtggtgctacctgtggagaagtcaagccagctgcagaaatttgcataagtaacgagaagctgaatgttaatcaccaaaacaatgggaaaatgtctccagggaatgtcagagatcttgatggcagtccttcccatcagaggcccagaggcctaggacagaaaaatgttttcatggtccaggcccaaggccctgctactctgtgtagccttgggacttggtgccctgtgtgccacctgctccagctccagccatggctaaaaggggctaagcttgcaccatgcactggaaaagctgccaacactcaatgccagcccgtgaaagcagccacagaggctgtaccctgcagagccacagaagtggagctgcccaaggctgtgggagcccaccccttccatcagtgtgccttggatgagataacatcattagccaaaaagattatcgttctcgtctaatagggaaatgaatcagatagtttacaattgtcccttggtatccggggtcggggaaattggttccactggtttgcactagaaagc

SEQ ID NO: 478277 - DNA, 1018 bp, Homo sapiens
gaggagaaagtcaagctgcctgcagaaatttgcataagtaacgaggagctgaatgttaatccccaagacaatgggagaaaatgactccagggcatgtcagaggttttcatggcagcccctcccatcacaggctgagaggcctaggaggaaaaagtggtttcatggcccaggaccaggatttccaggttgtgtgcagcctagggacttggtgtcctgtgtcccagctgctcgaggcatggctgaaaggagccaacacagagctctggtcgtggcttcagagggtgcaagccccaagccttggcagcttccacgaggtgttgagcctgtgagtgcacagaagtcaagaactgaggtttggaaacttctgcctagatttcagaacatgtatggaaacgcctggatgcccaggcagaagtttgctacagggacagagccttcatggagaacctctgctagggcaatgcagaaggaaaatatggggtcagagcccccacacagagtccctactgggacaccacctagtggagctttgagaagagggccaccatcctccatatcccagaatggtagatccattgacagcttgcaccatttccttggaaaagccacagaaactcaatgccagcccgtgaaagcagccaggaaggaagttgtactctgaaaagccacagaggtggagctgtccaagaccatgggaaccaacctcttgcatcagtatgacctggatgttagacagagtcaaaggagatcattttggagctttaagatgtgactgcctcactggattttgaacttgtgtggggcctgtagcccctttgttttggccaatttatcccatttggaatggctgtatttacccaatgcctgtaccccataatatctaggaagtgactaacttgcttttgattttacaggctcacaggcagaagggacttggcctttctcagatgagactttggactgtggacttcagagagtaggtgacattagagcatagaatttaatatattgaggacac

SEQ ID NO: 478278 - DNA, 602 bp, Homo sapiens
acatcaaagaccaaaggtagataaatccacgaagatggggcgaaaccagtgcaataaggctgaaaactccaaaaaccagaacgcctcttctccttcgaaggatcacaactcctcgccagcaaaggaacaagactggatggagaatgagtttgatgaattgacagaagtaggcttcagaaggtgggtaataacaaactcttctgagctagaggagcatgttctaacccaatgcaaggaagctaagaaccttgaaaaaagagaaaaaagaatgaaaagaaatgaacaaagactccaagaaacatgggactatgtgaaaaggcaaaatgtacgtttgattgatgtacctgaaagtgatggggagaatggaaccaagttggaaaacactcttcaggatattatccaggagaacttccacagcctagcaaggcaggccaacattcaaattcaggaaatacagagaacacgacaaagatactccttgagaagagcaaaccccaagacacataatcattagattcacaaaggttgaaatgaaggaaaaaagttaagggtaggcagagagaaaggttgggttacccacaaatagaagcccatcagactaa

SEQ ID NO: 478279 - DNA, 622 bp, Homo sapiens
ccaattccaaagttgcttccacattttcagagctttaaactacaatgactaccaggacctgcttgagaggcaagtttgatttttacctgccgcacactctaagtttggacccaatgtcttcatcattcactattccatcaagtcctactattgctgctattatggttactaccactaccgatgatgatgatgatgacgatgatgatgatgatgatgataacagtggagcaacagtaacagtactaaagctgggccttcccaagaatgttattctgctcactgtcaaccccctttctttcaattcttcatacttgtgttctaatcaagcagagcttccatatggctgggaaaaaatcgatgatcccatttatggcacttattatgttgaacaacttttggagctggatgtgagctgcgtgagcagtgctgtccctcctgctggaagaggggacccctgtcccaggtagctcattgctaggcaacccagaaaacactgctagcatctttcattggacaatcctgtttgccactcaccaaggcagtgttctatgacaggtagatgatgattattctattatttgtgaaacagttagctcatatagcttattagttttcctctctc

SEQ ID NO: 478280 - DNA, 540 bp, Homo sapiens
aaacatctaatatgtacaataaagaaaacaatgaaaatgattttaagggggcatccagtacagcagtgacacacagtaaaggcttgcaaacatttgccaaatgcaaaaaattagtaacatttcaagaaggcatgagatgtccagaacagagctatccaaaggtgcagcaagttttagaaaatggggttagcaagagagtggattctgaggccttcttcaataaagaatttcggatgaagtacatgttattctgtatgacagtctgttgtttccaagagaataataacaagctgtccttgaaaagaatggctggtgatggaattagctctagagaatttaaggtagtatttgccaagaaagaaggtcagtctgatattgtgtcaaacatatcctttattaacctgaataagtaaatatatgaataagtaaatatacctaataaattacgaagtgcttggtgagttacctgaccattgtttttaaatgttctcattagcatttcttgtctgtaataaatgattttaaatttcgtgtttctcc

SEQ ID NO: 478281 - DNA, 1698 bp, Homo sapiens
aggagccatttctgcaaaaacgaatcatgcttgttcaggaatacaattacagctgtttgaaaataagcatgcatgttgttcaatgtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggagctatcttaacacattgaggtgatatcacactgtggttttgatttgtatttccctgataattagtgatggtgagcaatttttcatataactgttagccattcgtatgtcttttgaggaatgtctactcagctctttcgcactttttttttattatttttttttagctgttaagctgtttgagttccttgtatattttggatattaacttcttgtcagatgagtagtttgcaaatattttctcctattttgtaggttttctcctattttggaggttgttgattgttctttttcagtatggaatctttttaattggatgtaatcccatttgtctgcttttttattgcctgtgcttttgaggcatatccaaaaaaccattgtccaagccaatatcatgaagtatctccacatgttttactatagtacctttatagttttggatcttacgtttaagtttttaatgcattttgatttgatttttgagagagacagaagtctagttttatttccaattttcacagcaccatttataaagctatgctttccccaatgaatctattttatctaagtatagccactcctactcttttgtttactgtttgcctggaatatcttcttctatccctttattttcagcctctgtgtgtccttaaggttaatgtgagtctcttgtaagcagcatatagttggatcttgttttttaaactattcagcaaatctgtgtcttttgattggagatttcaatccatttacattcaaagtatttattgatagataaggacttactactgatgttttgttaatggttcatagtagagatatctatgatttacagagcaacataacagtattgaattattctggatttgatatatttgcccttatcagtgaatgttgtactttcatatgctttcatttctacttgaagaactcccttaagcatttgatgtaaggcagatgtaggggaatgatttccct

SEQ ID NO: 478282 - DNA, 631 bp, Homo sapiens
acaagcaaaaattaaatagacatgggtatgaatcctagctctgtcatctatatgagtttagacaaattatttagtctctgtgaatctcaattttcttatgtaatagagaaatatctcctacatttaaaaatcattcatcagtcctgcctttcttgccctgaaccctgccagtgccacccaagtttgcctcttgttactagtgcttcctactctggcagacaccttcagaggagaaaacaggtggcaccaatccaaacgagtgtgataatagacgtgcttggtttcccagggacatgtgaagaattcaggagaaaaagctcacaattacaagtgctaagtcttcagaaaggcaagagggatgcaagaggggagcacggttataatggtcaacctttgacagaaccatttcactatgaaaacaactgagaagggcaagaatatgagtctagatatgcatcaaactgtaagcagttcagggcggcactgaaggtgtgcaatggtaaaaggttttttgaatttattttttatttcaataagtttttggggaacaagtgatgtttgattacatgaataagttcatgtaagattttggtgcacccatcacccaagcagtgcacattgtacccagtgc

SEQ ID NO: 478283 - DNA, 2909 bp, Homo sapiens
acagctatagattgtcattaccctgttcctacatacaatttcctatctggccctacctggcattcacatcttggcagtaatgctcattggcccaccactcaccttctgctgtgcaaactggttcctaacaagccacagactgatactggtccctggcctgggaccggtaccaaaatcacctggagggcttagtaaaacacaaattgctgggccccagtcccagaatttcttcttcagttgggctggtgggaaaggctcagaatttgcatttctaacaagtttccaggtgatgctgaaagctgcagaagaccgaagaggctttccagtttctattcttcaatggctaggatatttggtacaagtcacattccgtttgaaaacttccttgtttcccactcatataatgacagattcctttgtggtgcaagacatttggaaacatgagggcctgatatttgtgtgtatgtgtgtagtttgtaagtggggacaaggatgctgttattgaactatgttatcttaaaagaaaaattaataagtaatagcggtttacgtattacagaagagaaattatgtgatttacttctcaagaaagttcatagaaaagttctctaaaaattttttattgtaaaggcaaatgtgattatgaacttctaattttcaaaaataattccaaaagaacaatgtttagttactctagatttcaaaatcctttgtcatcagctgttactgccttctattctcttcacgaatatcacacattcctatttcattaggtaatttcaatactgacaattctattacttgctattggtgttaaatgatacaaaataaattcgtattcctggatctatcgtttactaattttatgatcaaaagtgagctgggataaaaacagacaatgagcaaatgaaaaaaaaaatcacatataatgctagatcaggctttgagacaaattaagtaagtgctatgaaaataaaataattcatgatatgaagattgcaagtgaaatgcaaaaggtattttagcataatctttcagtctctttccattatattcaaacctgaaatctagtaccattaaaaaattttgtgtaatcttattgtatgattaggaactgactccttttgctacccggtttctcaaaatgagtagatcgattggtttttacatttagtaccattcaccaatatttaaatcaccctcattaattgtttgagtgccatttcaagaattttaggtaaactgtaaaccatcttcacaagtaactatatatgtttacaaattatgcatacaatttttggaatgaacactgactttgtatgaaacccatttaattatgctgaaagtccatggacctcaggataacaatcttaatgtaaattaatatttgaaaaacatatcttcttcctattcaattcattcagctaattttaattagctggatcccaaaatgatacagttctatccaaaaatcacatatcaaatacttctgtggataaggctgtcagtttgtaagaccagactccacacaacctcagattaagatcctgtttcatcacataggctgttttaataatttattttttttgcaagcacttgaaaagtggtcatttttaatgacaaaatcagttctatttatattcattcctgctatccatgccctactgaagttagctggctttgttttcagcaagaataagtaattcatctcatatatttttatgaaaaaatataactctgtcttcctcacatctagtatttaaatgatggtccttaccataacaagaagtatgatctgtacactttgacaattcaataatacatttatattctctcctatcaaagtcgtatttcagacctaagctatttgagagagacagtctaataaattattaaaaatcagtaaatatcatgctgtgtcttcataaaataaaatacttggaatctcatctcactgtccaaagctacgtatctaaactgaaataaagtttgtcaatgttaatagtttttatagaataataacacaaaaaataaaaaataaataaataaaggaagaataaagaggaaacaaaagaaattatagttggttttgatataaaaatacacatgtgctaatatacacattcttatgcatgtaaattattatattatctgagtatatagtctttccaatttggccttattgatctatttaactaatagaacaaaggttggcaaactgcatatggcctgtgggccaaaactggatcaccagttgtttttgtgtgacctcaagctggatatggttattaaaggaaaatttttgcagtcaattttgatgatggggcacattaactttcagcccaattaagtgaaatgttatcccagaaaaaaagaattctgttcttctcagcagaattatagtacaaaaaaattgtactcaattattacattttgaattttgtcaataaaaacttgtagaaattaaaaaaaaaaaaaggcttgaagactctggaggtatctgtcatcttaaaaaggtcttacctgaaagtacattccctctttgagattaaaaaactgtcacatgccctatttgtgttcttgtgagaacacagcgactttggcaactcataattacatataaagccattcattaaatatttgctgagtgtgtgtaaggcacacagtactgaaatgagcacatttgaattttttattcaaataagaccatcattttttagcaggttgaggcttagtgtggagactgtgtataagagaaaattcaatctaaagggaaattttactctggcctggtgcagaagccaagtcaccacacagtgtttttacatccctgttcagtagtaaaaccataagaaaaaagaagtcaacattcaaattaaataaatttttcaattttataaatatgaatt

SEQ ID NO: 478284 - DNA, 1076 bp, Homo sapiens
gacagctcggtaatttttttcttcaaagtttctgtgaaaacttcaaagattttcttctgaagaatgcaatgaataaatttgtagttattaccacagaaggcacacttaatgagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaatgtaagcatttccacagaggagggtggcctggtgaacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgacaatggagctaaaaatccagataagagcagttgtcttctttcctgcaattcagagtaaattagatgaagcatccaaagaggttaaatattagggtgtgatacatactcacttacaggggctctagaggtgggaatcttaatccatcccaagggaaaacagtaaattaaactttttcttaaagaaatgatgtctgagcataaataggtattttgaaggaaaatgtaaagtgatgtttatataaatagtctcagtgacaagagagtacatagtgtgatcatgaaactccaaaatattttttaaagggcatgtgtaa

SEQ ID NO: 478285 - DNA, 2205 bp, Homo sapiens
ggtaaccggacgtttctctctggctgcccttaacattttttccttcatttcaaccttgctgaatctgacgattatgtcttggggttgctcttctcggggagtatctttgtgttttccttctaacagtcaggaccctctgccgcaggtctgctggagtttgctggaggtccactccagaccccgtttgcctgggtatcaacagcggagcctgcagaacagcaaagattgctgcctgctcattcctctggaagtttcttcccaaaggggcactcaccacatgccagccagagctctcctctatgaggtgtctgtcgacccctgcttggaggtgtgtcccagtcaggagacacggggagtgggcaggcaggaatatttgagtctgctgaagctgcacccacagccgccccttcccccaggtcctctgtcccagggagatgggagttttatctataagctcgtgactggggctgctgccttcttttagagatgccctgcccagagaggaaaaatctagagaggcagtctggctacagcagctttgctgagctgtgtttctctctcccctcccctctccctttgccgcttgactgtatcatactgtgttactggttgaggaggtgctgcgtcaccttctgtattgttgcttgatctttgatttcctgtgaagcacaatgaatcttacattagactcttctgagtcaggtggtgcaccatctgttcccaggcctggaaaacatgagtaacacagagcaacagaaagcaacagctaccccagtttttagcagaatattcatatttacatagcaagagagagggagacaattctgattttaggcagggtagaagtttatttttctcacactcatcgaatacatttgacataaaacctttataaaaattattttacacattagtacactcataggatgggataggtttgaacctacttgcctttgttgttctggggtgatgttagatttaagtggttgggaatggttgtgtaattgtacataagagctgcattgcatgaggctacccagaatacacgagagcagctggcaaacctaggtattgaagctgatagcagggctttcagtattcaattgataaacaggtacgtactggtcactgtgcttgtgctatgtgattagagagatacaaaagaaataaagaaaacatggggtgcctgatcactggtaacttgaaattcctgccaggagacaaaactagcatagattttatagcatatttaaaaaatatgaacagaagtataaatcttagggtgaatagtaatttaaaatcttaaagtcatgttaaattaagtaatactcattaaatatctaagtcatttctaagtaagttaaaatactgaaacattaattattaagaataactttaagtttatatattttaacattttttatatgatatagagaagctaaatatatttgggtttattaatcaacataaaacactgattaaacatatatttctcaaaattatgtaatagctttcatctacaaatactgttacaaaacagttcaaattgcttattttctaggttcttcactggaaattagttactaagagttaaaattgtaattaatgtatacaattaaaactactaaaaataagggtaacaattctctatgcaaaatatataataaaaaaggaaaaatatgtttttggtgagaaaggttataaaggagatataaaagtgtattttcttttaaagtaattttatctcagacattatttaaacattgcttcaaaataaacaaataaaaaatgatatagataaaactgaatggacatagaaagtttaaaaaaggaaaaaaagttaaaaatattgtgtggctaaactaaggataaataaattcattgtaagagttttaaaaactgagccttaatatcaaaagaaaattagggtgaaaataaaatttagctttctgttttaagcaagatttttgtgttgtattaataagagataataaaagatttttattcaccttttgagtaaactgcaaaaacggagagagagagagagaataaaagagaaagagaaacaaatattctgtgccttattctgactttattaggtcttttgattatttggaaaaccgagtctcctctttatcaaagagtaaaagtttttattttttaagatgttttaattatcactttggttaaatgactattattttc

SEQ ID NO: 478286 - DNA, 615 bp, Homo sapiens
agaattagtggtgttgcagatgtaaatggttaagatgacatcatactggagtaggttacaatactaccctctaatggcacatcgaagtatgccccaggatatgtgggaagattttctctgcaatcttttggaggaaatgtctgaaaacaaaattagaaagattattcctctgaagtctgacaggttattctataagaaaaactgctctaaggctaagagaggcaaggaaactgcagaagaagagtttgaagctagcagagcttggtttatgaaatttaaggaaggaagccatctccataacttaagagtgcaaggtaaagaggcaagtgctcttggagaagctgaagaaagttatttagaagatttagctaagataattgatgatgcaaccaccaccctcatcattcagctcccatcaacatcaatgcaagaccctccagcagcagaaaagattataactcgctgagggctcaaatggttattagcatttttagcaataaaatatttttaaattgagatatgtacttttttgtatttttaattaaggtatgtacttttttagacaatgttattgcacacttaatagtctacgatagagtgtaaatatacttttct

SEQ ID NO: 478287 - DNA, 722 bp, Homo sapiens
acccgaatgttcttcaataggttaatggttatagaaactgtggtacatccgtattatggaatactaatcagcaataaaaagaaatgcgttcttgatatttctggagctgaaggggtatatgattatggatttgctatagggagacttgtgtgttttcacacagataagccatatggccaagaagccatcgtgtactgtttactaaaagatgattccctagtaagacttgtttgtcacatgagcggggcagggatggattttcctgaaactgatgacacttcaggccccccaagtcctaggctcctcatattcaaaacatctgtgaataatatctacatcatacgtttgaagaaggtgttctctcgggtagtaggaggggacagcagcctctgtcccaaacttgggaagaacatcctcctatctgagtatgcaggtttaattttactgtcacagcacacgtgtacaaagtcagatacaaccgggagagtcatcggccctcaagatagtcattagtccattgcaggctaatactggtttcacttagtatctcctatcactctagtaactagccttttgttataaggctaattctggagtctttacaaatctaatatttctcttaagaaattaggaaatactgttatagtagaaacattctcttaaatactcaagtagaaaacaatattttattaatttggaaaaatgtacactactcatgtgac

SEQ ID NO: 478288 - DNA, 808 bp, Homo sapiens
caaagacaaatttcctcgctatgcaagagtcctccaccattaatgcctctttaataaaaactcttcttaaaaccgctttacttccaaaggaagctggagtcgttcactgcaagggccatcaaaaggcatcaggtcacatggctcagggcaacgtttatgctgataagctcaattctacccttcgacatgatcaaggacaaaacaacaatcagaagcttgctcagctggcaaaggctgcttgcctccttagaaggaaaaagagaaggtgtcagtattgtcaaagctgctgcatattcaaggaagataaaaatcccagaaatattcgttggattcagcaaaatgagttaacagaaaaagctagtacaggaaatactcttgaagaagtttggcagtcatggcaatggaaagcccaaagtcagaacacaggcatcagatttgatctgggtcctgatatttaattcaaaaagagaatcaaagtaaattactcagttgtagttatttaaaaggagaaaacttacccatttcttatgattagtatttcttcaaagtgtctaatcattaattatctgaaatacttacttaaaatacagatcactggctcctctcctgatgattctgatttgggggggtctgaaataggaggaaccaggaatctatacatttacaagcattaacaggtgattctcatcattagccaagtttggaaaaccacaattaaagggaagactgtgcaaggaacactggaaggacttagagatttcaaaactactgtaaacagagggtggccacagaattttcttgctctaaa

SEQ ID NO: 478289 - DNA, 574 bp, Homo sapiens
cgcaaggataaaaaaccaaacaccgcatgttctcactcataggtgggaaccgaacaatgagaacacgtggacacaggaaggggaacatcacactccggggactgttgtggggtgggggaataatctatgtaaagaaaagtgtatgtatcaaaggctttgccagctctgcagaaacaagtttgagaaatggctggagggtaggatggatatctagatgtccacagaggcaagttaggggacaaatgtgtgtcaatggtttggtgcaaggcagctgggagaggaatgtgatgaaattctcaatgcccctgcagacagacactcacacagctctcagtggctataacattggtgaatggaaaatggaacagaatctggccaccacccttactaaaatacctctagacatacatgaaactgaagacggggcactggaatggagcactgctacagaaaacctacttttccatagtcttttctgtatggacacataagaagatgaacatggcttcacatgtgcctctcaaattccacatgaaaattttggtctccttattaacaatctcattttcttcat

SEQ ID NO: 478290 - DNA, 2417 bp, Homo sapiens
gtacagactaagggaaccagaataaagtatggccaatatgagtctgaatccaaatttgtggatgtatgaatatttgtacgcgtatgtgtatgcagaagaagacaggaaaatgtgggaaagtttggaactccagagagacttgttgaatggctttgaccaaaatgctgataatgatatggacaatgaaatccaggctgaggtggtctcagatggagcagaggaacttgttgggaactggagcaaaggtgactcttgttatgttttagcaaagagactggtggcatttttcccctgtcctagagatttatggaactttgaacttgagagagatgatttagggtatctggtagaagaaatttctaagctgcaaagcattcaagaggtgacttggaggatgtatggaaacacttggatgcccaggcagaagtttgctgcaggggcagggcccccatggagaacctctgctgtggctgtgcagaagggaaatgtgggatcagagccccaacaaagagtccctactggggcactgcctagtggagctgtgagaagagggccactgtcctccagacctcagaatcgtagatccaccaacagcttgcactgtgcacctggaaaagccagaagctcaatgacagctcatgaaagcaggcaagtgatgtggctataccctgcaaagccacggccacgggagcccactttttgcatcagcatgacctggatataccctatgtcattgctcttaaatttggccttcccaaaagacctggagcatggaaacaatgcagccaagttctttgctatggcctcatcagcctgggctacactgtccatatttctattagcattttggtcacaaccatttaaccagtctctaagaacttccaacttttcctcatcttcctgtcttcttctgagccctccaaactcatccaacctatgtccattacccagtttcaaagctcccttcaaatattcagatatctttaacaaccccccaactcctagatatcgatttttggtttagttcatttagcattgctataaaggaatatccaagactgggtaaattgtaaagaaaaaagggtttatttggctgatagttttgcaggctggacaagaagcatggcaccagcatctgttcctggtgctagaactattagtgtataaaaccatttggtatttggtgacatattcaataataagacagataagagaaagcaacacaaagcattttaaaatttaaaaagcaggaatttttagtttttaaaataatactattcagagttaggctgaatgtctatagtgaatctttataacacattatttaaataacaatatgaaaacggaatgaacattgtagcgctagggaaaaaagggcttgaataagagaaatgagaaatctttttaatactgcaaagactttcaaagacaaaatgacaagcttatagatagggaaaggtgttaatttcttcactcacgtattatgtattattttctccctattaatgttatttttaagattgattcatgctgaatcctgagcctgaaacaattgtttccagagaagaaacatttttacttacaaagaattacctttccttgcttgcttttttatagaaaaagaaaaaagaaatgaaggaagggaaggagggaagaaaggagggagagaataaaataagaaaaaagagaaagttttattattgtctaatttcttccttgatttattttttactggactcattgattgaaaactcttcaaggaaatagattagttgagcattcttgtgtttctcataacaatataaatgtgtaagtcatcacaagtaatgattttcttgatcacttcaagtattttctgaatattatgcattgctctgtgctctgacaagctgcactgattctcttcttacattcaactatcaactggaaatgttaaatccattattatttattgagctggcattttgttattacctgtggatactgagatggaatatagtctcattactctagtaaaacattgatatctgattgagtgattctttacttcatttgatagtatcattttttgggtgagacacaacaaccctggacattggctagagaagtgtggccaattaaaatgattattttccgtattttttaagttttataaaataaacacatattttctttgataaccacaataatattcaacactaaaaaataaagacatcaaaacagaaatttagatgataaaaatgagaaagtgtgacatatttttgtttccttaattttacttacacctttggtttttgtgaaatattaaatatacttttttgaacgattgagtctcattcccaagttccgttacccagaaacaacagcttttaattcacttaactgcttttcctagtactttagtccatatttctaaa

SEQ ID NO: 478291 - DNA, 1104 bp, Homo sapiens
aaacaaacaagtcaacgtatttgtgatggtgctaagcgctctgatggtggtaagcatgctgatggtggtaagcacgctgatggtggtgagcactccgatggtggttaagcatgctgacagtggtaagctgatggtgcgctctgatggtggtaagcgctctgatggtggtaagcgctctgatggtaagcgtgctgatggtggtaggtgctctgatggtggtaagcgctctgatgggggtaagtgcgatggtggtgggtgctgtgatggtagtaagtgctctgatggtggtaagcgcactgatggtatgtgtaatgatgttggtaggcgctctggtggtgatggcgctctgatggtggtaggcccactgatggtggtaggtgctctgatgatgtgcgatggtgggtgctctgatggtggtgggtgctctgatggtggtaagtgcgatggtggtgggtgctctgatggtggtaggcgctctgttggtagtaagtatagtgatgatagtaagcacgctgttgctggtaagcactgtgatggtgatgtggtggccagccaagacctcattaataccatgacattggaggagacacctggagaaaccgaggccagctatgcagataagtggaggaagagtgttctagaaagggaagtcagaacgtgcacagaccctgaggcattacgtgctcagcaagttcgagggacccatgagtcacagagaagcagccaagtggaaagtctggaaaaggcaatgtaccccagtcaagtgatcacccattgcatgttacatgtgcagattcagagaaccggtctgtctgagcaccttctgcaataacttcagtctaactttcttaaggctttctcagagtcctgaatcattacaacttttgaggacattattcacaaaaaaaaaaaaaaaaaaaaaaaggaaaaaaggaacacaaaatagaggatttaaaatgatggtatattttctaaagcttatttaacatacgattttgtcgccttttgctttccctcacaaataaagacaaagctggcaaaccatgattaatgccacatattggatactgacatcattaacaataaaaaaaaaagtagtgaggt

SEQ ID NO: 478292 - DNA, 763 bp, Homo sapiens
ccagaatatttgcatgatcaacattttcgtaacaaattaccattcctgttctcctctaaatggaatcagtgcatggtcaggccgatactgtgtaggtgctcccggaaaaactggttttttgcaaaactcaccattagaaatactgggatggatgggaaacacagtgcagatggcaggtttttcaagtccgtacaactctgtgagcaaagcaccaggaagcagtcacatgcccctggggtgacccacggctggcacagtcaggcggccctgggcggccctatgctgatggcagaagcaagttaccatcgagtgtttattgaaggaagagttggcatcgccctgagggtgagtgtgggctgtgtgcatggaggagccacgtgctaccaagaagtgagaggcccagggtgtggggagccaggagctaggaagcctatggtgccccaggaacctggaagagatgaggatttgaacccaggaatttggatggacaccggcattcaatcctcatcatctagattagatgagggcatggaagctgaggctactggctgtaacttcaaatgtataatgatggtgatggtgatgatgatggtggtgatagtgacagtgatggttatgatgatggtgatgtttgacagttataatgacaatggtgataacagtattataatgatggtgatgatgacacggttatggtaatgttgatggtgatgctaatgatgatggtgagagtgatggtaattatgacggtgataaccgtgtg

SEQ ID NO: 478293 - DNA, 803 bp, Homo sapiens
aaaatatatgctaaataatcttttattttatgagagaatttctgagttgaattctcttaatccaggaattctcaaccaactattactttcgtcgattttcctgctcttaagtttgacccttttcagtaacatgatacgggaccaaagtatcgatgaaacaaaagggtacacttgccagcagttttgccatgacagtacaccgaacaaaggagacagggtcatttataacctgacgcggccaccctactgctgtgtcccgtttcctttggctggaacgggacctcagattctgtatttgtcccgattggctagcagcttagaacttttgaaaagaggcaaaggcagaggagaacaaaggaaggaggaagtaacttgtggaatggtgagaaagcatctttctgaagaccaggaaaaaatggatcgatatatccaaagttatgaaagtaaagagctgccaacgaagaatgctatactcagagaaactgtgcttcataaatggagagatacagattttcccgcatcaacaagagctgagaaatttcatcaccaccagatataccctgcaagaaacgctaaagggagtccttcaaattgaaatgaaaggacacttattagcagcaagaaagcacaaaacttacctgtaaaggtaagtgtatagtcaaattcagaatattctaatactgtaataatggtgaaaaatctaactcttttatgaaatttaaaggacaatatattttaaaaatagctacaagcaaagaaagacaaatactgcatgatttcacttatctatggaatgtaaaaaa

SEQ ID NO: 478294 - DNA, 945 bp, Homo sapiens
cctggagctagttagtagcccaagacagcacagcgggataaatcatggggccgggatcccaatccaagttggctgactcttttccccaggagcctctaatgattctggtagcatctgatggggctgtcaactgcacctctagagcacgtcgcagttctgatggggctgtcaaatgcagctccagagcacctggcagatctggccggctgtcaattgcaactctagagcacacagcagatctaatgggactgtcaattgcggttctagagcacaccgcacatctgacagggctgtcaattgcaactctagagcacattgcagatctgatggggctgtcaattgcagctctagagcacagggcagatctgatggggctgtcaattgcagctctagagcacacggcagatctgatggggctgtcaattgcagctctagagcacaccacagatctaacagggctgtcaatagcaactctagagcacattgcagatctgatggggctgtcaattgcagctctagagcacacagcagatctgatggggctgtcaattgcagctctagagcacatcgcagaaaattcaggtcaggaacctctcagactgcgcttgcacccagccacctgcacagtgaagccatcctgcaaagcgagtggcaagcttaacttcaaatgtcacattgatgtccccaataaaatgtcacacacgcacagagtttactgagccaaatttcgatccactgccaaaagaaaatgctgacgacagatcatgagtctctgttttcctatttagacttttcaattctaaactggtgagtacttttggttctaagataacaaacctaaacagagaggcacattgatatatgtttctataacgtaaagcagcattaaataatgactagctcattttgaatccagcagtaataagtacactattttgatttttc

SEQ ID NO: 478295 - DNA, 803 bp, Homo sapiens
gcactcgtacatcgccgtcggatgtgtacagcttacgttagggttcattcatggcgcgtttgttccatccaggcacctgcactcatacatcactgtcggatgtgtacagcttacgttagggttcattcatggcgcgtttgttccatccaggtacctgcactcatacatcgcccactgaatattgacagtccattgtcaggatgtcccacagtttattcactcacctcttacagggcaccttggtcgcttccaaattttagcaattatgggcaaagcacatataaacattcagtttctacatcagccacatacaaccaggcaatgcaggaagctgctaatgtggcaaatgttatatcagaagccggcgtttcctctccgtctgtaaatgcatctgaagtgcggtcgctacttccacatgtgtgtccccacatgtgtgacacacgcctctcctctgacctacacaagcacagcacggtgctccattactattttcatgtgggcatcacccctgatttacaaacagtcaacttgtccaggttacgagggcagctagtgcagccaagctcacacccaggcgcataaaatgtcttagcagagttacgtgagtcccttttcctcaatgacatttttaaatagagaactgggagcactgactatttaaaactctgtacggttcttacaatgcggagtctaattttgttaaaattctgttgtttctccattgctaaatagtccattttaaggataaggcctcttccagtattttaccaaccttgtgactacaacttaaagtagaatatgtt

SEQ ID NO: 478296 - DNA, 589 bp, Homo sapiens
ctctgctggaagagaccctgcagtcttcacatgcatctggcaaacactgtcaggccagcactcccacccccacctctggagaaaagtttgcactcttggtcggggacccctgcggaaaaagtgccctgagaaaacagcagctcctccttgaaaggcatgtttctgcatggctgacaggtgcaatcccgtggaggaatgcatgagtaagaatgatctgagaagactcgtgaattactacaaattagggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccaga

SEQ ID NO: 478297 - DNA, 642 bp, Homo sapiens
gggcactcagcccacagcgagggctccactctcatcacctccttgcctcctaaaggctccacatcctaatgccatcaccctgagtttagaatttcaacaggtgcattgggaagggatgtcatgattcagtccctcatgctgcctttggcttgtgtcctgggaaagatggcacatgcaactcacccaaggggagctggagagtatgccagaaatgatacatacggctataaagacagagtgtccaagtttgactcagttcatctccgggctcttctcacttccgacattgccccgttttgtgaacttgactgtgtctctttctacattctggaagcaacagtgttccctagcctcattcatgctgttgcctgtgccccgcacttagcagatgagccagtggataaggttctgcagctctgcttcccagtctttctgacatttctgctcacaattgttgaattacaaagcaccagctggtccctcgtcagcagcggcctccacgcaatcatgggaaatgctgcattccgtcacagggtgccctgagatgtccctgctctgtttcctctcttcaccttgcaaggcagctgacatcctttattttctcataacgtcactgcctggaatttccgcttccatcaatcc

SEQ ID NO: 478298 - DNA, 703 bp, Homo sapiens
aatcccacagcatccggaatacacccgcaatcccacagcatccggaatacacccgcaatcccacagcatccagaatgcacctgcaatccaacagcatccagaatgcaccggcaatcccacagcatccggaatgcacccgcagccccacagcatccggaatacacccgcaatcccacagcatctggaatgcacctgcaatcccacatccagagcatccggaatgcacccgcaatcccacagcatccggaatgcacccgcaatcccacagcatccggaatgcacccgcaatcccacagcatccggaatgcacccgcaatcccacagcatccggaatgcacccgcaatcccacagcgtccggaatgcacgtgcaatcccacatcgacagccaatggaacgaaatgacaatgactacgctgtggtttcctcggatatagacgaaatacatctgctgataaacacaggctcccatacgtttaatgatcaatccaggcctgcctccagtaacaaacagcagatcttcaaagaccagcccggacacagacagcccagaatttaggccatgttctttgaatatctacaatattacaaaattccagtgtagctcactgagtcagtgtgtgtgtataaaattaaaaatgcaaaaataattttttctggttcacggatttctgtgataaatgtttttctttttaaatatgaaca

SEQ ID NO: 478299 - DNA, 956 bp, Homo sapiens
ttaagagtgttcttaacagaagtagcgaattcagatacttctctcctaccatcgccctcaccaacatggcattactttatccacagttcctctgcactaccatctctaaggatgaatgtcttctggggtgttataattttatgtaccaaatgaatgtcactgtggggcttgttgaacttttgctttaccagtgggtgtggagcgcggccatgggccagatccagctggtgccatctgacagctgcctagtttttgtccacacagtcggcctggggggagctgccactggctcctttccacaaggtgtatgtctccttttgcgataccagcagagctccgcagatgcagagcctaataaggtcgacattattgcatttccactttacagattagaagacggaggcctgcaagatcagattgtaggaaacaggagcgccatctgcctggaggacccatttcaaagagacaacatcaacgtccctgggaaggacggtgccaggacatacaactggcaggcagcctttaaaaagcattacatcgctcttcatcacaaacaagaggagtctgagaaactaccccagccaagaggagcctacgaagcccacttcttactaacattagcatttcaactgaagactcctactgaggaagaaggctcactggctaacagccacgtggaattgtggctgtgggatggtcgcggctggtggaaggataagggaggaatgcccacagaatattgcgactctaatcggcgtccaacgaattagtcgtgttatgtactgatgagatttccttaaaattacttttctattaacatttgtcaatacattgtccctgttatataatccatgcaaagtaactattaaattgttataaattgctgtttttgaactttgacatttaatgaatgtaggtggaacataatcatgagaaattagctcactcgtttgcac

SEQ ID NO: 478300 - DNA, 1649 bp, Homo sapiens
ggtcctgacagcaaaagtttcagaactgctgccgtagaaaatctttagatgtaaagtcctgtataagtgtaagatgcgagctttctgcgctcgtcaggccctcatggtgcaccatggccccacgctagctctaaacttttatcactttgaaaagaaatcctgcaccgcattcagtcactccggaagagaaatcctgcacccccattcacagtcactccggaaaagaaatcctgcaagcccattcacactcactccagaaaagaaatcctgcacctccattcagtcactccgaaagagaaatcctgcacccccattcagtcactccggaagagaaatcctgcacccccattcagtcactccggaagagaaatcctgcaccgtcattcacagtcactctggaaaagaaatcctgcacccctactcacagtcactccgtgagtttctcctccctagatcccaggcaaccactcacctactttctgcgtcaaaagattttttgtaagagctctccaagttactcgtaggttaaccctaagtcatccaagatagcatctctgttctgtgaaattataatatagttccaaatcattctgttcatgatttgccaaagaccttgattcagccattttctgaggagccctgatctctttatttacaataaggtatttggagacaataatctaaatgatcgcagtagtactcattgttaatagcatatatttttgaatagattcctggaacttatctgctgtgtcagatcatagcacctgtatcattttattaacatgcggccaaatttcctttcacaaggggtgtcaccttttgcattttgcacaatagtgcatcagagtgccagtttctccagactctcagggagaaattgtaaaactgtgtaaaaatgtaaaatgttacttattggaaaaatgagaaatggcatatcatgattatcattttcatttctcttaacatatcatacaaatttgagcacggtcttatattaaacatcaatagtgggttatttaaacctgcttagacaatcaaagacagaaaattctatcaaaatagggaaatgtgaactattttcaaatatgcatttatatgtaaaactgtattacaatttgggtcctcttgtacttttctgtcatgagactactatttatatatcagcattaaagggaaatataatttaaaatatttgatttagaggaaactgacaaaatacagtaggtatttttagaaataaattatccatctggtaaaatgcttatctttttataaatgctgttaaagatgcgacttaataaatgctaaaatgagagattattatataaagaaagttgtgctaattctgtagggcaatgtaatattgcatatagcttttctgttttgtgattattcctattattgttattgttattaaaagtcatattactaattgctataaggctaatagtcatatattccagaatttggaactgtatgttattacagactagttttaattgactctgattaaaaagattagttttcaagttgaaaacttgctgaacatttcgtggcctgggcttttctcggacctactgttatctgacactattctataaacatttcaaattaagcattgatttgcattactttcattcttcctc

SEQ ID NO: 478301 - DNA, 536 bp, Homo sapiens
agactttccagaaatgaaccctcatagatgtggtcaagcgattttccataaggaggcaacaaaagcaaaaatagacaaatcagattacatcaaacttaaaagcttctgcacagccaaggaaatgatcaacagagtgaagagacaacctacagaaagagagaacatatttgtaaatcacatgtctgaccaggaggtaataactaaaacatgtacagaacctgaacgactcaatattaagaaaacaaggaaatgcaacttaaaccataatgaggtatcatctcatatctgtcagaataactattatcaaaaaggcaacagcagctccatcaaattattgtttgacgcattaaactacagcatcaaactcttgagagttcaaaatgtcaatgaaaaccttgtcttggggcccccaaatgacgtattttatttcataattattattttcacctgaataccactcttctttatttaaccaaacatattaaaccctattgaaatatatttccgtttccgtaaatgttcctatctacctagtc

SEQ ID NO: 478302 - DNA, 564 bp, Homo sapiens
ccgcctaacctacctactctaacagcttctaagaacgaggaaacacgaactaaaataatcttagggccatgactggggatgtacttgaccccatagtcatctgggatgagccactcctcaaccaccatgtcttcaaattcatccacgttgaacttggtgaagccccacttcttcgagacatggatcttctggtagccagggaacttgaacttggccctgcaggaaaatcttcagtgttaacagacaaagagggaacgatggatgaacaggcaaaaccaacagctgtccggtgtagtgtgacttatgtgtcgcagaatgaatcaacagagaacagtagcttgagatcacatgaagatattaggttggagaatgggaatatttctgatattaaaagagaccttgccaaaattctaagagactcagttttcagtgaaaaaaaaaaaaagcatgtgataataaatctaattgcaccctaacggtattacttggttatttataagtaactatagaaagtgagttattgtatataaataataaaattaacctttctgtatatttgtatgt

SEQ ID NO: 478303 - DNA, 528 bp, Homo sapiens
agttctctcgttattgtcattatgtctgcagttacttcctgcactagtcttgaatcaaagtcatccacagagataaaactctcatctcctgggaacagagcacctgggggaaggggcagctgtgagcgcagctttagccagcttaaatgttcctgcctcccagctctgaagagagcagcagatctcccagcacagcacttgagctctgctaagggacagactgcctcctcaggtgggtcccggacccctgtgcctcctgacagggagacatctcccagcaggggtcaacagacacctcatacaggagagctccagctggcatctgacaggtgcccctctgggacgaagcttccagaggaaggagcaggcaacaatctttgctgttctgcagcctccactggtgatacccaggcaaacagggtttggagtggacctccagcaaactccagcagacctgcagcagaggggcctgactgttagagggaaaactaacagaaagtgataacatcaacaccaacaaaagggatg

SEQ ID NO: 478304 - DNA, 1568 bp, Homo sapiens
ggggatagaggagaagagaatattattgtatttggctgaaaagattctggtaatgccatggtgttcttttactggttactttataaataatgcaaatatatttctcatggccctggaggttgggaagtccatgatcaaggtgaaaacaaattcagttccaaaggctgctctccgcttccaagatggtgccttgaatgctgtggactcacatggcagaagagaaactaaaggaaatgctgatagtgatatggacgatgaagtccaggctaaggaggtctcagatggagatgaggagcttattgggaagtggagcaaaggtcactcttgttatgtattagcaaagaatctggcagcattgtgctcctgctctagggatctgcggaactttgaacttgagagtgatgacttaggttatctggcagaagaaaattctaagccacaaagcattcacagtgacctggctgcttctaaccacctatgcttcccccagaatggtagatccactggcagcttgcattgtgtgcctggaaaacccatgggcactcagttccagcccctgagagcagccatgacaacaggggcaaaactgtccaaagccttggaaatccaccccttgcatcagtgtaccctgaatgtgggacatggagtcaaaggagattattttggaaaccctgtgctccacctcctggttgctcctctaaagcccctgcagccacatcagggcttcttctataacacagtcttcacacatgcagagatgctttagcagcagacggaccgtgtaacttctaacaatgaaataaatggtaataaacaatttgacaatgtgtagaagaatgtttgagcccatataaaatgaggagaggagagaagaagaaatgaatattaacagtgtagatggacgtgattaatgagaaaccaaacagccctttttcctcggtcatctagtctcactcttacaatgtgaatgattttttaaagacatataaaatcatttacaaaattggcaaattctattacctttgtaaaaatgtatttttccctagtccattaaagtttgaaaatacttattacaaatcataagctagaagactttaggttatataaatatttttaatgttaattatgaacaagttctgcacggtagaaaagtggcttataggttttttaagtgttggttggttttaattatattaattagaaaataatctacaatttccttataaaacttacataaactgtttggtgtctttgtgagagtaattcttctgatggaattataagtactagaagtgaagctagataggcctcctttttccatgtttagacagaaggcaaaagggaacaccacaaagtctcactagattatcagttggctatgcatgatgaatgcttcacacgaaaattcattattttagaagttaattaactgttaaactttctaaatttctttctagtggaattataacatgattgataatttatttttattggtatttccaaatatcacaatacttagggatcttcttccaactctgagagttgacatctattttgcttatgtttat

SEQ ID NO: 478305 - DNA, 1245 bp, Homo sapiens
atcaacagcatgtaagaattatgaaagaacattacagtccatccgagggagatgagccctgcagccttaatttccaatgtggcaaaagtcatgagtctgagtgtcagaactgccacagagattcttggttgataccacagccatccattaacctgtccctggagttagcagcccagatggtgttgctctggctaggacttccagtgctatgtgaagaggagtggtcctgtgtgatttatgctttaaagaggttctgttttgatgcgtttccaggatttgtttcaagatttagagctccttttagcaattcttatagtggtggtttggtactggcaaactctctcagcatttgtttgtctgagaaagatggtatgtttcctttatatatgatgcttagtttcgctggatacaaaattcttgaatgataattgttttgtttaaagaggctgaagataggaccccaatcccttctagtttgtagggtttctgctgagaaatctgctgttaatctgataggttttcctttgtaggttacctggtgcttctgtctcacatctcttaagattctttccttcatcttaactttagataacttgatgacagtgtgcctaggtgatgatattgttgtgatgaacttcccaggtgttctttgtgcttcttgtatttagatgtctagttctctagcaaggccagggaagttttcctcgatttttcccccaaatatgttttccatacttttagatttctcttcttcctcaggaataccgattattcttaggtttggtcatttaatataaccccagacttcttagaggctttgttcatattttcttattctttattatttgtcatggttggattggtttaatttgaaggccttgtctttgaacttcaaatttctttcttctacttgttcatttctattgctgagactttccagagcattttgcatttctgtgtgtccagtgtttcctgaattttttattatttgtttctttatgtatttccttgaatatttctcccttcactttttttggacttccttgcattgggctttgcctttctctggtgcctccctgattagcttaataactaacctcctgaaccctttttcaggtaaatcggggatttcttcttggtttggatccattgctggtgaactagtgtgatttttgggggtgtttaagagcctgttttgtcatattaccagagttggttttctggttccctttcatttgggtaggc

SEQ ID NO: 478306 - DNA, 614 bp, Homo sapiens
ttctaagtgtataaagattcatgtgtggatttttctctgatattcactgtgaggacctggtagagctcctggtggtaaaactcaccaaaattcttgtccacactgaacctccatacttcatcaattatagtttagattttcctaccctggtacttgttccagtggaagtttctactgcacaaccactgactgtcatcacccttcttattgatctatgtaaacaaggaaaatatttcaaaacaattgtgtatcgagattttcagaacactattctcacagtcaagactgaagtctatttatccagttgcaataacctgtaccgacagatcatgctaactttagcacttgtgagagaagggagaatgaggccaccaatgcacttattctcgcagttggacttgggtgctccatcagtcctaatcagtgccttcacaggagaggcactgctgaggctggataaataaaggacccatgaaaaagttgccattaagaaaacaaaccagttttcaatcactgaattgtgtcatgactttttgtgccttttcagatttctttataagtaaaatcataaatatgtaaaaaacacatttataagcattaaatttttaatttca

SEQ ID NO: 478307 - DNA, 509 bp, Homo sapiens
ttttcagcaatatgaagttaaaaccaagtactgtgttccaggctgcaggtcttcctcgggcagaggaagataggccacagcctttccagagccactctgtggaggaaggcatgatttgctcctgcaccagcctacaaaaccacacttctcacccctctcagtgctctgagagtgaccctcggctgcaggtctgttggagtttgctgaaggtccactccagaccctgtttgtctgggtatcagcagcggaggcgcggaacagcgaatattgctgaacagcaaatgttgctgcctgattgttcctctggaagcttcgtctcagaggggtacccggccctgtggggtgtcagtctgcccctgctggcagtgcctcccagtgctgtctgtcacagcttcccttggctaggaaagggaattccttaacgccttgcgcttcccaggagaaaaaaattgataagacattattactagtagtaaatctctgcatccttgattatattttctacaatc

SEQ ID NO: 478308 - DNA, 764 bp, Homo sapiens
agactttggtgatggaattttctcatattatagaagaaacgtgatgctgaggcctgtgttagttgagagttatgttcttggagtggcaagactcagggtccagggcatctgctcttggagtagctcccttgtgacccggatatttgccgctaggcgatctttccaggtcagcatctcacgtgcaggagacactcgtccgttcgatgcctctgaccgcaccgtccttgcttctagtctcacctggacaccaggagctgcctcttgctatcagcactcaaagcagatgcagccgtttggtgcctgtgcaaggttgcaagtgtgtggttggatgggaggcttctcctcgaccccctggtcccatgtctcatgcatagaagaggaaagtcagggccagaggtcacctggcccgttgaaggtccttactccaggagcagatcctcaatgggagtccagatttcaggtgcacaaggcgtgcggtctttcggcagctcacgccaccatgcacgtggtgtgtttctgctccatgcttctcctacggaggccattccaccgccatggcgtaaccagggaggtgggcgaggccagggccagttcctcacagtcgggggaactaagggacctgactccagcaggtcctggattaccttgatgcatcccagggggagaggttgtgttctgaagattggaggagtgtttgatttatttacatgggatttgttgcaatacatgttgtgaataaattttctttataactgtttcagtat

SEQ ID NO: 478309 - DNA, 754 bp, Homo sapiens
ggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggactgctctacacttggcctgtgccaatggcaattcagaagtagtaagtcttctgctggacagacaatgtcaacttcatgtctttgacagcaaaaagaggacagctctgataaaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttc

SEQ ID NO: 478310 - DNA, 685 bp, Homo sapiens
gcgttcctggtggttttgttcatttacgttgggtggatgaatttgttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacagtgaagaacaaaatgatacccggaagcaactttccaaggaacagaatgctagaatattacaagatgagattctgactactaaacagaagcagatagaaatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagcttagcattttgacaactgagaataaaatgctcagttttgaactgcagaatgtaagacacaacaatgaaacactggaaatggaaattcaatcatgtcattttagactggctactgctctacatgattgtgactgaagtcagat

SEQ ID NO: 478311 - DNA, 835 bp, Homo sapiens
cctccgtggccatgacagcttttcttcttaaaagaaaaaaccggaccaaactgctcaggcctgagtgtgaaatgggcatcggatgtaaacagaaccatgacacagacttaggaatgtttactaaatggcatctcacccccaaccaaaaaggatcctgggtgagaatgagctatcctggatccatttacaatccaggtagaggccaacatgaaggaggagagaccaatggagaaattcttcatggcctaaaccaacgaaaaaacaaggacggtcattccttgccaaggactaaaaggagttccgcattcctcacaggctccaatgaacatattggcttaaatggtctcctacctaagaatctgctcttcacaatggaagaagaggaaaccaacggagtggaaaaactggatgaagattaggaataaaataagcatgtgacctgcaaggcctgtgaaaacatgaaaaataacctgaagagcctttctcatcaaatttaggatccactcatgtccaaatgaagtgtctaatgtgcagtcaaggggtccagggctggggtatcaaagatattggaagcccactgatactgtttggctgtgtcccccactaaatctatcttgaattgtaattcccataatccccatgtgtcatggtatggacctggtgggaagtaattgagtcatggaggcagttttccccatgctattctcatgattgtgctttgtcgtgaactctctgagtaatctgaggcaagctatgccaaatatactactacgactacgaccgttactactgctaataataataataacgactgctaatattcatatagaactac

SEQ ID NO: 478312 - DNA, 616 bp, Homo sapiens
ggttttgtgctcacttaattcctgaaccttcgtagcgtcacttatttactacccgcattttatgaacaagaaaactgaagtccagagagaggaaggaactctcccaaggtcgcgcttctatgctctctggcatgtggtcctagcaaccgactatgtcatgataccccaggctgttactcctgtggctgtattcaaggtcaccagctctacgatggcaacaactgtccagttacaagggcacgtgcccattgctggaacctactggactgacttgctgaagcagctgtttgctttggatcccggggttgaaggagcagccccaaccaccgctcctgctcctcccgctcctcctccaagacctttaagaaacctaataactcagtatgcttttcagggaggtggtgggaatattccacaggtagtaacaggtgctcaaaagaccatggaggatgtggccatatttgtatcccagaccctgaaggacagattcttagatgtcccagggagaagtaaatgggtgatggtcatggatggtgagggggaagtactaagtttctactgttttaactaccgaggaatagcgacggaattcagagaaaccaggaactagaatata

SEQ ID NO: 478313 - DNA, 777 bp, Homo sapiens
ctccagaatatgggaaatacctgctacgtgaacgcttccctgcagtgcctgacatacacaccgccccttgccaactacatgctgtcccgggagcactctcaaacgtgtcatcgtcacaagtgctgcatgctctgtactatgcaagctcacatcacatggcccctccacagtcctggccatgtcatccagccttcacaggtgttggctgctggcttccatagaggcgagcaggaagatgcccatgaatttctcatgttcactgtggatgccatgaaaaaagcattccttcccgggcacaagcatttagataatcactctaaggacaccaccctcatccaccaaatatttggagggtactggagatctcacatcaactgtttccactgccatgggatttcagacacctttgacccttacctggacatcgccctggatatccaggcagctcagagtaaggcgcctacctccaggacgttaactttacacacttctgccaaggtcctcatccttgtattgaagagattctctgatgtcacaggcaacaaacttgccaagaatgtgcaatatcctgagtgccttgacatgcagccatacatgtctcagcagaacacaggacctcttgtctatgtcctctatgctgtgctggtccacgctgggtggagttgtcacaacggacattacttatcttatgtcaaactcaagaaggccattggtataaaatggatgatgccgaggtcactgcctccggtatcacttctgtcctgagtcaacaggcct

SEQ ID NO: 478314 - DNA, 974 bp, Homo sapiens
ccttggtgccatggctgccctgagcttagaggcaaagttaagagactcatcagattctgagctgctgcgggatattttgcagaagactgtgaggcatcctgtgtgtgtgaagcacccgccgtcagtcaagtatgcctggtgctttctctcagaactcatcaaaaagtcctcaggaggctcagtcacactctccaagagcacagccatcatctcccacggtaccacaggcctggtcacatgggatgccgccctctaccttgcagaatgggccatcgagaacccggcagccttcattaacaggactgtcctagagcttggcagtggtgccggcctcacaggccttgccatctgcaagatgtgccgcccccgggcatacatcttcagcgaccctcacagccggatcctcgagcagctccgagggaatgtccttctcaatggcctctcattagaggcagacatcactggcaacttagacagccccagggtgacagtggcccagctggactgggacgtagcaatggtccatcagctctctgccttccagccagatgttgtcattgcagcagaagccatcgtgtcgctggtcggggtcctgcagaggctggctgcctgccgggagcacaagcgggctcctgaggtctacgtggcctttaccgtccgcaacccagagacatgccagctgttcaccaccgagctagggctggacacagctgtggactgcaggacgctggagcacaggctgtacaggcggatccaccacgccactgtcctgagcacccagttgatggaagacgagcagggtgactatagagaagggaaactggccccgtagtgggccagccactgtcctcagacctgacatttgtcaacccccagcacctgtgagggtgtgctgtcattgtcccatctcaccgacaaagacactaggacacacagaggccaagtgacccccgagctcccgcagactgcagccc

SEQ ID NO: 478315 - DNA, 492 bp, Homo sapiens
gctttgaagaatagatgttccccgtcagacatgtctgtcagcagagaaccctgaccacaccctcatgtgttttctcctccaggaggcgcttggaaaccaccgtcaattggaccgcactgggaaacacagatgaacaaagtcaacaccgctttgtcctgcagtgcctggctcctttttcagctcgtcttgcgactccagggttggtggacctgggtgtctctctggacacatcctccagtggcctggacctgcccatgaagttggtggacatgttcagctgcagcgggcttggctttgtgaggaaccgagtgtgtccagggatgtggcagctgcagcgggcttggctttgtgaggaaccgagtgtgtccagggatgtggcagctgcagcgggcttggcttttgtgaggttcagcattgccatctccaagtgctctccatagggaaacagtttctggtcatgatgagcttccgcttcccatctgatcccatccc

SEQ ID NO: 478316 - DNA, 835 bp, Homo sapiens
ggacaggatgctgaagttttacaacggcctctcggaagtggaggcggtgggactccctgcggggaccgaccccctggaccccactgatatgaacggggtacacttcgacccggaagtttacctagacaagcttcctagagagtgccctctggcccagctgatggatagtgagacggacatggtgcagcagatccgggctctagacagcaacatgcaaaccctgacctcccagtgccaagtgtataagtgtgtccagaattggtgggttcttggtctcactgacttcaagaacgaagctgtggaccctcctggtggggctcgtggtctcgctggctcaggagtgaagctgcagatcttcacgtgggttcatggtcttgctggcttcaggagagaagctgcagaccttctcgggaggcagctaaggcccggtgagaagtcgagcacagcagctgctggcccaggtgctaagcccctcacagccccggccggcaaggccagccggcagctcctagtgcagggccaccaagcccacgcccatccagaactccagccggcaggcaagcagcacacccgtgggctgaagggctcctcaagtgctgccaaagtgggagcccaggcagaggaggtgccgagagtgaacgagggctgtgagggctgccaacacgctgttacctctcataaggagtgattaatctgagcttctccagaaagtccattcctggtaggcactgggaataagaaatctcagagtataaaaaaacatcaagtggtagcactttttctctccttgcaactgactctcagtggtgggggggggtgggttagtttgaggaaa

SEQ ID NO: 478317 - DNA, 922 bp, Homo sapiens
ggtgacctgaggtttactaagttcccccacacgtcccagaaggccacccagcttcaccactcattgggactcccagtgggaactctggcagcccagagggagctcatcccctgatcaagcccagcaggcgcccacccggaacctgggctggccggcgagtgccgcatgcagccctggctcctgccagcgcctctccctgcacacttccccgccagcagagagagccggctccagccttggccagcccccagagaggggccaccacagcagagcggagagctgaagggctcctccagcaccgccagagtggacgtcgaggcagaggaggagcccagagcgagtgagggctgcaagcacgagggtggagctgcccaaggctatgggagcccacctcttgcatcggagtgacctggatgtgagacatggagtcaaaggagattattttggagctttaagatttgactgccctgctacatgtcagacttgcatggggcctgtctttaagtttactaattctttgttcttcttgatacattttgctgaaactgatcatattagaaatatggatgtcaaaggtgtagcattccaggagagcatgatgttcagacaatatcactacattgaaggaattccacaattaggaactgaacaaggccgtggtaggactggtgtcaaacctgaagacctgggaccggtggagaaattgctgactgaagaagcttggttgcgactcaatgggttgcatctgggcagctggatgaaggaggagctgcaaagagttgaagagtggcaggcaatgacaagcaacaggtcatgtggggaatttctatggtagtgtattgcaggctctggaaatacaaggtttaaaatccagcaggaaagcacagatctgaatcttggttttaccttcttacaggggtct

SEQ ID NO: 478318 - DNA, 599 bp, Homo sapiens
caaagaaagtcgacacatatttagaactgttttgtgaatacgtatcaaggttagaaaacagtatgttttacctcctgaaaagagccaactgtgcttcaagtataatagggagattgactaaaggatctgatagtccaatcgtaatttcatgcccaagttattctctgatgcctacatcctcatataagatgtccacatccttggaatttctcatgggcctgacaagttcccaggactctggactgtgttatccatggtctactgattcaaatgttaacctcttccagaaacatcctcgcagacacacccagaaatatattttatcagctctccaagcatccttcagcccagtcaagttgacacagacatttaaccatcccagggggatttgggatataggccctatcacgtcttccctggaactcatggcagtagaggactgctgtggtacaacacgagacctggggctattcaagaggaagcattctctatccactgtaagtgtcctgtccctggagtgtgctaatgtggtccaaatgaccacctagagggcatgtcactgagacaactccagtgtctcatcaggaagaactagataa

SEQ ID NO: 478319 - DNA, 1819 bp, Homo sapiens
gagagaactcactcactgtcatagagaaaacagcatcaagcggatgatgctaaacgatgcatgagaaatccaccaccgtgatccaatcactgcccaccaggctccacctccgagattggggattacgatttaacatgagatttggtaccgaagatccagaccgtatcagtggtatagaagctaggagtaactggtatgtttctgcatactttacgaaaggagtcagtaaacacaagaaatataagaggaaacaaaaaccaaaagtggaaattactgatcaactcacctgcttagacaagaactcatgcacctgtttggcaaggctttgtcgattttgcactaacaatagtgcgataatcatgggaagcttcctggccctagaatgcagggcaacacccccacctagtggctcctttgccaagttgtacacagtttgtcagataataagcgcacatcctgagtgtacacatctttacacatgtatccttgcctgctacttatactgcaactatgatctttccgtctagaagcatgcagtcaaaaaaaaaaaaactgcttaagagtggataatggactcacaagatttagagagttacaatacccttagaaatcattttaaattaagacgtcatgtgtttggaaaatgtctatggtaaatccaggcaggcttctgagaaagcaaaaaggcccatacaagatgcaggccccttgaccttggacttctcatcctccagaactatgagaagcaaactaattttatttatatattatccagtcactagtattcggttatagcaacaaaaatgaactaagaactctgctagcttcctgccaggtgctaggttgactcttcataaatataccttcgtttttctttttctttttttttttttttggagacagagtctcattctgttacccaggagtcttcctctcatttggacatcagctttcctgccgtctttggccttggcacatgtgggagtgtgtgtatgtgcagggaaactgtgtcattcagtgccattcccaaagacttccaaagacccaacagagatttcaaatagttctttttgtctagttctgttatgaacatggaattttgaatctgcagaaagcaaatttgagactcatttaaaatttaataaataaccataatatattaaaagtcaaattataatagtgtgatgttattgaattagggcaaatacatgacactgtgaaatccttaataaattatgcatgaggcattctgaattgtttacctcaatttggacaattttagagattaaagagtactgtgtaatttagtttgtagttttagggcataatggggagaagagaaacatagcttgtatttgttccagcttatttttgtattagtgtcttacttcacaattgtgtttgaaaacatttatttatttactttacattaatattgcttatcgttcaatgttttcagaagtaaatcaacttcaatagaagttaaaaatgaaagcttcttttggaaataaatgtggttactctcacaaatcttatctatctcttgactctttgtaagacaattgtctactcatacatttattttcaaaatcatctacttcaagctttaacatcagagcaaaatgtttcttgctcatgaaacaatgagaaatagtagagtgtgtgtgtgtgtgtgtgtgtgtgtgtgtgtgtgcgaattttccctggaggaagagttggatgtctaaaataggcaaaataaaacacaataaggtaaatgttttcatagagatacttaattatttgatgggtctttgctgcatatgaggaaagtaagcat

SEQ ID NO: 478320 - DNA, 576 bp, Homo sapiens
agatcaatctcagactgctgcgctagcagtgagcaaggctccatgggcgtggcagctgctgagccaggcacaggagagaatcaccttgtctgctggttgctaagaccattggaaaagcacagtaattgggcgggattgtcgcgattttccaggaagcctatagacggatgtgcaagtaggagaaatatcactgaattcttttcccagccaggaatgaccctggggaaggaatgcattcctggggaccagccaacacttacggaaaatagaacctacgttgaaatattgggggctggtttcctctatacaagaggagtcatgaatatttatgaaaggagaaatcgcacatgcacagaagcagtactagcacaaagaaagcatgtgggaaacgaaggactctccgggaggtacaaaatctatactttgttttctaacataaagatgaaaactgcggtgaactgagctggcaccaggtgtttctcaggaaacacaattttgagagcttgaggatgctgtctggtaagacggactgaacctatatttaagtctttgggcccataagtgccttgtccttat

SEQ ID NO: 478321 - DNA, 609 bp, Homo sapiens
agtgccgccaaagtgggagcctatgcagaggaggcgccgagagcgagcgagggctgaggcatcgcattacccagcttcaaactatacttacaaggctattgttgccaaaacagcatggtactggtataacaatggacacatagaccaatggaacagaatagagaacccagaaataaagccaaatactcacagccaactgatcttcaacaaagcatacaaaaacataaagtggggaaaggataccctattcaacaaatgtcactgggataattggcaagccacatgtagaagaatgaaactggatcctcatttcttaccttatacaaaaatcaactcaaaatggcccatttttaaatcatgttctttgtttactatattactaaaacaactattactatactatgcttactatagtttaaactcaacaactatatatagatatatagtttaaactatatctacgtgcatctttgcatgtgaggtgggtctcctgaatatagcacactgatgggtcttgactctttgtcctatttgccagtctgtgcctcttaattgggggcatttatcccatttatatttaaggttaatattgttatgtgtgaatttgat

SEQ ID NO: 478322 - DNA, 675 bp, Homo sapiens
ccagcacgctgtcacctctcaagagtatgagagaaaaggacttccaagaacccatttccacagttgatagagctccatacagattagaacagatccaggaccagacacagtggcacacacgtacaatcccagcactttcggaggcagaggtgggtgatcacttgatcgagaccagcttgggcaacatgaaaacttcaataggctcctttgctacccgtaaaaggggaacaggtattatctatcattgtccaaacccacataatactttatgtagcaatttggtgcttcgagtcactagcctacatgagactggaacccaagtcactggttatgcatcagagcaacacggctgccctgctggcctgttgctgctagagagtaaagagaaggaatcaactgttctgaatgataaaaacggtgaaagtaaagaagatgccatcaggaagtatgaagtaaatgtgtgatattggcattaaggtacatttccattaggaaatacgcctttctccattaggatggcaaaccttccacataccatccagttaccaattaccatcatctgctatgaagcttagtatatctgaattttatctaagccttattttaaatacaacctatataatatgaaatttaatattaaaagaataaataaaaagaaaccagaaaaatattttc

SEQ ID NO: 478323 - DNA, 569 bp, Homo sapiens
tgaacacttcagtcctgttgcttcgctctctctgagaagtactatgaaggccgctgagaaggctgcagaagaaaaattggaagctagcaggggttggtttacaagatttaaagaaagaagccacaaccatgccataaaaatgcaaggtgacgcagcaagtgctgatccaaccaagattactgatgaagatggctccactaaacaacagattttcgatgtagatgagacggccctctgttggaagaagatgctgtctaggactagctacagagaagtcaatgcctgccttcagaacttcaaaatacagaagtgcaacagcagacacatgactataaaagctgtttggccgccaagaagggaaaactctccattgttcacatcaaatgtggtcatcaaggataacgaacaggaaggaccttccaggggaaaatgcagggacctgtggacaatgtggaagagggtgtttctgagtcactattaacatgtgcatggaaccaggaaatttaaatgaattgctgtaatctgtccacctttgtacaccagctcaaaatgccagtctgttaaaagtc

SEQ ID NO: 478324 - DNA, 773 bp, Homo sapiens
tgattgtgaggcctccccagccatgtggatctgtgagatcattaaatctctttcctttataaattactcagtcttggctgctgggagctgggggaggggtgacacaacactcctgtggccaccatcactgggaccgtactgggtcagacctgaagccaggacagcactcggtctgatccaaggcccatggcaaacactgcctcattactgccaatgttcactcaaggcccaatggctcttctatcagcatatggtgaatctagccagacttgtgtccttccttgagggtaagaagctccccctggcccagtgtctgtccagagatgctgtctgggagcctgggcctaaagtcaggaaccttgagattctactggtgctctattctactgtgactgagctggcacccatgctacaagacaaagtccttcccactcttctctttcctttcctcaggcagaagaaatctctccccatggccactgctaccacaggcttacataagcttgtggcaaatacttccatgcctgttctctcctctattccagggtgggcccagaaaagcccatagatgagacaaggcctggaattggtgaccgcaggagcccactttgtgctctaccccactgtggctgatctggtacccaacctaacactcaaaatctgaatatgtgttcacattatggtgctgcatatgtcccataggctttctttattctttttttattcttttctttttatccttttcttttctttgggacagggggttgactcgg

SEQ ID NO: 478325 - DNA, 556 bp, Homo sapiens
tgcaaacacaagcattttgccatggtatcttctggctttagggttttagctgaaatgtctgctgttagcctgatgagcttccctttggcaagtaaagcaaacctgctaatgcagacatgcaccggcaaagtgatgtggggagttgccatgggctcaggagaagctacagtatggggaggaaatatgtgggtctggtgtgcagccataggggccaccttgcttctgctggtacagaagctgccctatggcttgctgtcccaccacttctctaagcatctctctctgccacctcaaatgtccatagtggtcaaggggttccctcctgctggaggtccagagtcctgtggtgagagtgggttgctccttgtcagttcaactcacccatactccctgagctgttgtggttcaaaaatgagtcccaatgcacaatagcctgttgtgtgagtttcccagctttctcacccttcagcccagcttctgtgtctcccctccgtctacttgaagtgccttccctctgaagatcttttaaaagcacaccagttgactcagtcccttc

SEQ ID NO: 478326 - DNA, 773 bp, Homo sapiens
acccccatcatagagcctgacagttctgaggcacgagtcctcaaccactgggccacagactcgtacttatccatggcctgctaggaaccaggccccatagaaggtgaacggcaggcgaggcgtgcgacagggggagcggctcgctgcttcagtgccccgctgctcaaagctctagaggggcatacagacgggcaggctgcggggctcccgccccacgtctcggggtggacgttgacagctccggaagccgcagtgggcatgtgctaccatgtgctcttttagttttgccgtctgtaggcggcttgtgttaacctgctcggttagatcctccaccttgtctcaaggacagagggctttcctggaagtagctcagcgaaagtcagaagtgggtagagtgggagggctttcctcgggagctgggccactcggtggcctgggctttcctcggactgccccagccaaactctgcattgttctccttctgctggttggtggcctgctggcgcctgccggtgcatggccaagggtattcatgaaggatatccataaagaccatgccagtgatggagcctccagatctgctgcctgcaagctaaaacacagaaaagaaaatttaagtggttgggaatcagaatgtgagatggattggaagccaaattataagcttatttcaactcttggcctgcaggcgctgaagtaacattatttgttgtcggggacagaaaacaactcagattcgggtccaagtgattattccacttaggcattgctgc

SEQ ID NO: 478327 - DNA, 604 bp, Homo sapiens
cctcgtcttagttccgcacagtgtggacagccgtcagcatgacctcattcttcttggacgctggacaagagctcaggacccaccaagcaggggtacccagtagggctggtgacatgcctggtctggccgcaggccctgcatggagtttgctcctgtgtcagcactcaaagcagcccactggaccctgcacttgcttactcacatgctccctcccaccaggggctgagcacgtgggccaagtagatgaggctccccctgctgcaaatctcccacttttgaagtccatgccgtcatactgctttgaatcccataccatcagactatgtcacccactacctctcgttgctgaagtcatcaacctgggtcaagtatattgtaagcctcctcctcacttgcatattcttctctttattcgccttatttgtgaaaatcataagtctggctgaacactcgcattgctctgctctgctcctgcatctgtgccgctgagcctgactcacacatactcatactacatggtctcactttaaattcatgaccacaatcctcaagcaggcctttaatactgccggtcattatactatatttccctacttcacatatt

SEQ ID NO: 478328 - DNA, 1959 bp, Homo sapiens
tttagctttccttggagccctgctgttctgacaattaggtcctaagactggtggataccagtcactggatttaaagcgcactctaaatccaggatgattttatcccaacaaccgtaactaattacatctacaaagacaccatttccaaacaagttatattctgagtttccaggtagacatgaattttggagggacactattcaacccgatatagatggtcgctttatgtcaggagctatttgtgctcaacttaccaccagtgatggaatccttattgccagcgaggtggcaagtgacccagttcccaagcctcgtattacattttcacctacccaactttatcagttggtctctccaggaagcagaccctgagactgttgagcctgcagattgtttattaggaaatgctccctggtcaacgcctgtggaaggccagggggagatgccaaattgggcagtgggagaagtgaagctgcagccaccccaggcaaccgcagagggagttttggagctaaaatcgctggtggcaaccgtatgcttgcatgatcctgagagtgagggcctccttaaatgtgaagccccaggcacctccttgactcacccaggtcctgacgcttctgagcatacactttcaactctaataattgcttcagaaattgtccctctgcatgttggaaccaatttatggtctcatcagcaatgccaccccagcttggcattcatcattgccttccccgggcagttttcagtttcctacaatgtctcatactgcctgtcacacccagtgacagcctgttatagtcgggtgggcagcactaaatggctgctccctggctcagccccatccgtcagtgcctttcccctgcatctctgctccagcaccgcccttcctggggatcctcaggcttggcagaggaaaaacagggctgatagagacagagaaagagagagaaacaggaatgtcttggggtgagatttttactttattggtgataaaccaactgtgaaaagttagaaaggagaattttagcaacatgttgaagaggggagttctttaaagggaatataggaaaagcttcataattttattgatatacttgaatttaattttaaaagtaaggacagtagtactcttgcatcaaaatgcagaagatttatttaacgctgtgtatcccacccctgtaggtgttaggaatgcccccgtgaggaagaggaagtgaactgaggtgactacgtggtggcaaaagtcaggaaattagcagagttagggtttgtgtcctccctcctacccaggaagggattagcactgactcatttcgtaaacatttatttagcaacttctgtatgccaagagttatcctccatgctggaatatagcagaggctgaaacagatgaggctaaatcttttatgtctgggattttactgctttcatggaacttaaattggcttgttagggcatggaggaggttaatggccagaaacagacagaaagacacatgataatgaaaataaataaatagttacatgtcagttactgttaaatgctaagtgtcatagtccactttgtattgctataacagaacacaatagatgataatttatttataaagtaaatttattcttcacagttctagaggtaggggcatctggtgagggccttcctgctgcatcatctcatggcagaaggtgaaaagatcagagagtatgagagtgcaagtgagcaagaggaagccaaacttgctttgataacaagcccactcttaagataactaacacactcctgtgataatgacattaatccatgaggactctcccttcatgacctcatcatctcttattcagccccacttcccaacgctgtggcattggggattacgtttacaacacatgaactttagggaatacctttaaaccatagcaccgtgtaatgatttttaaaaggtgatgtgaaagcaat

SEQ ID NO: 478329 - DNA, 569 bp, Homo sapiens
ctgacatgcccgggtattgatgaggttatggaacggaggttatggaaagctcttatatcctggagctgatttctacccacaagcacctgagtttggaagcagaggcttccctctttgagcctcagatgatgcttcagcccaaaggaacacctttatttcagccttggagaagacccagattcctgacccacggaaactgtgagtcaggtccctcagctgcaggtctgttggagtttgctggaggtccactccagaccctgtttgcctgggtatcaccagtggaggctgtagaacagcaaatattgcacaacagcaaatattgctgcctgatctttcctctggaagcttcgtcccagaggggcacccacctatatgaggtgtcagtcagcccctactgggagcctcagcaatggcagatgcccctcaccctgccaggcttctgcctcgccggtcaatctcagactgctgcgctagcagtgagcaaggctccatgggtgtgggacctgccgagccaggcgcaggatataatctcctggggtgccatttgctaagaccactggaaaagtgcc

SEQ ID NO: 478330 - DNA, 1320 bp, Homo sapiens
gacagtaaacatcacatataggttcagcaactgctgttacgagatgttgttcgcaaccactgtgaaaacgacctgtttgcgtggttcgccaaatccagagaacatcttcacacacaagtactgtgggaacggtgtgtttgaggaaggagaggagtgtgactgtggatccttattcttgtgtactcaagatctgtgttgtttggcaaactgtactctgaaacctggggctgcttgcgcttttggactttgttgcaaagactgccagtttcttccatcaggacactggtgtagagaaaagcacaatgaatgtgatctttcagagtggtgcgacggaactttgcataattgtccagaagatgtgtatgtgcaggatggccttggtagcatggacagtggctaccgctgtcaaaaggcatgtagaaaccatgatggacagcgtaaacacatttttgagaaggtagccaagagtgcaaatcagagttgctacagggtgaacaccgacggtgactgtttggccactgtggtttcaataacactaaatatgtaagatgtaatatttcagatatcctgtgtgggagagttcagtgtgagaatgtgacagaaattcccattccgagagatcattctatgatgcactgggctcacttcaacggcatcaactgctggagtactgactaccattttggaatgaccgtacctgatattggtgaaattaaagatggcacagagtgtggttcaaaacatgtgtgtacacataggaagtgtgtccctctgccatttgaggaaagtacttgctcacctgagacctgtaatatgagaggcatctgcaacaataaacatcgtcattgcaattataagtgggccccaccctactgcctgttaaaaggcacaggaggaagtgttgacagtggcccatcccctaggaaaaaaacaaaactatgattgcacaagaaaattttgttgatactacttttattaattcctgtgtgtctctgtttacatttgttaattttgcttagtaagagccaaaaaccacatcagaaagaagagcaaaatgttcaaacttcacctgagaaagaaaagcaaaacgttcagactccatctgagacagaataggaaatttttacaatttcagaaaagaaactcaatccttaatgaaatatcctgtgtattaatttttagttcctggcagtagaaatgttattgccggtgtcagagaccactgacagaaaaacccagagatctatcatgtttcaggattaacaatcaccattaaagaaagatataaacagaagagctaataattagttttatgtttat

SEQ ID NO: 478331 - DNA, 704 bp, Homo sapiens
gacatcactactctcgtaatgaagacggcagatatcctacgcacctgacttacaagataagctatgcagccttggataaatagctcaacgcctctgaacttcgatttagttacttcaaaagtgatccaaatagctagtttagctgcccgtgggcaacaaagtgaggctctgtctcaaaaaagaaaagaagaagaagaagaagaagaagaagaagaagaagaagaagaagaagaagaagaagaagaagaagaagaagaagaagaagaagaagaagaagaagaaaagctacataggtgctaccctccagaagtaaatatgaccatctacattcatgaggaatcaattttgttaagcctgctggaagaacacaggacccaaggctgtcaaccatgctcaagcctggttgtctctgacttggatgttattgtgtgtgagtccagcacattacacaaagtggtcactgatttaaagcttagagaaatgagacacaagacaaagagcattttgatagactttccttttgaatctacatcgcatgttccccctcaatccctgccttctgaaacagggaatgcctagaagtgcttgtagttttaccgactttgagatgccgggagagatttctttcctattttcagactccttttttcatattacttcagcttgctgctgattctgctagtattctttgaaacaattttaac

SEQ ID NO: 478332 - DNA, 894 bp, Homo sapiens
tatcaagttaaaactagggacatggatgaagctggaaaccatcattctcagcaaactatcacaagatcagaaaaccaaacattgcatgttctcactcataagtgggagttgaacaatgagaatatgtggacacagggaggggaacatcatatactggggcctgtcgggggaagggggtctacgggagggataacattaggagaaatatctaatgtagatgatgggtggatgggttcagcaaaacaccagggctcgtgtatacctgctatatacgaacagtctagaggcatttcaaataataaggaaagtgtttccaaaatgatgaagaccacagacagcaacacatatattaataattatcaaaccctgcctctgtccctcatatcctcagcaacactttacaataactgtaacttctctataatttcaattccatgcatcccatgtggtaatcaccactgtggtctttccattccactgtcagtgtagtggacagtccgatttgaatattaactactgccaaagttcagtcacgggttagaagggtggccactgaaatatgggttgttaaaataatgcttttgtttggtatgaggacttcctctcttaaatggtgatatcacacaaatgactaagtcactttatttgaattaaaaaattacccacttggtgcctggattttttattaagtaacctctgactatctttatttcctcatgtgaaaaatgcaatcaatgccagtaatcataattattgaataagttaatgtgtatttagagtggtgcctgacacatagcaagcactttctcaaagcagtttattttttattaataaaatgaaagctgtatgcatacaaagagtatttagtgaattttaacaaactcattttatttg

SEQ ID NO: 478333 - DNA, 1593 bp, Homo sapiens
caggactgggtgttgctctgggagagtgagtgacaaagaatgtgtttgcttagtgcttgctttaatagcagtggggatcctaaactcagtgttcctcaactacagtgcaaattcactgtgtttgtagcatccacgtgggtcatacaccatcacttctatgggacatgtggatgtgatttgcatttcggtgtttgtttagggggaatttcacattggaattctgctgagtggttagaatttgctgcagtgacgaacagtgttgctgcagatgcagcctcgcagcacccagcttcagctgccttgcttatgttttgttttttcctgctggcttctccattccgcccctgtgaacttggaccaatggggtgggagccaagcgggctgccggatgaaagtgaccgatctttaaacttcaaagcaccagaaaagatggacatggatgaaattggaaagcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagcacaccagcatggcacatgtatacatatgtaactaacctgcacaatgtgcacatgtaccctaaaacttaaagtacagtaaaaaaaaaaaaaaaaaaagacatacccaagactggaaagaaaaataggtttaatggactcacagttccacgtggcttattttccctctttattacctgttttgttcttgactttgcttttttctgtcattagcatatcatagagagatctagttattttagtacacgcacaccttctgcattctgtttctacaagtgtctaatattccatggtgtagaagtactttattcagtcagtccaatatttttgggaacttggattatgtctagactttttctactacaaacaatgcccacaatgaaaaatcttgcacattttattctacaagtgtgccatcatctgcaaataaagttttatcttttccagtttttaaaaagttgtattttgttttaaattgacacataattgtacatatttatggggtagagggtgatgtttctatacatgaatacattatgtagtgatcaaatcagggtagttagcatactcatgacctcacaaatttatcatttctttgtgtgagtttttattatctgcaggaaagttacaccattctttttcatcactttcttactgagtttgacaaaactctctcaataaataaaatatcagataaaaaatcgcttcccttaagccttctttattggctcctcttcccctgcctttcctggaatggttggacgtctgtagaattctgcctagatcctcccgatttgctcatttttacttcgggaatgtatgagtctcctttcatgtgtgccttatccaatgcagcagccctcaatatctgcctacctcttcagctaagatcatgtcaaattttacttttttagtttgcattagttgtattgactatgtttt

SEQ ID NO: 478334 - DNA, 938 bp, Homo sapiens
tttaatctttacaacacccttttgagtctcaagactttggaaaggggcgcttaggctattttggtctgtatttggcaccagggaagcgagactcgctgtccaatccgtctgtcattgtttctgtcatttagggttccgagaagcggcaaagctaatgctctgaaggaggaaaagaaatatgttgcgatgttctcaagacgtatatcaaagatgtttcagtccccagatgacgaatcagaaaaagacaccagttcaacagggagaatatgagttttcttttggccctactggatttgaagtgagaatacagtgtccatataaagcttctcaatctcagataaacaaagagcagagtgagtgtgacctatcaatacccattcttcacgttgaccatctgaagaagacagactgcgttcatgaagaaggacgaataatgctcagaaaagagggtgaagatattatagactacactgatgaatatgacctttggggacctcaccaaaagctggggcaagaagtttcctattttaacatgctgttagatactgttatttccaaagagctagatgtatccttagcaaaggtcctccactctttctgccaagatctcagtctatgaacaatgaagcttaaatgagattaccaaacatatactacttatatattaaaggtattgatttcattttgactgtaattgaaattagtatagtgaagtagtgcgtctttattagactgacaaagttttaattctggccccatgatttataagttatgacccttgggcaagtgaattaatcactgtgtaaaatcatgataatggtctgcttcatactgttttcatggagattaagagttaaaatatgtgaatatgtgttaatcatgtcaagtaaatagtaccaattcaatacaaccttttccagaaaatctttccaaagaaa

SEQ ID NO: 478335 - DNA, 730 bp, Homo sapiens
aggggcagcagtgttgatggaaaggaacaaagaaactggaaatttaagaatttagaattggtaaggcttgtatctgattagatgaaccagttgatccctccatccttggccactgttcttgaaaacaaaagtgaattgactccctttttctctagaatgatttgctccagaacaaagtttaattctttatgtatgaagacccataattgtttctatcaccctgcctacatattcctaactagtaaggattggtaccagttcttctttgtacaactggtagaaattgactatgaattcactggtccaaggttgcttggggttgattctgaattctatgtctgtcatttcagagattttagactggttaagaaatcattgctgggagctagtagactcatttggagatcagtggtcctcaacctttttggtgccaggactggtttcatggaagacaatttttccacggaccagggagtcaggaaaggatggttctgggatgaaactgttccatctcagatcatcaggcattagttagtatattagcccattttcacactgctacagcgagctgcccgagactggaaaatttgtaaaggaaagaggtttaattgactcacagttcagtatggctggggagacctcagaaaacttacaatcctgggggaaggcaaaggggaagcaaggcaccttctttacaaggcagcaggaaggagaatgaacacaggaggag

SEQ ID NO: 478336 - DNA, 568 bp, Homo sapiens
gattttcaaaggggagggagtgtacaaataggggtacatgtgcacaatgtgcacgttagttacatatgtatacatatatcatgctggtgtgctgcacccattaactcgtcatttagcattagatgttctgggatatgggactcccttggacagaggccaggcctggaaaataggccgcacttcttctggactagccctacaaagggatggcttccctgctcccttgttggcccataagcccatgtttctcaaccctgtcagtattctgagagtgagggctcctttcctgctcaagtgtcaggcacagatcttagctcagtactctggagctgtgcactgcaaccctgaggcacaggaaccagctcatagttatttttttctggccccttgggataaggcaggggccctgggaagagctgtctggcaggagggcctaaggaacagatgtaccctagtcatctggaagaaaggatatcactgactgaagatcaaattaatgaaatgaagtgagaagacaagattagagaaaaaagagtaaaaagaaatgaacaaagcctccaaaacatat

SEQ ID NO: 478337 - DNA, 589 bp, Homo sapiens
agagctttcatgaaacccctatgcataaatacaatgtttttttctgtcattcaggacacaacaggtaataagaaccctgccattcagagtggagcagtagaccactttgtgaaaccatgccacagaattgtaaaacctactatgccattattagcccatcatgtttctatagacaaaataatacccactttattgaatggagttttcagcaagaagacaggtggtatgatcaccagcatccatgtcacgaggacccttgaccatcctgaggccagcatccatgtcatgaggacctttgagcatcctgtagagtggttcatgtggcaaagagccaaggcctaccagcaagcaatactcatggaagctgacagtttcatgagtattgaaaacagacacaaaccacgtgggtcagagataaagggcatcattactcattgaaaagcggcatgagcagggtatttgtgtaatacctctttacccacaagtagcataggggtgaagtgaagaagctcaaataagtgcttgcacatgcagtagcttcagtgcaggagagaaactctaagcttagggagcacacattatttttaac

SEQ ID NO: 478338 - DNA, 2250 bp, Homo sapiens
gcttgttttggtcgggtttgtcaaagatccgatggttgtagatgtgtggtgttatttctgaggcctctgttcttatggtgctctcatgcattggtggtcatttaatggttgctacagtgtggaaacacaatggaacagtgatagatgatgagattataaagaaactgataggacagaggcttgtgaaggcacaggaggaaagttgtccagaaatagacaaacgttcttccagaaaggcttttcctgacttagtttgtgatatagtcttccttcagtgcttccaatcaaaaggcactgtatctcagaataacaacagtaacaatgacaagacagagccaactattggtaaaaatgttgaacaaactgaattttcatacacagtcatgaagaatgcaaattggtaccaccgctttaaaaagctattggcagtgtctcccgaagctgagaatctgaacatttgcataacttaagacctagtaattcctttcttatgtaattcccaggaaaagtaaagctcatttatattcatatgcccataaaaagacatactctggaatcttcatggcaacactattaacaattacctacaattttaaactatatgaatgcaaattaaaagtagaatggaaaatgcatgttgatatattcatacagttaaatgctatgcaataatgagaatgaaagagctaaaattacatgaaataataaaatggttagatctcacaaagaatgttgaggggaacaagacaatcgtagaaaatgcacactataagattccatttatataaacttaaaacaaaacccaacacaactgatatatggtgtcatcattccgaatagtgtttggtttctatttagtggactgtgacagaattggagatctggaatgagagtttcttgagggaaaaaaacttgtctgtttcagctttgcattttcagttctcagaacaatgtatggcacatgtttcagggtgaatgaccacatgattaattgaatgaatggattgatttataaacccatcaatggcaaagatcatgaagaacccaaatgttttcttggtgcctgcttttctactggcattttgtttgcttacctttgtgtttcccttgatccttccacaactttatgaatttatttagtcatccctattcacattttataaaggataaaactgagtctaagggataagaagtgaggtacccactaaaagaaaagcagtaaacattggaactccaattaaagtacaacattccaccttcagaatataaatttcatagtagtaacatagtatattagtacagtatataataactatatgtatgaataggctctcacaggtgagagccaaatgtgtcaataaatacaaacatactttgagtattaaaatccctataaaaatgttataatgccttcccacctctatattctgatatgtgagggcactcatcaggatttgttttctttatcttactctattatagtatttggcatccattaagaaaatacaaaataccaaatggtctccagcttttatataattaaactttcctgaacacacagagccagctcgagtcatctcctcatctgatcttccataattacatacactacttatatttatttatcatatactgctttaaaaaaaattattcatgggttcttggaaagcagggagaatacttctcatagacctgtgcctctcatcaaactttgcctggatttccagaaaataagtgctcttaaattgttgtcactcaagatactttttaaagactcaataatacagctttttcatatttttattaaaaataaaaagtgtctattcagatgtatatattttgtcctttcttttttttattttgaagcaaagaacaaaacagctgaaatagctgtggaactcagtgtttaataaaactgattataaatctgagctagtactaagcatttttatgccaagtaaaaatattctttagaaagttctcaagtaagcatattaggcacatcacagaaatatattgctgctttggactgtttcacatcattttcaaacttttcctgagcacctaattgtatatgatgctgtattacattatgttacagacaactgcacatatccaatcccagcacagctagagttgggacaactttgaaactagtattcaccaaagaatattgattctgataatttgtaacatcttacaaatcttattagtacaagtgctagaagagtatgtccctttaataagctc

SEQ ID NO: 478339 - DNA, 634 bp, Homo sapiens
tgtaggctacggacagcgatatctaagctggatgtgtcactgtttttagtcttatgccatgtacattatgactaaagagcataataaatctaatttcatttttctacatgtggtggacaattatagcacaaggcaaaggagaagcaagcacctgcttcacaaggcggcaggaaagagagagcgcaaggaagtaccacattttaaaaccatcaggtctcctgaaaactcaatcactaccaggagaacagcatgggggagactgccccctgatccaatcacctccaaccaagtccttcccttgacactgttacaatgtgcatttcccatgtcagccagaggctactgcctgaaggtctctgacagaaatcagtgtgctcaaaatgctgccaggccccaagcaggaaaggtacatacctctgtgtaccctgtggagcacccagagctgccaggaacaaacgagtatgagagaaaaatgctagtcacagagggtcaaccaccactacatttttctcaaaaagatctgtctgcatagccagttctgctacactgccaacttaatttgggcatctcttagtgtggttgagcctaatgtgcactttatgtttcccttgtatagatctctttggagaccttc

SEQ ID NO: 478340 - DNA, 603 bp, Homo sapiens
tctgggatttttataggcttataatgggggagaagacatatggatcttggagaatgacagtggattattgtaactttaaccaaggggtgactccaattgcagctgctgtaccagatgtggtttcattgcttgagcaaattaatacatctcctggtacctggtatgtagccattgacttggcaaatgcctttttctccattcccgcccataaggcccaccagaaacaatttgcctcagctgggaaggctagcaatatacctttattgtcctacctcgaagccataaagtgtgtcatgcacagcagcattccaccatcaaatggaagtgttatatatgtgatcaggcttgagcaggtcctgaaggcacaagacatccttgaaggagagtggggaagggacatcttcccagtgggcagagcttcaagcagtgcactggttgtgcactttgcatggaagaagaaatgtccagatgagctattatatactgattcatgggctgtagctggtggtttggctggatggtcagcgacttggaagaagcatgattggaaaattggtgacaaagaaatataggaaagagggaagtaagctttctgaacttcac

SEQ ID NO: 478341 - DNA, 631 bp, Homo sapiens
ccctgacagtgcctgtgcactccagttcccaccagcaaaggggtcagggaaatatcctgcttcagtttgggtcagttccctgtaatggttaatactgagtggcaacttgattggattgaaggatgcaaagtattgatcctgagtgtgtctttgaaggataagttgctgcatttggttcctcctaaaagcaagaaagaggcacgacacctagcgggcctatttggatttttgaagcaacacattcctcatttggttatgttactccagcgcatttatcaagtgatccaaaagactgccagttttgagtggggtccagaacaggagaaggctctgcaacaggtccaggctgctgtgcaagctgctctgccacttgagccatatgatccagcagttccaatggtgcttgaggtgtcagtgacagatagggatgctgtttggagccttttacaggcccctataggtgaatcacagcagaggcctctaggattttggagcaaagccctaccatcttctgcagataactactctcattttgagagacagctcttgttctgctactgggttttggtagaaactgaatgttgactatggatcatcaagtcaccatgcaacctgaactgcctatcataaa

SEQ ID NO: 478342 - DNA, 1044 bp, Homo sapiens
tctgttgtttcttgcataagagcatatacttcccagccatatggtcccaagagcctcttggctctatcaccaccatcaccatgaccaccaccaccaccaccatcaccaccaccaccaccaccaccaccatgaccatcaccaccaccaccaccaccatcaccaacaccaccaccaacaccaccaccaccaccatcaccaccaccaccaccaccaccaacaccaccaccaccaccatcaccatcaccaccaccaccaccaccaccaccaccatcatcaccaccaccatgaccatcaccaccaccatcaccaacaccaccaccaccaacaccaccaccaccaccatcaccatcaccaccaccaccaccaccaccaccatcatcaccaccaccatgaccatcaccaccaccatcaccaacaccaccaccaccaccatcaccaccaccaccatcaccaccatcaccaccatcaccaccatgaccatcaccaccatcaccaccaccaccaccaccatgaccatcaccaccaccaacaccactaccatcaccatgaccaccaccaccaccaccaccaccaccatcaccaccacgaccaccaccaccaccatcaccaccaccaccaccaccatcgccatgaccaccaccaccaccaccaccaccaccatgaccatcaccaccaccaccaccatgaccatcaccaccaccaccatgaccaccaccaccaccaccaccatgaccaccaccaccatcacctccatcaccaacaccaccaccaccaccaccatgacaccaccaccaccaacaccaccaccatgaccatcaccaccatcaccaccatgaccatcaccaccaccaccaccaccaccaccaccaccatgaccatcacaaccaccaccatgaccatcatcaccaccaccacaatgaccatcaccaccatgaccaccatgaccaccaccaccatcaccaccaccaccatcaccaacaccaccatcaccatgaccatcaccaccaccaccaccataccatcaccaccatcatcaccaccatg

SEQ ID NO: 478343 - DNA, 709 bp, Homo sapiens
agagcagagcccacacctgctatgccacaagaggccctggatgccatggaggcgcaagggcccaggcgggacttgcagaatgagagtcctaggcccaagtatagagtccctggtgggcacagaggagagaccaggtggaaagtagacttcactactgtgggagtgggggcattcctggacacagggggaaaccagctcacagaacagcctggggtcttcttggaggaggccattttggcccagatcctaaaggaagactggaagcctcagggggcagaaatcaaccgtggaaacacacggaccctgccctcccggcgccagtgttctgggtggtcaggaggtgaagaaaccagcaagaaccagcacaggaatccgacggtggcaacgcgagataaccaagcttggaggcgaagtagagctacaaaggctcccatagataaagccagcttcttgaaaatggcggtcttgagattcacgaaggctctggaccagaaacgggacaaggcccacgggacagatgaaccaaggttcggttgtcccacctgagctcctcccctccacctccctcactccacgtttggagtcattccacagcttcctaaaccacccacccaggcaaccccatccccctacccacccatccacccaccaactcaccctcaacctcccatccacccatcctctcactcacctgcccacccactaaccc

SEQ ID NO: 478344 - DNA, 738 bp, Homo sapiens
gaggcctgctgtgtcttcctgtgaaaggcattttcttcccctcctctgtgataacatttggatcctgaaatgaggacaaatagaggagagtcaaatgaccagatctacagctaccataattcagcagtgaggctatacttcctgggcattttcttaatttcctcttcttcctcctcccctccctctccccctcctcctccccctcctcctccccctcctcctccccctcctcctccccctcctcctccccctcctcctccccctcctcctccccctcctcctcctcctctttctcctcctcctcctcctcctcctttcctggtggattctgctctgtcagggtcatacactggggccatagaaagctgtcttcaagaacgcttccaagccctggaaaggaacttgcagaccttcagtcaattagttctgaacctaacaactggcccaggactagaaatggatcaagtaccatctcagctgagttatgttgtcacttagcactgtttattactctgatggacaacatgggaggaggggtggagattctgaggggcacacaggtcatcttttcagtcagtagtatcacttatcataatttgtttttactttattaaagctcaattaactagatatataattacacaaaataggtcttcaaattatgtttgtgtttatatacaattattgttgagatattaataaaaaagtaaagcaaatataaatctggatttggggaaa

SEQ ID NO: 478345 - DNA, 2197 bp, Homo sapiens
atatgctagtgaaaatcaaccctctttttccctgtcgccgtccacgtaagatgtgacttgctcctccatgccttccaccatgattatgaggcctctccagccatgtggagctgtaagtccactaaacccttttttctgcataacttacccagtcttggaagaagacaggacaatgtgggaaagtttggaacttcctagagacttgttgaatggctttgcccaaaatgctgatagtgatatgaacaataaagcccagactgaggtggtctcagatggaaatgaggaacttgttgggaaagtccctactggggcaatgcctactggagctgtgagaagaggaccactgtcctccagaccccagaatggtagatccaccaacagcttgcaccatgtgcctgtaaaagttgcagacactcaacaccagaccatgaaagcagcttggaggaaggaagtagcccgcaaagccacagggtcggaggtgcccaagacagtgggaacccacctcttgatcagtgtgacccagataatgttattcagccttaaaaagaaaggaaatttgaaaacatgcgataacaaagatgaatcttgaaaacattatgctaggtgaaatgggacagtcatgaatgaatacactatttgtatatatacttttatactgttgtgctatatatatgtatatgtacctgttgtagtataaaagtacctgttaccactgaactgtgcacttaaacatggtttaaatggtgaatcttaagtattttgcttttaaagtacctttaagtttgcaaagtactttaagtactttaagaattttatgtatattttaccacagtttttttaaaacaacaaaagaacaatgttgtctctaattacgtcagacatcatatagcataccatatgatacccttcagcttcagcaagtaatgacggggtccaagattcagtaattgttaaatgtactaccctggtgattttgatgaagagaataaattaggggaaaattgtgatagtggaaaatatcttcagtagcatttgtcccaagagtctagtataaattaatatagttctactctgtcactacaaatttaacatgttttaatttaccccaaaatgctacaagctgcttattgaatcacttctctgaggcacttataccaaaaagtgacattctatttttcatcgaccttacctcacccatccaacttcacttggaattgggtagctgtaagcttttccttgactttataataccaggattatttttgcaatatttttcccattagcaggcattcttacctaaaaaacaggactcaccaacaaaagtgaaccttatagccaagtctgtataccacagccatggatgtttagatcacatggggaatgtaaccagtgtgatccaaactgagacaatcagatgttttcttttttggaagatagtggctgaaatttacaaatgttagaaaatcatagtctttatactggaatcagcatgatgcccataggtttattcctcattggctttctaacaatgagatcgcaagcttttccaggtcatgtagaactatgccaagtctctgacttttatacttcacccaaacttttaaatctatttttttttcattaaattaagcactcttctgtgttttcccatcctactcaaatcaatatataatcaccagttgatttataaaaggactgaagaaagtttttttgggaaacttatgccagggaggttgctgtatttcttcggaaaatatgggagtgcaggcctgagaataaggagagggaaaaaacataaatctggcacaatggtaaatggttgtctccttatataaaaagccttattccaggatctcaactctgacatattttgaataaattttattaatatcacagtaattgatgtaaggaagggcttagtttcatgcagtgggtgatcataacatatagcacattatggctaagaacaagagagcaaaggatttaaaatgtttatgttccttggaaattaaaggaaatggctaaaggctttggattgcacagctgatggcactggcaaaaggtaccgtggcagtgtctagctatatcaaatttgcaatttggttcctatttaacgtcctttttgggaatatgtaaatttgcaacacgcaactgcattttcctttaatcaggactctgaaactcatctagtagtacc

SEQ ID NO: 478346 - DNA, 627 bp, Homo sapiens
actgaatactgtaggtgattggaacacaatggaaagtattttctttgctgcagtttgcatctgctctctagcaagaaatggaattgaaaaaggaattggtggcagtgacagtggctggacttattactggagaaaaggcttcggggatcttcttgttcttgtcttcccaatagtaggagttttagataagaagatctttcttggtgtcagcccacaagcagccatggcagaactggggtctagggaacaggttctgaaagcagctgtggagccaagttcctgggctctggattatacaactactgtagtacctaagggacattccaacagctacagccctgaaggctggggtgtagttgtgattcagaccactgggagcagggtgctttgccatggcactggggaagaaggagtgctttggaggctttgtacctggggaacaaggcacagctgcaattcaagacctgggactaacaggtcacagtggcaacttgggctctggggaataaggtaccatgcagtggtgactctggatcctgggataatggtacacaaaaacagtactggctttgtagggccaggtacaacaacaggttgtaaatgaagaaataaaaaaactttctattt

SEQ ID NO: 478347 - DNA, 1629 bp, Homo sapiens
caggaagctgcggtgtatatctgctcattccagtgccacatagaattgacagtgcttcctgtcaggaactttctgacattcccttggccagagaatgttctcaggccaagagacacagagagctgaggactgcgggcaggtagcccgaggggatgtgaatgggacaccgacagcatctgctagctttggcagatgggagctagggccactccatgctaagggacagcatgaacaaaatgaaggagaagatgggttgagtgaggagctcgccaagctttgctccagagggagagagtatttgaaattgggactatctgcaaaaatcaccaaatatatgaagggcagcaaggaaactctaagaggggaaaatgggcagcacaccggcctgggccggcagttggacaatggtgaccggatgagtggccagtcatggttccactcaatgctggtgaatgaactatcccctggcagtttgcaaagctcaggtccacagctgactgtggaactggaagtgccacagcacccacccctgccgccaagccgtgccccacttctgctgctaaatggagaaaggatggagcctacattagaaaccagagacctggcaaagtgggtgggacaggaggttcctggcaagcgacagacagaactacagaatgccgtaagagaaaggaaggtgatgaggcctgctcaagagcatttggctgatgggggctgaaacctctcactgcaaccaggttcatttggctccaagtcctgtgtgctctttatgaagtcatagcaaggcctggactagggtgagaaaggacaggtgcctgtgaggcaggacttaaaggaggcgctggccctcaggggcatgcgagggcagggtgagcacctgagagtgagggcctccttaaagtctgtggtccagggtcctttggtcccctaatcccagagcagaaaagaaagccttcaaatccagctgctgcctgaagagcctcagactcactcccctggggcagcaaagtgcatttctttacccacaaggccctgtagtgctgactggaagatggggctgtcagggactcatgggaaagaatggcacattggatacaaactcattcggcttagttttaccctgtggctgcccctgtagtgtcatttgtgacaccaggaatatgttccataccaaccgaatagcttctcttcctattcgtgccagtgcatggaactatataatcattcatctattcattaattcatttatttgtagccttcctctttatataggcttagagagccactactcgaagccaagccttacgtcaggcagcagagataccaagatgaggttgaagaaaacacacggctttctccactcatggactccaatgaggatggcaacaacatgggctgagacttgaccttgtgactccagcctaggattatataaggatgtgactgaccttagaggatttcacgggaacttagctgtacacgtggaacccatttatttgctgacacttctcatttcctttcagaacaaacctacattcccagacctataattttcttgagaaaatgggtttattataagtcactcaataaaacaccctaccatggcttcccagtacaaaccctagtttc

SEQ ID NO: 478348 - DNA, 998 bp, Homo sapiens
gcaataatcctttaggctattgttagcttgtcttggctctgcaggctcttttttggttacatatgaactttaaagtagttttttccaattctgtgaagaaagtcaatggtagcgcccctctgctgcaggtctgctggagtttcctggaggtccactccagaccccatttgcctgggtattaccagcagaagctgcagaacagcaaagattgctgcctgttctttcctttggaagcttcatcctggaggggcatctgccagatgccagccagagctttcctgtatgacgtgtctgtcagcccctactgggaggtgtcttccagtcaaggatacaggggcatcagagccatcaggcagggacatttaagtctgctgaagcgtgcccatggctgccgcttcccccaggttttctgtcccagggagaagggggttttaatctataggttgactggggctgctgccttcttttcaaagatgccctaacccagagaggagaaatctggcagtctggccacagtagccttgctgagctgagtgggctccacccagtttgaacttccaggtggctttgtttacactggggggggggctgcgtcaatgattgtagtgctaattgttacagacatgaccacaatgccaaggcgaatggggacaatgaaatccatggctggttttaagggcaggtgcagaggatccagcatgttattctgaaaccccagaagacgctgcagctaccaaatagaaggagcctggatccctgaatgtcttcatggaacagaacattctcctcactccagtctgtttgaaccagaatatgacctgagcaagaaataagccttaattatatttgaccatagaattctggtgatatttctatggctgtaagtccatgttgattaatacaaagggatgctgtaaagcctcttctattaaaaaaagttgcccaaggagtgaaaggagagatattttctgtaattaagattttcataatacatagaa

SEQ ID NO: 478349 - DNA, 503 bp, Homo sapiens
cgtgcaaggcagtgggtggtggccctggctggctgcagatgttgagtcagctccataggaccgtctttgcaaatgtcatctcgtgcaagaacaataattatcctgtctgttgccagagagttttagcatttacaaagtgcctgaatacaccgagacttagaaatgattatctctgtgataatggatggagaaatggtgacttcgtgaggccaaataacttgctgaaagtcacacgatatgaggctgaatgcaaaccttctcctgctaggctcttcaaggccatgcagtcttcactatactgtggaaacctcacaataaatcctacaattcctccactaagaacggaatggattttaaacattaacttgggtgactgtgactcagcagggtctctatttccatgggatttgccttttaaaagatgttcgatagaaaatatttgtaatgtacagccaacaaagggcaagtatccaagatgtgtaagtaattcctaaaattcaata

SEQ ID NO: 478350 - DNA, 520 bp, Homo sapiens
ccaggtaaaaggagggcgtattcaaatggtattcccaccaccacatctcccagcacttcaccagttcccctggatgcagcagaattcacatgagcctgagagtcaggcagcatctctcgcctcacgctacagcgtggctatagcctatcacagtacaactcctcctggccttcagccaccaacagttattctgcaggactttctgagcggcactcagatcattttggtactgacaaacttccaggacaaagtgccctatggtggtagaaaatgtgagaaggtggcaatgaagcagagcactgttgctccgaaagttatgtaccatgccagaatgcaaatattctcacatccatataagttgcgaggcacgcgaggggaggtaggcaaggaacagagaatccacaaagtcactataggccttgtagactgctggtggactgcccgtgaccatccacggtgaagtgtgggagcctcatgctcttgggcaaggcccctccctgacatcagaaatccttagcat

SEQ ID NO: 478351 - DNA, 622 bp, Homo sapiens
attggggcctacaaacttcaatcttctgctctgccccactgcaatgaagaagagcagtgaatccaggactggaggagacgagagaattctagagctcactgcaaaagccgtgggtctgaatctcctcaatatctctgagtctgactctccctcctggtacatacccaattcaacaacaacgacgacaaagtacccttctaagttgggcaattctctttgggcaaaattatctgcagaaatcagaatttattcttcaatctcccctgacgaattaccccagtatttaaaaggcaggagaaaaatggtgctgcggacgtcagatgccaggggccctcctcagccccatggttcaggggtatccccccctaccagtaagacccagaggttccaaggaaatgagaggcaggcaagaatctgtgcaaatgttgtcgtatttaatatggtcaggttccctgggtgatccagtgcacaattttcttccccttataaataaacccagctgagcgtgcgtttgcagctcatcatcacttacagaagcgaatgagcatagcaatttattgtttcttattgcaggagttttcagagcagaaagttaaacttttatctgcacattcaagtgagg

SEQ ID NO: 478352 - DNA, 1533 bp, Homo sapiens
gccattcagtgccccaataactggtgcgcctggaactcaagccagatgttccggctttgggctccgggtctttcgcatccgtcttccagaagcccaggagtctccgtggagtcctgcatgttagaacttactagaggcaccatgcaagccaaatgtggaggagaggaaaggagtggagactgtcacccagggcaagatccatttggatgttgtcccaaagaggctgcctttccaggtcccccgcctctcgatcttcagtttgtgaagctgtcaatggaaactggatccaagtgtgacacccaggatgtcagagaatgcgacagcagcactggggacatgaatcacataatgccacacatcagcattgccagcagagccaggataacttggcagtgggcacggaaacaccgtctgggtcagaaggtgctaagaagagctggtgtgttatcattagcaaagtaacacacagattcaaccaaggctgctaataccaagttgccatgtcttccaccctctccttctgccctctaactgacctcaggcaatctctatttggcccaaacccaaacactacaagtttttggtgacatttgtattgagtcccctttctgcaactcaccagtgttggccactgtgaggccatggtagatgtgggcagggaactggagactccgggcccagtgggttcaacctcatgagggagtggagttgagatgctttggggatcagtgacacaacctcttacttggcttggggtgcaaacctagactccctgtcaccctggccttctcctctccaagagaaggagaactgtgggcatcgcagtggtgacacttcagttatcacaggctcagcagccaagtgaaaagatgatgttggaatttcctagatgattccattcatggattggccatgcagcagtccttagggatcccctcctaaaagtcacgatctacccaagaatccactgtgaatcgaccatccgccagtttctccaaacgttttaaagagcaatttgtattttcaacctgtctcacctcttggggataatgaattagacgagttgactacccactgtgtctcagcggccctttgggctggtgtctttagggaacagtctgtagccattcttatccttttccaagctgtcctcccagaactacatgcagggttcattctagcacagggctgccaactttctctgttctcacatagcctcttggcatcagcctggatttatctgcaccaggtggcatttgcacatgcagagggcctccctgatcctctgattacctggaggcctcattgcacaattcctcttccatgaaggtgtagaataaataggcctagagttgaacccaaaagaaagcaacctagaagtgaatagagaaaggacccgtttgctgttttgttagttgttgtccctaagctgttccctatcaatgacaaaatatttggcaccaaaggttcttaattttgaaagtaaccttgtcaaaagcttttgaaaaactaaatacaatttcctttcccact

SEQ ID NO: 478353 - DNA, 617 bp, Homo sapiens
accagcccagccaacatggtgaaactctgtctccaccaaaaaatacgaaaaccagtcaggcgtggtggcacgcacctgcaatcccaggcacttggcaggctgaggcaggagaatcagcttcctttagcatcctgccagcagcacatgccaggctcccagcttctttcagtacttctggaacctgctgtgtggtgcccacccttcaaaagtctttccttccagcagctgtgcaatgcaccacccctcagaaatctaagcactggcgaatctaaccagaaatctaaccacctacccttcgagctcctaagttgtgccagtaaaatgcagatgctaacaatcaaaactaacatgaccacagtgctggagcagggtcctgcaggagtcggctctgttgggggcatctccttggacagtgggagaagctcaggatgtcccagtggcagctgggatggccatgtgggcattcaggagctgggactggtgacttttgatgtcaagtagttcagaagcatctcattctctgagcaacttttatagccttcccaagtctatcctttcttttaatattctctacagatttttggctgccttttccagtcaataaatgggatgggttg

SEQ ID NO: 478354 - DNA, 529 bp, Homo sapiens
cctctgaagatgttaggagtgtgccagtcctcttcgtttctgcgtggaagctcttacacatggctgtgtcccgagtgcagcctgtggtttctactcctggggaccaccctttccctcacagtacaacttctatggaggccagcttgtcaccaggtcctgttgggtgaggtgctcagagtggggggacttcctgaagattcctctgcttctgctgccatgtccctcccctcagtagtgtccctgtgttcacaagaacgccgccacgtggcagcataccctgcccaccgcagagcaaattgcgacaaatgccaaggagagcttgattctgagatgcagcattgcaggaaatacgtgaatgtgcttaaccagtattccactctctttgcaaagagaggctcctctgctaagttggcaattacaccagcctcatatcctgtattatttgaagtgcgttgactgtaggagtctctgcatgtgtttagttcagatgaatttagtctaatgagttttctgattaccccactcttgc

SEQ ID NO: 478355 - DNA, 589 bp, Homo sapiens
ggagaaaggtggaaagggggccatatggggaggccacaggtaggttttctagtcaaaagcatcagcattggtttggcggacagccagcattcaccaccagacaagggagtggtgattccatgctcaaccctttgtgtcttccagctgaggccccaggctctcttgagagatgccataattatgaaaggccttatccctgctggcttcctgtgcacagcaaagcctaatgatgctgacaggtcatataagcttgcactaatgggctcatgttttatttattcaggtgctgatttgacattgcccagccccagtgaatctatggatttggaaataactgggttctctctccatactgtgatgttatctccaaaaatgaaggaaatgagaaacaggaaaggccttggattccctgcagatagctcccatagtttacaataagaattcaaatactacaaaaagcattaggcaacatttaaaacacaaatcaacagtgtttaatatgatatattgcaaagaaatttttggcaccgtgtaatgttagatctgaatttgagatctttctaacttcttgatataggtatttagcact

SEQ ID NO: 478356 - DNA, 744 bp, Homo sapiens
ccagcaacatttctgacaacaaatggttatgacctgattaagtgacagggactctcctgcctccgtggacaggaatggagtgtggaatcccagggtgccctcagattggcagaggagaaaatgaaggcttaaagaagtttaatgacctgtccagagccccagggttagtgggtgcttggagctgggacttatatccaggctcacctaatggcatagtaacgctgatcatatcagctccccactgccagggctatgctgacccatgccaaccaagactcaccttcagggcctttgagagtgaggaagtgtgctctgaatcttaccttttctcctgctgtcagccctgcgagggctcctggcagccctgggctgtgtgtcctcatcttccgcaagcaccaagcccatggcagctcaatgagaccttcatagaggctgtcggtcctcagcatttccctgcctgcaagcagattcccatcatccaaaggcgttagaaccagagggctctttaaaggcaatcctgttttacagataagaaactgaggcctaggcttagtagctcattcaaggtcatgcattgtctttctctataacagttattcatgttctagaaagaaactatgggcccactaagtgcattagctgtactctcattcttgaaatagcatcagactagcggacaatgtgatcaccagtcactgatgtgtgtgatgagaaagcttggtttgggaagtaggatggtcattt

SEQ ID NO: 478357 - DNA, 1077 bp, Homo sapiens
gactgagaaaaggacagaagacatagggctgcctctgtgccatcacagtgggtgataattgaagcagtgagatcacgcagttattcaaagataatgtacaggacaaaaaaaatcagacctatggtaaatcttagcatcagcagtttcaatggagtaaagggggaaaaagcagatttcaatgagatgaagaatgactggaaggagaaaataaaacagggggatgagatctggaggacaggaggtggagaaggagatgtgaacattagggaacaggttaactcttgtaacaaaaacaggaagacaagggtaaaaatggatgcagatgccatcagctggcagatgatcttggggtcaatggatttggctttaggggacaggaaggcagaagagcagagacctacagctgacaagctgactgacgttcataagggatgtcacagaaccaaattagcccacgtgctagtggaggaaaataatgcaagccaaaaagccatggaatgacactttaaaatgctgaaagaagaaaaaatgtcttacaatgtgcacatgtaccctaaaacttagataataataaaaaaaaaattaaaaaaaaaaaaaaagaaaaaatgtcttgtgttctatgttcatcaaacttttttttttaaaattggaggatcactgtcctccactgcctgttgtccaatgtctgaaaatagtcatcttctatgttttgggcaatgtttcagttgtttttagcaggagggaaattgttgagtgttttactctcttatgtttggaaatgtaagttccctatgtgtttttatttttctcttatttcccccatgtgacttgctaatttgaactcctcttctgctctgggaaactgttttaaactaaagtttaggactttatatttatttctatgaatgtccattttattttgcaccattatcctatcatatagagtcttttttaaattcgttacccataatgttaattctccttttcagttcttgccactctcaaactctttaatattacttcttggtaataattgaagtgtttgccaaaatgttattaagcaactgcagggtaatt

SEQ ID NO: 478358 - DNA, 1605 bp, Homo sapiens
catcccagcagtttcttcttgaatattagtgtatctggcaggctgggataagacaaggaatcgatgcatgtcgtctttcacggtgacttctcaatgtgcaagacacacagtcaagaatgcaactttcagggctacagctttcattggtaactttcaggtgtttcaggcagaaaggagttgcagtgtcaaagataggaaggctttccagtcctgcagaaatgacaactcacaggggcttaatgaactatgttggctgactttatgcagtgcgattgccaacacctttaccactcactcatataagacctttaaaatggttcttagtgtttggaagagccagtctcttagtagtcaatactgcattcctgaagagaatggacttaaaggaggagggcctgctggtgaatcctctgaacaatggtgtacaaaagaatgtggtgtggacgttattgagggggaagtcccactgttggtggggctgtggcctgtggacattaactgctgccagggttcgaataaaggacaggtcaatatgggttggaataatcgggagaggtttcatggaagctggagaagtaaatatgactcaacacacaggaaagctcctccagcttttttccttttactactgtcaaaatgcaaagtccatgcctctgaaggtgataaacactgtgaagatgacgatgatgatgacgatgacgacaacgacaattattatatcattttctacatggaaccctatgcttatatttccactgctcccacagagaatgggttgatggacaggttgattccccttgctccaatccaccatcagaaaaatcccctggagccagctatgatggatgaactcggagagcagtcatcaagaactaaggctgaagagctcatgggaatatatgaacttgatctaagccttcgtgcatagggcctgaggttctgatatccatccaggaggtgatctccaggatgcaggctctgtgcacgtggggagctgatattgagtcatctatgtactgtttagagtcctatctgcaaaataaatggggagagaatgagtctcctgcaagaaatcagaaaccctggcttgtgccactctcagaaatgctaaagaaaagttatttcatggtgtttgcatcctagttacttgactgcctttatttaaggttgcatggttttaaaaatcatactgacccattaattcaagtcagtttcatgggtattttgtctgatttgattattcagtttggttgaactggttatgtgtaaaactgcaggcagttttgattaaaaaattactgttacattcaaacaaaatcaaggatcactcaaatatgagacctattccattttgtggtgttgattgaggctatgcagcaagccacaattattccatgtttctaaaacaaaatataaaatcaatttttaggaaagatatcaaatacacatttgttgctgttgttctcttattgcttttgtaattgacataaagtactctcctgtgacttgattcagcaataactaatttacatttttattttctggaaaactttctgaagcaccaatacttggtctatatatgaatcttaactgttgctgctttgg

SEQ ID NO: 478359 - DNA, 590 bp, Homo sapiens
cacatctggaatcacttacagctggatggtcaggccagcaggatgaactcactcgttgctcaaatcagcagtgggatgacaggaagtcagtgggagatgctggcaagagcaccaggtgaggagtcttgggtcctggagcctggtctggttttgcccactccatctgtgacctgtgccacttccccttggtgcttagtgagctcatccgtaaaatcagagtcagacaacatgatctcacctgcctcttcctactctaaaatttgcgtgtttgtctatgaaataatccaaggattttgtgtcaggcttaaaagctgttatgtgcccattagaagtaatcctacgctgcccatccagattctaaactttgcttccactgatgacaggggagggtcatttgatcctcccaagccacaccccatccccctccaaaatataccaccccaaagccacccccaaaggaaggtgctgtttgctgaaggaagtctgaggcagctcttcccatctcagacccaaggtgagggatggtgcctccctcaatccctagtcatgggtggaccaagattgtaattgttggctccctcggggtctac

SEQ ID NO: 478360 - DNA, 517 bp, Homo sapiens
ggtcagcggactcaaagaccaaaactagacaaactcacgaagatgagaaagaatcaacgaaaaactgctgaaaacccaaaaggccagagtgcctcttttcctccaaatgatcgaaacgtctctccatcaagggtacagaactggacagaggatcagatggatgaattgacggaagtaggcttcagaagatgggtagagcatgttctaacccaatgcaaagaagctaagaaccttgataaaaggttagaggaattgctaactaaaataaccagtttagaaaggaacataaacaacctgatggaactgaaaaacacagcgctagaactttgtgaagtatacacaagtatcaacagccgaattgaccaagcagaagaaaggatatcagagtttgaagaccaccttactgaaataagacatgcagacaagaatagagaaaaaagaatgaaaaggaatgaacaaagcctccaagaaatatgggacttcataaaaagaccgaacctacaattgatttgagtac

SEQ ID NO: 478361 - DNA, 536 bp, Homo sapiens
tatcatccgaggctttgtgggagagcgaatgtcgagcccgcagctggggctgtacgggggtgtcaacagaatagctaatggcaagttgacacacagagatatcaacttgcaagagacaaagtggaatccagtaatgagtattgtcagagggcctgcaatatttgaaggaaggagaaagatctatgggaacatcaactttggaacaggactgctgcaatgtactgggaagagcatctggtcttggagccatgatactagggttgaaataataattagaactcttctgagcaggatgactgtattagtctgtttttacactgctgataaagacatacctgagacccggcaatttatacaggacaaagatttaatggacttgcagttccacgtggctggggaggcttcacaatcatggcataaggcaacggggagcaaagtcatctcttaaatggatggtggcaggcaaagaaagagcttgtgcaggggaactccttttagtaaaaccatcaaatatcatgagacttattcactgtcac

SEQ ID NO: 478362 - DNA, 703 bp, Homo sapiens
tcagaggaggcatgtagacaagggaaaaggagaaaggccggtctatatccagtgggattgagaactggccctaatggaaccttcagcaggaagacttcattacactatccctcatttaatcttctcgctgtgccatttcaacatctctggctatgcaatagcccttcagtgggcaataaagagagggagaccttttcctggagagaagagctgtgatttgtaccacaggcaatttccaacattcaaagtcgaagtacgtttcccaaaaggctgggcaaattccagttgtagagttagacagaaagagagtgttggtgttgtttgcaaggccacggaggatctgatacctggttcctggatctgctatcactggtacctggagctgatccggacaatggagacaatggaaagatcagtgaagaggggacctggggcagcagagatcagctctgacagtggaggacgtgcaccagacagggctctcatcccaaacaggcttgatacatttctttcccagaaaagattgaattagaagagaatgttttaaggaaaaaaattgagagaacatctaactatctctgaagtgttgatatggaaatcccagcgtaatgttctattacttttttttccctgattcctatttggatagactccaatgacatgcagaaaaagtacagtcctactttatattcattagagactc

SEQ ID NO: 478363 - DNA, 625 bp, Homo sapiens
gtttataggaaatgtccacaatatggaaatctatgcatatgggattgatcgcactagggaggagggtcatgctagccatgtcaccggtagtgtggcccgcagggacgccgacctgctggagcgtcgtgccagcatgggctgtggcaaccacgtgggccagcaggaggttcccgctgcacagctgtgggaggaggacacgggagaacacaatgacatgagtgactgtcctgcttggttaggaaagggaaacgtaaagttgtggaattctgttgatgatggatgtgagagtggtgaagccctgcgggatgatgtagaggacttccacatccctggtgaggagctgccccttgggtctgagtttctgggaggggagagggagaagctgggagaccccccgagagctggggatgagctgctgggtgatggcagtaagaacatgtggtatattattgatgaacgtggggactctgaggagtcctcagaggaggacacggcagagcccaatggcttcattgatttcccatcaagagtccgccaaacgctccggccgctgatccgctccgcgaagatctgagtacaggccagccagggtgggtttaaatagcctcgggcgcagcctagcagc

SEQ ID NO: 478364 - DNA, 1389 bp, Homo sapiens
gtttataggaaatgtccacaatatggaaatctatgcatatgggattgatcgcactaggaaggagggtcatgctagccatgtcaccggtagtgtggcccgcagggacgccgacctgctggagcgtcgtgccagcatgggctgtggcaaccacgtgggccagcaggaggttcccgctgcacagctgtgggaggaggacacgggagaacacaatgacatgagtgactgtcctgcttggttaggaaagggaaacgtaaagttgtggaattctgttgatgatggatgtgagagtggtgaagccctgcgggatgatgtagaggacttccacatccctggtgaggagctgccccttgggtctgagtttctgggaggggagagggagaagctgggtgaggcaggcatgaatcttgaggagtcagggctgggggaccgctcatattctcccgagacctgtgagtctctgggggactcctgggtgcatggggctgactcccgcaggaacctggggatggctggagagtaactgggagccacaggagggtccctgaggcctgggggtgaagagatgcaagacacaggggtggagcagcgtgaggctcgtgagtttgtaggtgattcctgggtgtggggggctgactccagctgaaatctggggttgcttggagagtagcttggagacacaggagaccccccgagagctgggggtgagatgctgcgtgatggcagtaagaacatgtggtatattattgatgaatgtggggactctatcttgtcaatgattctagcttatattaatatgcaatgtatacaatatgctaacatttacaatatatgtttatagtttaaacatttctgtcatattttcagattctttaaagattatattacacttcctgtttcagatagctgcttaaaatgagtaaggaaaaacggatgtgtgcatcagttgtaactgtttatggactaaaactagttgatttactggttaagaacaaaaagtgacaacctaattaactgaaaattttaatgttaacatctccgttgaagctttttatgattagtgtctggatagcatatttttatgattagtgtctgcatagcatattttttctcatactttgtgtctttgtatttaaattgtgtctctgtggatgccatattgttgggtcttgctttcctctcaggtctggcagtctctgtcttaagtagagtatttgtccagttacattgtaactaatcattgctaaggacgaacattcagacccttgtagcagtgttctgtaatcctatgtgagggacaaacattcagaccctcgtagcagtgttctggaatcctatgtgagggacaaggattcagacaaggacaaggattctcttgattggaatagtttc

SEQ ID NO: 478365 - DNA, 742 bp, Homo sapiens
ggtagtgtggcccgcagggacgccgacctgctggagcgtcgtgccagcatgggctgtggcaaccacgtgggccagcaggaggttcccgctgcacagctgtgggaggaggacacgggagaacacaatgacatgagtgactgtcctgcttggttaggaaagggaaacgtaaagttgtggaattctgttgatgatggatgtgagagtggtgaagccctgcgggatgatgtagaggacttccacatccctggagaccccccgagagctgggggtgagctgctgggtgatggcagtaagaacatgtggtatattattgatgaacgtggggactctgaggagtcctcagaggaggacacggcagagcccaatggcttcattgattgcccatcacgaggggagagggagaagctgggtgaggctcgcatggaccttggggtgtccgtgctgggggaccgttcataagaagagccagacaagaccctactgttcttaggtgcagacatgattaggaaacctgcagctcccaggggcccccactaatgttctaactcgcagaaggaaggagtgtgtgtgcgtgtgtgcgtgtgcgtgtgtgtgtgtgtgtgtgtgtttgtgtgtgtgcggtgtgaggtatgggccccttaaggaaatggaaatcaaccaaccaatgggacagacagacagacagacagacagagattcacttgcccaagtgttctgtcctgtcctctgaatccgctttcaa

SEQ ID NO: 478366 - DNA, 5571 bp, Homo sapiens
tcattcagaccacagctggggtgttctggatccctaggtgtgggacaaacattcagaccctcgtagtaatgttctggaatcctatcagtgctctggaatcctacgtgaggaacaaactttcagaccacagtagaagtattgtggaatcctatttgtgggacaaacactcagaccacagcaggaatgttttggaatcctatgtgagggagaatcatgcagaccacagcaggattgttgtggaatcccacgtaaggcacaaacacccagaccacaacaggagtgttctggaatcctatgtaagggtcaacctttcagaacacagcagcagtgttctggaatcctataggagggacaaacattcagaccacagcaagagagttctggaatcctatgtgaggaacaaacattcaggccacagcagcagtgttctggaattctatgtaagggacaatcattcagaacacagctggggtgttctggaatcctacgtgtgggacaaacattcagaccctcgtatcattgttccagaatcctatgtgaggaagaacattcagaacacagaaggagtgttctggagtcctatgtgcatgacaaacactcatactctcatggtagtgttctggaatcctatgtgagggacaaacatttagaagcacgtagcagtgttctggaatcgtacatgagggacaaacactcagaacccaacagcagtgttttggagtcctaagtgagggaaaaacattcagaccacagtaggagtgtcctggagtcctatgtgagggagaataattcagaccattgcagcagtgttctggaatcctttgtgagggacaaatattcagatgtcagtagcagggttctgcaatcctatgtgagggagaaacactcagaacccagcagcggtgtcctggaatgctaattgagggaaaaacacacagatcacagaaggaatattctggaatccattgtgagggagaataatacagaccctcgtagcagtgttctggaatcctatgtgagggagaaatgctcaacccagaagcagtgttctgcaatcctatgtgagggacaatcattcagactacagccggggtgttctggagtcctacgtgtgggacaaacatgcagacccgcgtagcatttttctggaatcctctttgaggaaaatacattcagaacacaacaggagtgttgtggagtcctatgtgcgggacaaacattcagtccctcgtagcagtgttctggaatgccatgtgagggagaaacactcataacccagtagtagtattgtggaatcctatatgagggacaatcattcataccacagttgaggcattctggaatcctatgtgtggggcaaacattcagacccggacccttgtagcactgttctgcaatcctatgtgaggaacaaacttttagacccagggagcagtgttctggaaccgcaagtgagagacaaacacttggaaccctacagcagtgtcctggaatcctaattgagggacaaacatacagaccacgaaggaatcttctggaatcctatgtgagggagaataattcagaccctcgtagcagtgttctgcaatcctatgtgagggaaaaactttcagaccacagtagcagtgttctggaataccatgtgagggagaaacactcacaacccagcagcagtgttgtggaatcctatgtgagggacaatcattcagaccacagctgagttgttctggagtcctaggtttgggacaaagattcagactcacgtagcattgctgtggaatcctatgtgaggaaaatactttcagaacacactaggtgtgttccagagtcctatgtgcgagacaaacattcagtcccttgtagcagtgttctagaatcctatgtgagggacaaacatttacacccatgtatcagtgttctgtaaccgtacgtgaaggacaaacagtcagaacccaacagcagtgttctgcattcctaagtgagggacaaacattcagatcatagaaggagtgttctgtaatcctatgtgagggagaaacattcagaacccagaagaagtgtgctggaatcctctgtgagggacaatcatttataccattgtagcattgttctggaatcctatgtgaggaaaaacccttcagaacacagcagtagtgttctgcggacctacgtgcgggacaaacatacagaccctcatagcagtgttctggaatcttatgtgagggaaaaacatttagacacacgtagcagtgttttggaatcgtacgtgagggtcaaacacacagaacccgacagcagtgttctggaagcttaagtgagggacaaacattcagaccacaacaggagtgttctggaatcctatgtgagggagaataattaagatcctcatagcagagttctggaatcctatgtgagggagaaaaattcagatcccagtagcaatgttttggaatcctacgtaaaggagaaacactcagaacccagcagctgcgttctggaatcctatgtgagggacaatcattcacaccacatctgggatgttctgggtccctatgtgtgagacaaacattcagaccctcatagcaatgttatggaatactatgtgaggaagaacattcagaacacagcagcagtgttctggagtcctatgtgagggacagtcattcagaccccagttggggtgttttggatccctaggtgtgggacaaatattcagaacctcgtagcattgttctggaatcctatgtgaggaagaacattcagaacacagtaggagtgttctggagtcctatgtgcgggacaagcattcagaacctcgtagcagtgttctggaattctatgggagggaccaacatttagacccacgtagcaatgttctggaatcgtatggggggggaaacactcagtacccaagaacagggatctggaatcttcagtgagtgacaaacattctgaccagagcaggagtgttctggaaacatatttgaaggacaaacactcagaacccagcagctttgttctggaatcctatgtgtgggacaatcattcagaaaaccactgaggtgttctggaatcccacgtgtggaacaaacattcagacccttgtagcattgttctggaatcctatgtgaggaaaataccttcagaacaaagcaggagtgttctggagtcctatgtgtgggacaaacattcagagcctcgtagcagtgttctggaatctgatgtgagggaaaatcatttagacccacgtagcagtgttctggaatcgtacatgagggacaaacactcagactccaacagcagtgttctggaatcctaagagtgggacaaacattcagaccacagcaggagtgttctggaatcctatatgagggagaataaatcagacgctgttagcagtgttctgtaatccaatgtgagggacaaactttcagacaccagtagcagtattctggaatcctatttgtggtacaaacactcagaccacagcaggaatgttttggaatcctatgtgagggacaaacagtcagaccacagcagcgattgttgatgataatacccatggtgaggcagaaaacacccagaccacagcaggaatgtactggaatcctatgtgagggtcaaccattcagaatacagcaggaatgttctggaatcctatgtgagtgtcaaccattcagaccacagcactagtgtaatggaatcctacgtgagggacaaactttcagaacctcgtaacagtgttctggaatcctatgtgagggacaaacactcagaaccccgcagcagtgttctggaatcctaagtgaggggcaaacattcagaccacagcaggagtgttctggaatcctatgtgagggagaataattcagaccctcgtagcagtggtctggaatcctatgtgagggaaaaacactcagaacccagcagcagtgttctggaatcctatgtgagggacaatcattgagaccacaactggggtcttcttgaatcctacgggttggaaacgcattcagactctcgtagcattgttctggaatcctattttaggaaaatacattcagaacacagcgggagtgttctggagtcctatgtgtgggacaaatattcagactctcgtagcagtgttccggaatcctatgagagggacaaatactcagaaacccacagcagtgttctgtaatcctatgtgatgttcaaacattcagaccacagcaggagtgttctggaatccaatgtgagggacaagcattcagaccccatcagcagtgttctggaatcctatctgagggacaaacattgacacccaagtagcagtgttctggaatcttatgtgcgggacaaacactcagaacccaacagcagtgttctggaatcctaagtgagggacaaccattcagaccacagcaggaatgttctggaatcctgagtgaggcataaacattcagaccacagcaggagtgttctggaatgctatgtgagggagaataattcagaccctcatagcagtgttctggaatcctatttgaggcacaaacattcagaccccagtagcagtgttttggaatcctatttgagagacaaacactcagaccacagaaggaatgttttggaatcctatctgagggggaaacattcagaacacagcaggatagatctggaaacccttgtgagtcacaaacacccagaagacaacaggaatattctggaatcctatgtgagggtcaagcattcagaccacatcagtagtgttctggaatcctatgtgagggacaaacatttagacccacgtagcagtgttctggaatcctatgtatgagacaaacattcagaaactcttagcagtgttgtggaatcctatgtgagggagaaacactcagaacccagtagcagtgttctggaatcctatgtgagggacaaatactcagaacccagaagctgtgttctggaatcctatctgagggacaaacattcagaccagagcaggagtgttctggagtcctatgtgtgggacaaacattcagaccctcgtagcagtgttgtggaatcctacgtgggagacaaacactcagaacccagtagtagtgttctggaatcctatctgagggacaaaaattcagaccagagcaggagtgttctggaatcctatgtgaggtacaatcattcagacccttgtaccagtgttgtggaatcctatgtgagggagaaacactcagaacccagcagcagtgttctggaatcctatgtgagggacaatcattcagactgcagctggggtgttctggaatcctacttgtgggagaagcattcagaccctcgtagcattgttctggaatcctatgttaggaaaacacattcagaacacagcaggagtgttctggagtcctatgtatgggacaaagattcagaccctcgtagaagtgttctggaatcttatgtgaggtagaaacaatcgtaccctcttagcagtgttctgcaatctcatgtgaaggacaaacattcagaccctcttagcagtgttctggaatcctatgtgagggacaaacactcagaacccagcagcagtgttcc

SEQ ID NO: 478367 - DNA, 5470 bp, Homo sapiens
gtaagtgtgttttggaatcctacatgagggccaaacaatcaaaccctcatagctgtgttccggaatcctatgtgaggggcaaacactcagacaatcgtagcagttttctggaatcctttgtgagggacaagcattcattccctcgtagcggtgttcgggaaccctgtatgagggacaaacattcagaccacaccgttctggaatcccctctgtgggaaaaacattcagaccctcgtggcagtgttctggaatcctatgtgacggacaaagatttagaccacagcagcagtgttctgaaatcctatgtgagggacattcagaccctcttagcagttttctggaatcttattgttctggaattctatgtgatggagaaacactcagaatccagcagcagtgttctggaatcctatatgacggagatacacgtacaccccagcagcagtgtcctggaatcctatgtgagagacaaactttcagaccccaggagcagagttctggaatcctacatgagggataaacattcagaccctcttagcagttttcttaatcactatgtcagggacaaagattcagacctcagcaccattgttctggaatcctacatgaggctcaaacattcagaccctcgttgcagtcttctggaatcctgtgtaagagacaatcattcagacaacagcaggagtcttctggaattccctgtgagaaataaacactcagatcctcctagcaacactggtagcagtgttctggaatccaacgtgagggacaaacattcagacaacagcaggattgttctggaatcctatgtgagggacaagcattcagacaatcgtagcagtgttctggaatcccatgtgagggacaaacattcagaccttcatagcagtgttctggaatggtatgtgatggacaaacattcagacaatcatagcattgttctggaatcctatgtgagggacaagcattcagacaatcacagtcgtagcattgttctggaatattatgtgagggacaaacattcagacaattgtagcagtgttccggaatcctatgtgagggacaaacattcaaacaacagcgggattgttcaggaatcctatgttatggacaaacattctgaccctcgtagcggtgttctggaattctatgtgagggagaaacactcagaacccaacatcagtgttctggaatcctatgcgacggacatacctgtagaccccagcagctctattctagaatcctatgtgagagacaaacattacgaccccagcaacagtgttctggaatcctatgtgaaggaaagtcattcagacactcagcacagcaggcgtgttttggaatcctatgtgagggacaaacattctgacactcatagcagggttctggaatcctacgtgagtgacaaacattcagacaatcttagcagtgttctggaatactatgtgagggacaaacattcagacactcgtaacagtgttttggaatactatgttgcagacaatcattcgtatgctcgtagcagtgttctggaatcctgtgtgaaggacaaacattcagaccacagcaggattgttctggaatccccagtgaggaacaaacgttcagaccttcatagcagtgttctggaattctatgtgacggacaaacatttagaccccagcagcggtgttctgaaatcctataccatcatagcagtgtattggaatcctgtgggagggacaaacattcagacaatcgaagcagtgttctggaatcctaagagagagacaaatattcagaacacagaaggattgttctggaatcctattagtgtcctggaatcctatgtgagggacaaacatgcagacaattgtagcagtgttctggaatcctatgtgatcgacaaaccttcgaacaacagtggaagtgttctggaatcctatgttatggacacacattcagaaccttgtggcagtgttctggaattctatttgagagagaaacattcagagcccagcagcagttttctggaatcctatgtgatgaacatacatgcagaccacagcagcagtgttctggaatcttatgtgagggacaaacattcagacaattgtagcagtgttctggagtcctccgtgaaggacaaacattcggaacccagcagcagtgttctggaatccaatgtgagggacaaacatataaatcacggggggggagttttctggaatcctatgttacggacaaacattcagaacctcgtcgcagtgttctggaattctatgtcagggagaaacagccagaacacagtagcagggttttggaatcctatgtgacggacacacatatagaccccagcagcagtgttctgggatcctatgtgagagacaaacattcagcacctcgtcacagtgttctcgaatcctatgtgagggacaatcattcagatcctcgtagcagtgttctggaattctgtatgagatacaatcattcagaccctcgtagcagtgttctggaatcctaagtgtgggacaaatattcagacaatagtagtagtgtcctggaaatctatgtgagggacacacattcagaccctcttaggagtgttctggaatcttatatgagagacaaacattcagacaatcgtagcagtgttctggaatcctcggtgagggacaaacattcggaacccagcagcagtgttctggaatccaatgttatggacaaacattcagagactccttgcggtgatctggaattctatgtgatggagaaacactgagaaaccagcagtattgttctggaatctgatgtgacggacatacatttagaccagagcagtagagttgtggaatcctatattggggcaaacattcagtccccagcagcattgtcctgcaatcctttgtgagggacaaacattcagaacccagcagcagtgttctggaatcctatgtgaggcaccatcattcagaccctcgaagcagtgttctggaattttgtgtgaggggcaaacattcagaccctcgtagcagtgttctgcaatcctgtgtgaggtactattattcagatgatggcaggagagttctggaatcccctgtgaggaacaaacattcagaccctcctagcagtgttctgtaaccctatttgagggacagatattcagacgacagcagggttgttctggaaccctatgtgggggacaatcacccagaacacatcagtagtgttttggaatcctatctgagggacaaacattcagaccctagtagcactgttcaggaatcctatgtgagggacaaacattcagacaatcgtagcattgttctggagtcttatgtgagggacaaacattcagaccccagcagcattgttctggaatcctatgtggggttcaaacattcaaacaacagcgggattgttctggaatcctatgttacggacaaacattcagaccatcgtagcagtgttctggtattctatgtgagggaaaaacactgagaatacagcagcagtgttctggaatccgatgtgtgggacaaacattcagaccccagcagcagtgttctttaatcctatttgagggacaatcattcagactctcatagctgtgttctggagttctgcataagggacaatcgttcagacccacgtagcagtgttccggaattctgtgtgatggagaaaccttaattacttcatagcagtgttatggaagcctatctgtgggacaaacattcagaccacagcaggagtgttctggaacactaagtgttctcaaatcctatgtgaggaacaaacattcagaccctcgcagcaatgttctggaatcctatgtgacggacaaacatttggactgcagcagcaatgttctggaatcctatgtgagggacaaactttcagaaaatcgttgcagtggtctggtatcctaggtgagggacaaacattcagaacccagcagcagtgttctggaatccaatgtgagggacaaacattcaaacaacagagggagtgttttgcaatcctaggtaaaggacaaatatttagacaacaggagcagtgttctggaatcctgtgggaaggacaaacattaggaccctcagtatagtgttctagaatcttatgtgagagaaaaacattgagacaatcatagcagtgttgtagaatcctttgtgacggacaaatatttagaccccagcagcattgttctggaatcctatgtgagggacgaacattaaaatcacagcgggaatgttctggaatcctttgttacgggcaaacattcagatcctcgtcgcagtcttcttgaattacatgtgagggagaaacactcagaacccaccagcagtgttctggaatccttagcgacagacatacatgcagacatcagtagcagtgctctgggatcctatgtgagggacaaactttcagacggcagcagcagtgttctggaatcctgtgtgagggacaatcactcagaccctcgtagctgtgttctggaattccgtgtgatggacaaacattcagaccctcatagcagtgttctggaaacctatgtgagggacaaacattcagaccacagcaggcatgttgtggaatcctctgtgaggaagaaacattcagaccctcgtagcagtgttctggaatcctatatgacagacaaacatttagaccccagcagcagtgttctggaatcctgtgtgagggacaaacattcacaccctcggagcagtgttctagaatcctataaagggacaaacactcagaacccagcagccgtgttctggaaccatatgtgagggacaaacactgagaacacagcaggattgttttggaatgctatgtgatggagaaacattcaggcactcgtagcagtgttctggaatcctaagtgagggacaaacattcagacaatcgtagcagtgttctggaatcctatgctagggaaaaacattcagaccccagtagcagtgttctggaatcctatgtgagggaaaaacattcaaacaacagcgggagtgttctgaaatagtatgttactgacaaacattcagacccttgtcacagtgctctggaattcaagtgagggggaaacacacagaacccagcagctgtgttctggaatcctgtgtgacggacatacacatagaccccagcagcggtgttccggaatcctatgtgacggacaaacattcagactccagcagcagtgttctggaatcctctgtgagggaccatcattcagactctcgtagtagtgttctggaattctgcgtgaggggcaaacattcagaccatcgtggcagtgtactggaatcctgtgtgagggatagtcattccgaacacagcaggagtattctggaatcccctgtatggaaaaaacattcagaccctagcagcagtgttctggaatcctatgtgagggacaaacatttagaccccagcaaaagtgttctggaatcctgtgtgagggacaaacattcagactttc

SEQ ID NO: 478368 - DNA, 6976 bp, Homo sapiens
agacgccagcagcagtgttctggaatcctaattgcgggacaatcattcagacccttgtagcagtgttatggaatcctttgtgagggacagacatttagaacccagcgacagcattctggaacactatgtgaaccctcgtagcagtgttctggaatcctatgtgagggacgaacctttagaccccagcagcagtgctcttgaatcctacgtgaggaaaaaacattcagacactcgtagctttgttctcgaatcacatgtgagggacaaacattcagataatcttagccatgttctggaatcctatgtgagggacaaatattcagaccccagcagcgttctggaatcctatgtgaggaacaaacattcaaacaacagcgggagtgttgtcgaatcctatgtaacagacagactttcagaacctcgtcgcagtgttctggaattttgtgttagagagaaacactcagaaaccaacaggagtgttctggaatcctatgtgatggacatacatgtagacgccagcagcagtgttcttgaatcatatgtgaagacaaacattcagatctcaaaagcagtgttctggaatcctctcagcagtgttctggaaccttatgtgacagacatacatgtagaccccagcagcagtgttctggaatcctatgtgagggacaaatattcagacagcagccgtagtattctggaatcctatgtgaaggatagtcattcagaccctcatagcagtgttctggaattctctgtgtgggacaaacattcagaccctcatagcagtgttctggaatccccgacactcgtagcagtgttctggaatcctatgtgggagacaaacattcatacaatcttagcagtgtacgggaattctttgcgagggacaaacattcagaccccagcagcagtgttccagaatcctattgctctggaattctatttgagggagaaacaatcagaacccagcagcagtgttctcgaatcctacatgagggacatacattcagaccacagcagcagtgttctagaaccctatgtgagggacaagcattcagaccgtcgtagcagtgttctcgaattctgtgtgaaggacaaagattcagaccatcagagcagtgttctggaatcctttgtgagggacaaacattcagaccacagcaagagtcttctggaatccactgtgaggaacaaacattcagaacctcatagcagtgttctggaatcctatgtgatggacaaacatttagacctcagaagcaacaatcgtagcagtgttctggaatcctatgtgaggggcaaacatacagacacttgtagcagtgttctggaatcctattatgtgagggacaaacattcggatcctcttagcagtgttctggaatcctatgtgacggacatacatgtagaacccagcagcagtgttctgaaggcctatgtgagggacaaacattcagaccccaggaacagtcttcgggaatcgtatgtgagggtaaatcattcagaacgtcgtagcagtgttctggaattctgtgtgagggacaaacattcagaccacagcagcagtattctggaatcctatgtgagggaaaaacattcaaacaactgcaggtgtgttctggaatcctatgtgagggaaaaacattcaaacaactgcaggtgtgttctggaatcctatgacaaggaaaaacattcagaccctcctcgcagtgttcttgaattctatgtgagggagaaacactccgattcctgtagcagtgttctggaaccctatgtgacagacctacttgtagactccagcagcagtgttctggaaccctatgtgagggacaatcattccgaccctcgtggcagtgttctggaattttgtgtgagggataaacattcagaccccagcgcgagtgttctggaatcccacaccctcgtagcagtattctggaatcctatgtgggggcaaacattcaatcatagcagtgttcaggaatcctatgtgagggacaaacatttagactgtcgtagcagtgttctggaatcctactgttctggaattccctgtgagggacaaaaactcggaacccagcggcagtgttctggaattccctgtgagggacaaaaactcggaacccagcggcagtgttctggaatcctatgtgagggacaaacattcagactccagcagcagtgttctggaatcccataccctgatagcagtgttctggaatcctatgtgagggacaaacattcagaccacagcaggactgttttggaattccctttgagaaacaaacttttagaccctcatagctgtgttctgcaatcctgtgtgtgggacaaaatttcaaaacctcgtagcagtgttctggaatcctatgtgaggtacaaacattcagacaatcgtagcagtgttctggaatcccatgtgagggacaaacatgcagaccctcgtaagagtgttctggaatcctatgtgagagacaaacattcagacaatcgtagcagtgttctggaatccaatgttagtgacaaagtttcagaccccagcagcagtgttctggaatcctatttgagggacaaccattcagacactttcagcagtgttccagaatcctgtgtcagggacaaacattttgaccactgcaggactcttctggaatcccttgtggggaacaaacattcagaccctcgtagcagcagtattatagaatctcatgtgagggacaatatttcagaacgtcatagcagtgttctggaatattatatgagtgaaaaatattcaaacatcctcgggagtgttctggaatcttatgtcacggacaagcattcagaccctcgtcgcagtgttctggaattctatgtgagggagaaacactcagaacccagcagcagtgttctggaatcctatgtgaaggacatacatgtagaccatagcagcagtgctctggaatcctttgtgacagacaaacattcagaccccagcagcagtgttctggaatcctgtgtgagggacaaacattcagaccccagctgcagtgttctggtatcctatgtgatggacagtcataaagaccctcgtagcagtgttctggaattctttgtgagggacaaacattcagacattcatagcagtgatgtggaatcccatgtgagtgacaaacattcagaccacagcagaagtgttctggaatcccctgtgaggaacaaacattcagactctcgtagtagtgttctggaatcctatttgaaggacaaacatttaggccccagcagcagggtccttgaatcctatgtgagggacaaatattcagaccctgacaatcgtagcagtgttctggaatcctatgtgaggggcaaacattcaaacaacagcgggagtgctcttgaatcatatgttatggacaaacactcagaccctcgtagcagtgttctggaatcctatgagagggacaaacattcagaccctccagaccctcatagcagtgttctggaatcctacatgagcgacaaacacactgaaaccagcagcagtgttctggaaccctatgtgagggataaacattcagaccatgccaggattgttctggaaacctatgtgagggaccaacactccgaacccagcagaaaggttttgaaatcctgtgtgagggacaaacgtttagactctcgtagcagtgttctggaatcatatgtgagggacaaatatacagaccatagcaggagtgttctggaatcctatgtgagggacaaacattcagaccctcatagcagtgatctggaattctatgtgagggacaaacattcagacattggtagcattgttctggaatccaatgtgagggacaaacattctgaccctcatagcagtgtaccagaatcctgtgttaggaacgaacattcagaccacagcattagtgttctggaatcccctgtgaggaacaaacatacagaccctcgtagtagtgttctggaatcctatgtgacggccaaatatttataccccaggagcagtgttctggaatcctcagtgaggaaaaccattcagaatcttgtagcagttttgtggaatcctattgttctggaattctgtgtgagggacaagcattcagaacgtcgtagcagtgttctggaatcctatgtgaaggacaaccattcagaccacaggaagagtgctctggaatccccagtgaggaacaaacattcagacactagtaaaagtgttctggaatcctatgtgacagacaaacattcagaccccagcagcagtgttctggagttttatgtgagggaaaaacgttcagacaatcatagcagaattctggaatcctatgtgagggacaaacattcagacctcagctgctgcgttctggaatcctatgtgagggacaaacattcatacaacagtgggagtgttctggaatcctatgttacaggcaaatattcagaccctcgtccgagtgttctggaattctatgtgagggagaaacattcagaacccaccagcattgttctggaatcctatgtgacggacagacatgcagaccccagcagcattgttctggaatcctatgtgacggtcagacatgtagaccccagcagcattgttctggactcctatgtgagggatgatcattcagaccctcgttgcagtgttttggaattctgtgtgacgcccataaatctacaccccagcagcagtgtggtggaatcctatatgatggacaaacatccagaacccagcagcagtgttctggaatcctatgtgaggtacaaacattcagaccccagcagcagtgttctggaatcctatgagagggacaatcattcagacccttgtagcagtattgtggaattctgtgtgagggataaacatccagaaactcatagcagtgttctggaatgctctgtgagcagtgttctggaatcctatgggacaaacaaacatttagatggcagcagcagtgttctggaatcctatgtgaggtacaaacattcagaacactgcagaagtgttctggaatctcctgtgaggaagaaacttttagaccctcataaaagtggtctggattccgatgtgatggacaaacatttagaccccagcagcagtgttctggaatcctatgtgagagacaaacattcagaacctcgtagcagtgttctggaatcctatgtgagggacaaaccctcagaactcagcaactgtattctggaatcctatggagagacaaacattgagaccacagcaagattccgtgttctggaatcctatgtgagaggcaaacattcatacactcatagcagtgttctgcaatcctatgtgagggacaaatattcagatcatcctagcagtgttctggaatcctatgtgagggacaaatattcagatcatcctagcagtgttctggaatactatgtgagggacaaaaatgcagacagtcgtagcagtgttctggaatcctatgtgagggacaaaaatgcagacaatcacaatcgtagagtgttctggaatcctatgggagggataaacattcaaaaaacagcgagagcgtctgacatcctacgtttcggacaaacatgcataccctcgtcgcagtgttctggaatttatgtgagggagagacacacagaacccagcagcagtgttctggattcctatgtgacggacatacatgtagaccccagcagcagcgttctggaatcctatgtgagggaaaaacattcaggcaccagcagcagagttctggaatcctatatgaaggacaatcattcagaccctcgtaacagtgttctggaattctgtgtgagggacaaacattcagaccacagcaggactattctggaatccccagtgaggaagaaacattcagaccctcgtagcactgttcttgaatcctgtgtgatggacaaacatttagaccccagcagcggtgttctggaatcctatgtgtgggaccgtcattcagaacctcgtagcgtgttctggaatctggtggacaaacattcagacaatcataggagtgttctggaatccgatgtgagggacaaacattcagactcttgtatcagtgttctgaaatcctacgtgaaagacaaacattcaaacaatcgcagcagtgttctggaatcctatgtgagggacaaatattcagaccctgaccctcatagctgtgttctggaatccaatgtgacggacaaagatttagaccccagcagcagtgttctggaatcctatgtgatggacagacattcagacaatcgtagcagtgttctggaatcctatgtgagggacaaacattcagaacccagcagcagtgttctggaatcctatgtgaggaacaaacattcaaacaaacaacagcgggattttccggaattctatgtgacggagaaagactcagaactccgcagcagtgttctggtattctatgcgatggacatacatgcagacctcagcagcagtgttctggactcgtatgtgagggacaaacattcagaccccagcagcagtcttctgaaatcctacatgagagacaatcattcagtccctcgttgcattgttctggaattctgtgtgagggaaaaactttcagacaatcatggcagtgttccagaatcctacgtgagggtcaaactttcagaacacagaagtagtgatctggaatcccctgtgaggaataaacattcagaaccctgtagcagtaacctggaatccgatgtgacggacaaacctttagaccccagcagcattgatctggaatcctatttgagggacaatcattcagaccctctcagcagtattctgtcatcctatgtgcgggagaaacattcagaccagagtgggggtgttctgtaataatatgtgacaaacatttcgatcctcacagaagtgttctggaatattatatgagggacaaaggttcagacaattgtagcagtgttctggaatcctacgtgagggacaaacattcagagactagaagca

SEQ ID NO: 478369 - DNA, 3064 bp, Homo sapiens
gaattctatgtgagggaaagacattcaaaccccagcagcagtgttgtggaatccgatttgaggggcagacattcagaccccagcagcagtgttctggaatcctatgtgagggacaaacattcagaccccagcagcagtgttctggaatcctatgtgaaggaaaaatattaagaccctcgtagcagtgtcctggaatcatatggaagggacaaccattcagacaccagcagaagtcttctggaatcctaggtgtgggaaaaacattcagaacctagtagcagtgttctggaatcctatgtgagggacatacattcagaccacggcagcagtgttccggaatcctatgtgagggacaaacattcagaccacggcagcagtgttccggaatcctgtatgacggaccaacattcagacccttgcaacagtgttctggaatactaggtgagggagaattatttataccctcgtagcagtgttctgtaatcctatgtgagggacaaacattcagaccccaggagcagtgctctgaaatcctaagttaagggaaacattgagaccccagcacgaatgttctggaatcctatgtgagggacaaacattcagaccacggcaggagtgttctggaatcctatgtaaggaacaaacattcagacctcagcaggagtgttctggtatcctatatgagggataagcatttagaccctcgtagcagtgttctggaatcctatgtgagggagaagcattcagagcacagcaggagtgctctggaatcccatgttagggacaaacattcagaacctggtaccattgtgctggaaacctatgtgagggacagacatttagaccctcgcagcagtgttctggaatcccatgtgagggacaaacattcagatcctcgcagcagtgttctggaatactatgtgagtgacaaacattcagactccagcagcagtgctctgtattcctatgtgaaggacaaacattcagaacccaggagcagtgttttgaaatcatatgttaagggcaaacatacagaccctagcatcaatgttctagaatcctatgtgagggacatacattcagacccttgcagcagtgttctggaatcccagatgggggacaaacattcagacaatggcagcagtgttctggaatcctatgtgaggcacaaacactcagagcctcgtagtggtgttctggaatcctatgtgaggaacaaacaatcagaccacagcaagagtgttctggaatcctttgttagggacaaacattcagatcacagcagcagagttctggaatcctatgtgaaggacaaacattcagaccctcgtagcaatgttctggaatcctaagtgagggacaaactttcagacaacagcaagagtgttctggaatccaatgtgagcgacaaacattcagaccctcatagtaattttctggaaccctaagtgagggacaaacattcagaatttcatagcagtgttctggaatcctacatgagggataaacattcagaccacagcaggagtgttctggaatcctatgtgagggacaaaaattcagatgccagcataagtcttctggaatcctatgtgagggacaaacattcagaccctcatagcagtgttctggaatcctgtgtgagggacaaacattcagaccacagcaggagtgttctggaatcctgcgtgagagaccaacattcagacccttgtggcagtgttctggaatcctatgtgagagacaaacattcagaccctcataacagttttctgaaatcctacttgagagacaaacattcccaccacagcaggagtgttctcgaatcctatgtgagggcaaacattcaaaccacagcaggagtgttctggaatgctatgtgagggacaaacattcagacactcgcagcaggcttctggaatcctacgtgagggacaaatatttagacaatggcagcagtgttctggaatcctatgtgggggacaaacattcagagccttgtagtgttgtggaatcctatgtgagggacagacatttagaccacagcagcagtgttctggaatcccatgtgagagacaaacattcagaccccgaacagaagtgttctggaatcctatgtgagggacaaacatttagaccctctttgcagtgttctggaatcctatgtgagggacaaacattcagacgccagcagcagtgttttggagtcgtatgtgatggacaaacattcagacccttgtagcttcttctggaatcctacgtgagacacaaacactcagaacccagcaacagtgttctggaatcctatgtgaaggacaagcattcagaccctcgtagcagtgtactgtaatcctatgtgagggacaaacattcagaccatagcaagattgttctggaatcctatgtgaggaacaaatattcagaccaggacagcagtgttttgtcctgaaggacaaacattgagacccttgtagctgttttctggaatcttatgtgaggaacaaacactcagaccatagcaggagtgttctggaatcctgtgtgaaggagaaatattcagaccactgcatgagtgttctggaattcaatttgagggacaaacatgcagaccctcgtaggagtgttctgaaatcctatgtgatgaacaaacattcagaacacagcaagagtgttctggaatcctatgcgaggtacaaacattcagaccacaacaggagtgtcctggaatcccatgtgaggtgcaaacattcagaccctcatagcattgttcttgaatgctatgtgagggacaaaatttcacaacacagcaggagtgttctggagtcctatgtgatggacaaacattcagaacacagcaggagtgttctgaaatactatgtgagggacaaatattcagaccacagaaggagtgttctggaatcctttgtcaaggacaaacgttcagacccttgtagcagtgttcaggaatcctatgtgagggacaaacattgagaccccagtaggagtgttctggagtcccatgtgagggacaaagattcagactttcgtagcagtgttttgaaat

SEQ ID NO: 478370 - DNA, 641 bp, Homo sapiens
gaaaagggaaaatggtcccatttataaatgacagatttgaaactggggttcacatcaacagtgtcactgccaggaaggagggtcatgctagccatgtcaccggtagtgtggcccgcagggacgccgacctgctggagcgtcgtgccagcatgggctgtggcaaccacgtgggccagcaggaggttcccgctgcacagctgtgggaggaggacacgggagaacacactgacatgagtgactgtcctgcttgggtaggaaagggaaacgtaaagttgtggaattctgttgatgatggatgtgagagaggtgaaaccctgcgggatgatgtagaggacttccacatccctggtgaggagctgccccttgggtctgagtttctgggaggggagagggagaaactgggagaacccccgagagctgggggtgagctgctgggtgatggcagtaagaacatgtggtatattattgatgaacgtggggactctgaggagtcctcagaggaggacacggcagagcccaatggcttcattgattgcccatcacgagtccgccaaacgctccggccgctgatccgctccgcgaagatctgagtacaggccagccagggtgggtttaaatagcctcgggcgcagcctagcagc

SEQ ID NO: 478371 - DNA, 625 bp, Homo sapiens
gtttataggaaatgtccacaatatggaaatctatgcatatgggattgatcgcactaggaaggagggtcatgctagccatgtcaccggtagtgtggcccgcagggacgccgacctgctggagcgtcgtgccagcatgggctgtggcaaccacgtgggccagcaggaggttcccgctgcacagctgtgggaggaggacacgggagaacacaatgacatgagtgactgtcctgcttggttaggaaagggaaacgtaaagttgtggaattctgttgatgatggatgtgagagtggtgaagccctgcgggatgatgtagaggacttccacatccctggtgaggagctgccccttgggtctgagtttctgggaggggagagggagaagctgggagaacccccgagagctgggggtgagctgctgggtgatggcagtaagaacatgtggtatattattgatgaacgtggggactctgaggagtcctcagaggaggacacggcagagcccaatggcttcattgattgcccatcacgagtccgccaaacgctccggccgctgatccgctccgcgaagatctgagtacaggccagccagggtgggtttaaatagcctcgggcgcagcctatcagc

SEQ ID NO: 478372 - DNA, 2083 bp, Homo sapiens
tgagaagcgctgctgcttcacactttgtctaaaacagcataaaaatattagggtgatgctctgaaatgctcaagtttgtgcgccttctctcaatcctgctaaatctgactgtgcttgttcatgaatcatctgtaaaggctcacactccatgtctaggggatgcagatggggagtcagccacagagaagatatttggggaagctcatgggccagtttctttttgggggggagtcacaaatcacattattcgagagatcttgggaagcgcctctctccaggcctcagaatggtggagcccatgtcacatcataattctctccaaggcattcctttctaaaatgcctttctccatctccatgcttgacccaaacctcaagctaggtgaggaaataatagccatgaaactggttttcatacacttttctttgcaaatttgtatcttgatatggtatctgtttgaggaatatcaaatctattgactcttcagaactcatttaaatacccaattaaaaaatagaggtgaaactggcctcagttttaagagaatcgtaacatatatatggacttaaaacagtaacatctatttcaattgaattctgttaaaaacactaaccactcttccttgtactgtgacattcctttctgtatccgtcaatgccatttttgaatcttcatattttattctgccaatttgcaaaagttctccatcttctttcattctttctattttctttctcacttcactcacttttcaaataaagcaagagacagatgagctcagaatcaggcctggtccctaaattctctgatcattgcagagccctaaaagactgctcctacaaaatatattctgtttatttgacacatttctgtctcatttcctcaatttgtgttctcctacagttttactttctgaaacagtttgttctgtgacaaaaggtttgcaaaaaatacagggataattgctaaagtttctctctttttgacagtaattcaatgcctttaacaaaatttataatccttttgtacctaaatgtttataagtgttgttaaaccataatgtaaaagtatataaacattttcacatgttctaccagatcaaatatggtacgtatgataataattagaaccaccaacctaacatattgtgaaaaatgccacatatgcatttaattacagtttctgattttcaagcatgcattcagggaagggaggaagtggctttctatttaacttcttcactgctaacagaacatgcatgtgttttggcaagtttcctagggaacatctgtctaaaagggaacgttggggagttaatcgacatctatggagctgggcaacggctgtatggcccatgctgtctccattaaacttcttaactgtgtctcccttaagcagagtcacaaaacataccattgattcagctctttgaataaaaagcaaatcacaagcaaaacttaaactggtttatttacaggatagctttatgaaattggtaaacaatcgagcctctttttccaaaagaattgtttgtagaagatgccaatactggggtggggaacagagttatgaggagggatttgtaaatggtttgtgggtatgtttccaacagctcatagcaaaggaatgaatggaaaaacactccttggaattgggggtggggagagagagggctataaagatggcaaatgaaacaaactagcattttgacattgcctcagttctgggtggaaggagcatgatgaagaatttgaaacatagccaagagcccaacaatttagaggaactgggtggacagacatagtcatgggtcccttaatgacagggatacattctgagaaatgagtcattaggcgattttgtcattgtgtgaacaaacatcatagagtatgcttacaaaaacttagatggtagagcctactactcacctaggttatatagtatacatagcctgttgcttataggctacaaggcctgtacagcatgttcagcatgttactgtaccaaatactgtaggcaattgtaacacaagagtaaatatttttgtgtttctaaacatatcttaacatagaaatggtacagt

SEQ ID NO: 478373 - DNA, 813 bp, Homo sapiens
aggcacaagatggagagtacgtgctgataggttttgtgggaaggtaaagagcatgaatattaaacaacatgttctgttgctgccaaattccaaattcccagtagcaacccactctaagcgtgaagagaatgatgctgacttggagcccgccctcatcttctcctctaaggtggagttagaggctcatgtgtcaggagcagtagactgctttccacaaattgtgaaggatcaaagagtgttgggtctctggactgggttgacagtccacttgctggagttcaaaatgggttgtaaagcagcggagacaactcacaacatcaacaatgcctttggcccaggaactgctaatgaatgtacattgcagtggtggtccaagaagttttgcaaagaagacaagagccttgaagacgaggagcttagtggctggccatgggaagtttacaatgaccaattaagagcaatcactaaagctgatcctcttacaactacaggagaagttgccgaaaaacttcatatccaccattctccggtcattcagcacttgaagaaaattagaaaggtaaaaaagctcagttccaggtccagggcttcaggtattgcaggcttgaccctgaaaagatatatccaactatctaatcctggtactttgaccatggaaggcatggccagcaccactgaaaacggtcccttccatttgggttacaattgttgagcagatgatccctcctttcatgttttaacaagtaccttatctcctgacttgattttgggttgctgtgactatcccatatgtttaaaaacttctcatttccc

SEQ ID NO: 478374 - DNA, 2539 bp, Homo sapiens
ggcggtgtatagtccagagggagtgaatctttaggtttattctactgttctctcgatattgtccctaagaacctgctctttcaatgacgaacacctgtacatcagagccattgccaccctgcagccaagctaacagatatcacatgacaggaataaatcttcgagtgaagctgcagaccttcctggtgagtgttacagctcataaaggtagtgcagacccaaagagtgagcagcagcaagatttattacaaagcgcgaaagaacaaagcttccacagtgtggaaggggaccccagtgggttgccatgcttgcttgggtggccagcttttattcccttatttggccctgcccacaccctgctgattgatccattttacagcacgctgattcatataaaagcaaaaattgaatcagataaagataaacaggcaaagaagattttattcaaggcaattgcagtagaggagagggaccgtaacacagtctgacctcaactctgatgaaacaaaggacagttgagggagagaactctgggctgagagggagatcagggggcatctatttttgcaaattgactttacccatatgaaaacaaatgatagtatttaggcctgaagtctaatctcagtgccttcgaaatagagagagagagaaaaaaaaaacaataagaaaaagaaagaaaacttaaggataactttcttaatagaaaaggaaggggaaaaatagacatactttgtttccgttcgggcagtttgtcctggtatgaaagttagcaacgctggtataattggtttacaagacccatgggaagagtgttaccatctcagcaggaaaggggaccaaagtcaaagaaactggataaatttgtgaaatggactaagaggatgctcagaaagggagaacattgaggaggactaatgttatggattccaagaagttccttctaaaaataatgatgggttggtaatgtaaatgctacataaagatgatgtcagagtagttctgaagtttagagatcacggctgacttgtacaaaaggaatttaaacagaaatttgagtgtcaaaagcatgtcaaaccatgtttttctgggtttagctaaacaagggagaaatgtagactgccatctcaagaaacacagttgtgatgaaattgagacttctaaagaatttaatagaggtaggaacaggttaaagatattttttcattttctttttatttgctttaagcagggcaaagccttcagtatgtttataaggacatagaaacagagcattctatggttctcagggttttatgcctgagaatgttaaataagagagcaagttacagtgtaaatgaaggtgaaaaggtcagaacttaagtaagactttttgttttttttttgtactcaaggaggagtgatacaataaaacgaatatgaagagtttccaaagagtttcaactctggtctgatcatattcaatattatatttagggtaacatagttgtgatacacacagttcagtggagtgaatttcctaaaactatattttaaaactttactatttggagtagtgaacaaatgtaaaagttaaacttcaaaatcaagttcacttggctttggatttgaatagttgctccaataccgtgtaacttagataaattttctgtgtctccattttcttctttgaacatttttgtatatggtttaattccttacaaaaatcagttattttctcaaaccaatttgttagtttcaaaatggcaaaaaatatttaattaaaatggctaatatgcctacatatttttatgattgcattgaatacctaaccaactctatacaaaaggttgcttttgtttctaattgccacttattgtactagatagtaaattactactagttgggggctatctttttcatctttatttacccaactccttagtcaaatgacaagcccataataagcacttgattaaagttttctgagtgaagtactagagctaatactatctgatgcttccatagagttaattatgtgtttccaaatgcatattgaattcttctcttctttatactcttttatataccaactactgattattttattgttgtctttacattttattttttattctttaaatatcatcataattatttttcaaatgcagccaaggtcacaaaaagagattttttgaaaattaagaaaataaagataaagaaatagagtagagagaaagagtaagataaggatgtttttattattacccaatggtaatctaaaagatatgtgaattagtgccttctaaaatttatttttacattaaattttgctaatcccgttaaaattcatcaaaataagagggggctatggaagcatgtacagaaatttagcttctaatgtgatagaatatttttcttagaaagctttgctttggggaatacaattgttatcattagtgagttttcagtaactgccaaaagtccagagagatgtgatgaaagcagcaataagttttagaagttggaaaacatagattatattctccttcccctgtgt

SEQ ID NO: 478375 - DNA, 602 bp, Homo sapiens
aaaccagaagcccagccagctttacctttcaattttataggacttggtctgttgtcattggtgttaatgggtgagctagtgtctatgcccaattgtagcagcaatgtctcaggcaaattctatttctgtgttctcccttggttgcttcacaaatacctgtgccttgcaaactattgccaacacagtaacaaaggtgtctacacactggcaccgatgccattactggcccaggtccccaaactgcagtccctccacataggcccatgtttcaggcctctgctctgtggccgctccatgggcacctataatttaagggaatttgcagttaagggcgtttctctacccattgggtctggcttgtggtcctgctcccaatggtggttgtatcagtgtcttgtgagtgatgcccatgaagtagccacagagcagaggcctgaaacatgggcacaggtggagggactgaaaattggggacctggtgcagtaatggcactggtgccagtgtgcagacacctttgctactgtgttggcaatagtttgcaaggcacagataaattgactttatcaaaattataaactttgaaacatcgaaggatagtcaac

SEQ ID NO: 478376 - DNA, 863 bp, Homo sapiens
ggttaaggcaggaacaggccattttcacttcttttgtggtggaatgtcatcagttaaggcaggaaccggccatctggatgtgtatgtgcagccatgcagtggggctactgggctccaggctgatgctggggaatgtttgcaaagagtccagtgatgtgattcatcttcaagtctcccagccatggataccagcacccactctggtggaggtggcaggggagggaagtggactctgtgtgggtccttggttgtgttttgttgattgtactggttttgtgttggttggcctcccaccaggaggtggcactttcaagaggcatttgaagaaggtgtgcctaggatttaataaccactttaagatgacagtggcacagagcattatttggaaaatatataacttagggagtaacggacatacaggagccttggaatcaagggatgatggatactatggctattttactcacctagagaagaaagatcagcaaactacatgtttctaatgtaaagaatccaactgactaagtaggggacaaactaatctgtttgttggagccacaagtcatttgctatacctttatgtttcaaaaagatatataatatggcttataatgatgcttcagtcaacaaagtactggatacacaatggtagtcccataagaatatagtactgaatttttactgtacattttctgtttaggtatgtttaaatacataaatccttcccaatatgttacaattgcttacagtgttcagtatagtaacatgctgtacatgtttgtagcctaggttcaataggctactccatatggcctagctgtgtagtatgctataccatctaggtttgtataagtacactctac

SEQ ID NO: 478377 - DNA, 453 bp, Homo sapiens
ctgccagcacgctgtcacctctcacaatgatacattttctaaagccagcccaagtggtcataggcaccaagacagtccctgtgattccaggctttagactagcccctgcagacccagactccatgcctgccccagaaacgggcccactccaggctccaagctggttccaattataccaggctccagtggactcagggtccagacctgctctagcaaaaccagggttcaggctcatccaagtagaccccagtgccaggccagcctctgcagaaggaggatctagaaacactcctccagatctaggcttcaggacagcattggtggacccaggacccaggttcagtcccatggacttagacctcaggcccattttagaggacataggttccaggtccatcctgttgcctggctggctcctaaagactcgggtacaaggccttttctaatgccaag

SEQ ID NO: 478378 - DNA, 795 bp, Homo sapiens
gggtccctgacttccaacatatgtttcctatagagattatttcatcacccaggtctggtagaattcagctgtgaatccatcaggtccgaggcattttctggtttgaaagcttcctattactgatgaattttggaacatttgttgatggcttcattcaaaaagcttcatctggaagatttcatgggggtggagtatggctcagctcaacactcaggctgttcactctaacccttgggggctggtgtcaagcccatggctttgttctctggaccctcaagattaagcacctgctgcactggaggggaaaagtgtttttcctcagcattcagggcatcttggaaatggagactggacattctgcaggcaccaagcttgccagcgccttgattgacatctggtgtgtaagcagtcaaaataaaattaataatgttgaatatcaaaaattaaacacatacagtaaagtaaaatatattaaaaagaaagacaatactcaaatctcatcacttcctaattgttttactaaatttactatttcctatggtcttgaatttatgttcacctattatatctgtatggtgaaaatactataacagtgtgccacaatgtgtaatattctctcaggtaactgcccttgatctccaattctttgttctcttccaatagttgctcttctggattttaaaaatgtaatctttataatgagtagagagaaggagggaacacttcctcttggcccctctgccaggtactaagttgccaaggtttacctacaaaactgggaactgtcacaaggct

SEQ ID NO: 478379 - DNA, 1223 bp, Homo sapiens
gtgtggtcattgttatggtagccgtagagagctgatatggccagatgcggcggagagaggaagcccggctggacccacgtggcttactgtgaaatcagccagtatggcctgcggtggggagaagatcagaaagctgacaccaaggactctgcaggcccacccatggccagctatgctcctgccttgccctgcctgaatccaggtcccttcctttgccctgctgccatcctagcaggagacagagagaggcctcctactcagagtagggtgtttgtgaagggcaccaggacaagctgggacagggccagggacagaggccaacaaccctggggccgtggggcctcctgcaggctgaagagggtgctgagagaccagccctcccagcagtgcaggcccctttgcaaggagcagctcatgcattctgcccagtctgatgactttccaccagtcctgacatggccaaggttttcctcgctcggtgacaagggagggatgcgggatgtagaaaacccaagatatcagcctttccggttccagccctgcccgggaaacatcaaaggcattgaacattccacactgagctgtttagggggcaccacaaggcgcttagataagaggggtccttgagtatctggctcctccatgccaccctccctgccctacatagccccactctccatacaggccacatgtttctgtcctgttttgatggggcagtagcatgccttcaccttgtccaaggatgtggggtgagacccaccatccacatgtgccatgcactggctctgctgaaataaagaagatccctctgggttagggagggcaggtgagaggccctggggtctgcacaggtggtgtcggctcaggttccgcttctgcctgccagctgtgtgtcatgggcagatcagctcattcttctaaagctcaatttccacttccacagaacgcaggcaacagcagcccttcatggggctcttgtgagtcctgttatttatcacacatggagtgtctcctagaattctctggcacacagtaggagcttaataactgttactaccgtcattcacagatcccaaaagaatccttgattgctcttttattctgttcccaaatatgcttacctgcctctgtgcagagacctttggggatggggaaggcggtgaagggggagcacgtgggctctgccccaccaagctcttagacacacctgttcctatgctggg

SEQ ID NO: 478380 - DNA, 674 bp, Homo sapiens
ttccctgaccccttgcgcttcctgggtgtagcgatgcctcaccctgctttggctcatgctcggtgcactgcatccacttgcccaatatcgaaccggcaagggtcagacttgcctcaggttgggccctgtcatccactgaaagtgagatggaatgagcttccaaccaggaatttcaatatgtggactctgggcaagatgaaagagcagacagttgccctgagtaacagaaaagctagaaaagggaaaagagaaaaatattgtctgtggcggggtggggaaggcaaagagctcagggaggccagagaaggacctacccattgcagtaacagtgaattaaagttcagggggctgcttatcagtcgtgaagggatcttttttaggagtaccatcagctctcgtttccctatttcaggagaaaaacagttccccatgtcccatgatcctttacatgccgaatcctgtcatccacagccatcagcagagtgcaaggcagatttaatttctttaatcagtcttttaagctgtttgtttttctgtaaagtctttaaaatactgaagtatttttagaagcttttgcacatcaatagacatccttcaatgagactgatgtaagaacccttattttcaaatcacttcagtgcagtgttgttcatttaaaatgttccactgttcta

SEQ ID NO: 478381 - DNA, 758 bp, Homo sapiens
tcccacccccaatttctgagtgagagggtttattttttacaatttaggaaaatctcaacagctccagggctgagttgccagtgggtgctggctggacccagggccaggcgtgtgtgtctccaggggatgccagctcccaccactgctcacgccaaggatgaaacagcccagctctatggtggagacaattcctggacccaggagatggtgatgaattgttgtgtaaatctgtcccacgggagcaggcctctagtcttcagctaccttaccccgcgggctgccgctgtgaatgctgagaagggcgctgagtcaaactgggaagatgggaggaatgtgagcaactcagtggcctgtgttgggaggaatggagaatttagagaatacagggaccagcgtgcgtgttgggccacgtttccaacaacagcatcaatcagagtaaatgtcatcccctctctttcgctctatggaggcagaacatcctgtagagggccatcttctgacactctcagcagagcaacacagcatctcaaccaaagggtgggtgtctcctccccagtgacaaaaagtacacttctcagctgcatcccaacattcaccatcactcatctctacttctacgatagctgaactctccttacaaatatgtacccttcaatgatttgtgagaaatgagttaaaaacaaaacaactccagagagttctgttatgtagctcctacagatggtgctaaacatatgaaattaaacaaaatgataccc

SEQ ID NO: 478382 - DNA, 554 bp, Homo sapiens
ccgtgcacttctccagcattggcttgtcagctccgcagggggcagaattaattccgttactccctgggcaaaacctttaaatggcttccctttcatccaggcccaactcagtacatttgcctggcccacagagcctctacaacttgtctctggcacacatcaccaagatcgtttttactcaaagtcgctgtataaaatgctacgtgcctggcacccttctaagcgagttacaagtattagcccacttaatcttcatgtcagccctccgagctgggcaccgttatttacgtcatatttttacagataaggacactgaagccattcgaatgcagaagcctttcacagaaataagcagtctagagttggaagctgagaaggtgtggaagcactctacgctgccggagatgccagaagactgcaccgctcactgcataatgtcatggttctctactagaatccccagaaccagaaactcacaattctgtctgcacagacagatcgtgataccacctgtgatgacagaatggacacttgtttctccttgttgaggccct

SEQ ID NO: 478383 - DNA, 2611 bp, Homo sapiens
agtggtaggggcactgctgcagggggtccaggggtgaatggtcatgcaaggaagaacctttgtcctctggggcagtgcaccttccagtgattgcctcagcatagtggacatggatgagggggtggctcatttctcattggacaagctttttttaagtgtccttgtaaaccacactaataacaagccctaccgtgtgattggcctgctccattatctgtcctctctgaacaaccaagaccacaaagaggaccgagaaaaaccagatttagtggcccttaccaacacattcaaaaacctgaaaaactggaaaagcacaagagacagggagtggtttttagaaacaggactagccttggagaagagaggagtgaagctgcagaccttcacagtgagtgttacagtttataaaggtggtgcatctggagttgttcattcctcgtggtgtgttcatggtctcactgacttcaggagtgaagctgcagaccttcacacagttatagcttataaaggtggcgtgggcccaaagagtgagcagcagcaagatttattccaaagagtgaaagaacaaagcttccacagagtgaagggtgacccaagcaggttaccagtgctggctcagctggcctgcttttattctcttatctggcccacccatatcctgctgattggtccattttacagggagctgattggtccattttacagaaagctgattggtccattttacagagcgctaattggtgtgtttacaaacctttagctagacacagagtggtgattagtgcatttacaatcctttagctagacagaaaagttctccaagtccccacctgattagttagacacagagcactgattggtgcatttacaaacatttagctagacacgcagtgctgattggtgtgtttacaatctttagctagacagaaaagttctccaagtccccacctgattagctagaaacagagtgctgattggtgcatttacaaacctttagctagaaacagagtgctgattggtgcatttacaatcatttagctagacagaaaagttctccaagtccccatctgacctagaagcccagccagcttcacctctcaccatcatttgatagatgaagaaagagcccaagaaacaaagagttctaagaaagtgaaggcagagaccagccaggaaacctcatgtaagtagttcattcttgttgtataggactccccactacataacactcagcttccgtgttcctaaactcaatctataccaatttatttctaattgtgtgggtttgaggagaacccttgacagcattccttgaaacattcacattctttccccaaatctttgcagaaaataatgcataaataataagtgactaagatttgtcatggtatatttagagggaaataaataatttctgtcatgcatgttcatgtgaagagaacaccaaacaggctttgtgtgaacaataaagctttttaatcacctgggtgcaggtgggctgagtccaaaacgagtcagtgaagggagataggggtggggccgttttataggatttgggtagatagtggaaaattacagtcaaagggggttgttttctggcaggcaggggcaggggtcacaaggtgctcagttggggagcttccaagccaggagaaggaatttcacaaggtaatgtcatcagtcaaggtaggaaccggccattttcacttcttttgtgaatcttcacttgcttcaggccatctggatgtatatgtgcaggcttgggctcagaggtctgacattcctgtcttcttatattataagaaaaataacaaaatagtattgaagtgttggggcattgaaaatttttggggggtggtatggagagataatgggtgatgtttctcagggctgcttagagtggaattaggggtgatgtgggaacctagagtgggagagcttaagctgaaggaagattttgtggtaaggggtgatattgtggggttgttagaaggaggatttgtgatatagaatgattggtgatggcctggatgcagttttgtatgaattgagaaactaaatggaagacacaaggtctgaataagagaaggaataaagcaggcattaaaggactaagaattggaaggacccaggacatccaattagagagtgccaagggggttcagcataattacttgcttggttggtgagttttggggctccatccttgagtttttttatgttgtcatacaccaggccagattgatttaggtaaaaacacttttcatttaaaaacatagagtctcattttttttagcagtgagatggcaaaaccaggtatccaaaggcgaaagtatccaacaatgcccaggaaggaaagcagttgctgttttgtagaagggattgggctggagagatcagtcagacgcaattggcagggagaatccatgtgtttgcatgaagaattatgctaagataggtaatggatgaagaagaaatttgggcttgactgaagtaatggaggctgtctgcaaagccctgtggcagtacagcccaggcaaaatggggagtttataggctttaaaaattgcaaggagagtttataggctttaaaatcgccatgctgtaacag

SEQ ID NO: 478384 - DNA, 2855 bp, Homo sapiens
cccgaatagaatggaatggaatggaatggaacggaacggaatggaatggaatggaatggaatggaatggaacggaacggaaaggaagggaatggaatggaatagaatggaatggtatggaatcaacgcgagtgcaggggaatggaatagaatggaatgcaatggaatggaatcttccggaatggaatggaatggaatggaatggaatggaatggaatcaacccgagtgcaatggaatggagtggaatggaatggaatggaatggaacaacccgaatggaatggaatgtaatggagatgcaatcgaatggaatcgaatggaatggaatgcaatggaatggattcaacttgaatggaatggaaagaatggaatcaacacgagtggaatggcaaggattggaatggaatggaatggaatcaacccgagtacaggggaatggaatggaatggaatgcaatggaatggaatcatccaatggaatggaatggaatggaacggaacggaatggaatggaatggaatggaatggaatggaacggaacggaaaggaagggaatggaatggaatagaatggaatggtatggaatcaacgcgagtgcaggggaatggaatagaatggaatgcaatggaatggaatcttccggaatggaatggaatggaatggaatggaatggaatggaatcaacccgagtgcaatggaatggagtggaatggaatggaatggaatggaacaacccgaatggaatggaataatcaattcgaacgtaatggaatggaatggaacggaatggaattgaatggaatggaatggaatgcaatggaatggaatcaacccgagtgcaatggaatggaaaggaatggaatggaatggaatggaaactacccgaatggaatggaatgtaatggagttgcaatcgaatggaatcgaatggaatggaatgcaatggaatggattcaaattgaatggtatggaaagaatggaatcaacacgagtggaagggcatggattggaatgcaatggaatggaatcaacccgagtacaggggaatggaatggaatggaatgcaatggaatggaatcatccgtaatggaatggacaggaatggaatggaatggaatggaatggaatggaatggaatggaatggaatggaatcaacacgattgcaatcgaatggaatggaatggaatgcaatggaatggaatcttccggaatggaatggaatggaatggaatggaatgaatgcaatggattcaactcgattgcaatggaatggaatagaatggaatggaatggaatggaatggaatggaattaacccgaatagaatcgaatggaatggaatggaacggaatggaacggaatggaatggaatggaatggaatggaatggaatggtatgaaatggaatggaatggtacgaaatagaatggaatggaacgaatttgcaggggaatgtaatggaacggaatgcaatggaatggaatcatccggaatcgaatggaatggaatggaatggaatggaatcaacccgagtgcaatggaatggagtcgaatggaatggaatggaatggaaaaacccgaatggaatggaattggaaaggaatggaatggaatggaaaggaatggaatgaagtcaactcgagtggaatggaatggaatggaatggattggaatggatttcaatggaatgaaatggaatggaatggaatggaatcaatcattccgagtggaatggaagggaatgtattggagtggaaagaagggaatggaatcaacccgagtggaatgcaagacaatggaatggaatggaaaggaatggaatggaatcaactcgattgcaatggaatggaatggaatggaatggaatggaatggaatggaatggaattaaccggaatagaatggaatggaatggaatggaacggaatggaatggaatggaagggaatggaatcaacacgaaatggaatgcaacggaaccgaatggagtggaatggaatggaatggaatcaacccgagtacaggggaatggaatggaatggaaagcaatggaatggagtcatccgtaatggaatggaaaggaatggaatggaatggaatggaatggaatggattcaactcgatgacaatcgaatggaatggaatggaattaacccgaatagaatggaatggaatggaatggaacggaacggaatggaatggaatggaatggaatggaatggaacggaacggaatggaatggaatggaatggaatggaatcaacgcgagtgcaggggaatggaatggaatggaatgtaatggaatggaatcttccggaatggaatggaatggaatggaatggaatgaaaggcaatggattcaactcgattgcaatggaatggaatagaatggaatggaattgaatggaatggaatggaattgaatggaatggaatgccttcaaaccgaatggaatggaaagcaatggaatcaacacgagtggaatagaatggaatggaaaggaatggaatggaatggaatgctacggaatagaatggaatggaacgaaatggaatggaatggaatggaatggaatggaatggaatggaatggaatggaatgcaatggaatggaatcgttccgagtggaataggagggaatgtattcgagtggaatggaaaggaatggaatcaaccagagtggaatggaagggaatggaatggaatggaaactaatagaatggaatcaacacgagtggaatggaatggaaaggactggaatggaatggaatggaatggaatggaatggaatgaaatcaactcgattgtaatggaatggaatggaatggaatggaatggaatggaatggaattaacccgaat

SEQ ID NO: 478385 - DNA, 822 bp, Homo sapiens
tggaaaggactggaatggaaatggaatggaatggaatggaacggaacggaacggaatggaatggaatggaatggaatggaatggaatggaatggaattgaatggaatcaactcgactgcaggggactggaatggaatgcaatgcactggaatcaacccgagtacacgggaatggaatggaatggaatgcaatggaatataatcatccgcaatggaatggaaaggaatggaatggaatggaatggaatggaatggaatggaatggaatggaatcaactcgattgcaatcgaatggaatggaatggaattaacgcgaatagaatggaatggaatggaatggaacggaacggaatggattggaatggaatggaatggaacggaacggaatcgaatggaatggaatggaatggaatcaacgcgagtgcaggggaatggaatggaatggaatgcaatggaatggaatcttccggaatagaatggaatggaatggaatggaatgaaatgcaatggattcaactcgattgcaatggaatggaatagaatggaatggaatggaatggaatggaattaatccgaatagaatggaatggaatgcaatggaacggaatggaacggaatggaatggaatggaatggaatggaattgtatggaatggaatggcatggaatggaattgtatggaatggaatggaatggtacggaatagaatggaatggaacgaattgtaatggaatggaattgaatggaatggaatggaatggaatgcaatcaacgcgagtgtaggggaatgtaatggaacggaatgcaatggaatggaatcatcc

SEQ ID NO: 478386 - DNA, 561 bp, Homo sapiens
gagtcactcccaggtgggcagtatgagtctccctcgatgggccctgaggcaccctctgggtgtagagacttcctctcttgatgaccgcgggtaccatcattgtcaaatgaatcccatgcaagagcgagtgtctgagagtgagttgcccaattggctgctgaccttcttcccctactgggtgcagctaatctatgaacaatctgaaagcactggaggtttgttcccttctctcctccagcagtcctggctgggcaccccagctgtgtggccccctgatttcctcccaggcccctgggagacatacatagaaccacaccctcacatcaactcatcacatcaccagcgcttgtccacacgtgtggtaggatgcagagtgctctgggcaggccactcagaggcccaggtctgctccatggtcccaggcgttccctggacctgcttgtggtctcctcatttgttgagtggatggcttcgtctgaaggcatctgtgacgatgtgtggtttctgcctgcacttcttaccccagtcatagagacacttggaggcctctccttgtgcctc

SEQ ID NO: 478387 - DNA, 817 bp, Homo sapiens
gtcttcgcctttctgagtccagttaattgtattcgtttccgtcaagcatgtacacagtctgtggaatgcttatgacagaggtgacttttcttccagttccaagctccactcacgcgaggcacttgctcaggctgtattcatggaggagatgtgtcggtggtcaaagcactcaaatacttccctctcattcggtggagagtcgctccccgaaatcaccttcctggccacctccgtcagtccctcccctaggttattctagatatttctatgcctccagtaatgaaaggggtaattccctgcagcagagccgccgagcccctgccctttctcgaagctgcccctctatttgcttggttgttgcccacgcccctcgggctgttaaatattgcgaccatcacccctgtttttcagtaataagaaagagaagccatgtgcatgtgcaggagaatggggccaacagccagcaccagagatgtgaaagcagagactgggatgtggcagccagcaaggattgctgccagccaccaaaagtgggaagacgccaggaagaattctcctctaaagcttcagagagagtttggccctgccaagaccttgaattcagctcagtgaagctgatttcagacttctggccttcagaacaccctgatcattccttatactctgaagacagccaggtccttcctcctcagttgtttcaagaaaatggcaccacagtcaatcacaagaacaaagaagacaaaccttaacttttatgtatatcaaaatacactttcagagctcttaatggaaaaaatagcctggtttttgatcctta

SEQ ID NO: 478388 - DNA, 715 bp, Homo sapiens
tggcacctcctctctctctctcactcctgctctgccatgtaagacacttgctctcgctttgccttccactatgaggatccactggaaatttgcacctaggaagtctggcttgtgctccaaaccactgggatacaccctggatacgctttatctcccaaagaggaagagagttgctcagtttatatgttgcatgagtgagcaaggtctccatcctctgaagctggatgtgattggcgctggaggatctgctggcaaggtgaatcacttagatgaatcactcaaatgccaggcaattggagccagcacttggtgggaggcctcagttcctctccatgtggactctttcctactattgtgtaagcgtcttcatgatatagtgggtagacttccctcaaaacaagaagagagaaatacagagagccagagagaagctctttacatgtgctctgaactacatttttatgacctggctttggaagtcagttattaccattctgctgatcagtatcaagtctctaagttggagctatattcaaggggaggaacctcagctccaccttttgaagtagggagtatcaaaaatttccaaatatatttttaaactaccatgggagaaacatatgtacattacacgtaagtaaacaatgatacaaatgacttctgacttcctgcagaaaaaaaaaggagtccagaaaacattgagatatttttaaac

SEQ ID NO: 478389 - DNA, 1469 bp, Homo sapiens
tcatgaggggtctcctgatccatggccaccacgcccatcctggtcatgacttttcttggcaattcctctgagttcctgaccctcattcagtctgctttgttgccctttccccttgtatcttctgagagccccgcaagccacaaagagatttatcacagtgtcatttgtgaaaactcatcacactttgcaagctgcctctgtggggaagtagatggtgttttattgatgcttaggtattgttgcgggatcctgaggaccagagagagaccttggggtgtaaacaggaggatacatttattattgaatgcactcagacctagcagactcaatgtccaaagactgggcccagaacaaagacagcacttgacttttatacacacttcacaaaagaggtgggctagtttgaagcaggcttatggttacggtcacgtgaaagcaaggatacagaggcagaacaattaattaaattgtgacaggtttataactcaggattacacatgaccattgccaagcaacccagatgtccattatctaggttttgctctaaagagccttgcactggttcatctcataacgtttactatggtgcccaggcagcggtagttcaggcctgctcaggcttctgatgaccttcattgtacttcttagataaaacagaatacttgaagttactagttacagagaacaagaatctataaactcattccataaaacaaaggaaaatttgttttttcttctccctgtgttgagggagtgctgggagagtctccagagcgcattagataatattatcaggacttttcctgggtctgggctgtgcctgttgctatctctgggacaagtcagcctaatacaggaaagcttatttttctttctttttaattttatttttctttaatttcccacctcagtatcactactaaagtttacatcattttgtgtgttttttagataaattaattactatacggtatttgactctaggcttcaaagtcaggtttcgaattatgaaacattcagttctactttccagtcttcattcccacaacatacttgccaggaagatatttctcaaaataaacacctgtctagcacactgaggtttcacaagtatattgggtccttgcccaattctctctgtatttaatatctctttctttggagtaagatttttctgtaattaaaaaaagttttttgaaaaacaggtgtctatattgttttacactaaactaaaactgaagtaactaacaagtacaattcactgcaggtactctcttcatcttgtagttcacgcttaagcactgaacctgtgctaagaaatgaattaagggaaatttaatactttagtcagatatattgataccaccaacaatcaggttcttttagtaaggaggaaggggagaatggagattgactgggtatcaagcaatcttaccacatgtattggtatatattttggttgtttacag

SEQ ID NO: 478390 - DNA, 1018 bp, Homo sapiens
gcgttctactgctctggttgtgctggcagctgattagattgtgcccacccagatttagggagctgagaccttgccaaggtgcagccagccgtggagcatgcagaaaggatctggggaaacaaacagcccaagcccgtctcttcccttctgccaatctctggtcattcccccttgtggctgtgcccatctgaaagccaaaggcaagagacttcgttatgtggctcttaaaggccagcttcctgggacagagaacaggagtgacttccagaacagtgccacagcatcagcccacttggggagctgccgctgctgccacagtcccgaagcgggaaaatcaggaagcagacatggcaaatggtacatccaggaatacaacgtccctgctgtgatccatgggttgggagaaggccacggcagctattgcctccagaagagtgctgcacctgccaggtccactttcgcagaacacagaccccctaccatgaaatcagcaactggacactgggacctctgccactgttactgcaggaaaacccagggcccccgtgaaccagccggtcaacagcagcattggacagacccaagttgagacctttaccttcgacacactttctgaatctcatgcaactgtttatgtttggccaacctaaatcctatttgcattttaactgcaagagattatgggaaatacctctttaagtttttcagtctttcagtttgggaaggcactctagggtaatgggcaggctaggatagtgggggtttgccagcaaccaataaacatacatttaaatcaaaagccagattgtctgtgtgtgtgtatgtgtgtgtgtgcatgcacatgtatgcatggttttacgatgttttacaaaactatattaactttactagtgtaatgcactctagcctgttctattctattctattctattctattctattctattctattctattttctattctattctattctattctattctattctattctattctattctattctattctaa

SEQ ID NO: 478391 - DNA, 927 bp, Homo sapiens
tgctgttatgaatagtgctgcaataaacgtccaagtgcaggtttgtcaaagatcagatgattgtagatgtacggcattatttctgagggttcttcaggaccctcagctgcaggtctgttggagtttactggaggtccactccaaaccctgttttcctgggtatcagcagcggtggctgcagaacagcagatattggtgaaccacaaatgctgctgcctgatcgttcctctggaagttttgtctcagaggagtacccggccatgtgaggtatctcaagctgcatgctgggagaaccactactctcttcaaagctgtcagatagggacatttaagtctgcagaggttattgctgtcttttgtttttctgtgccctgcccccagaggtggagcctacagaggcaggcagacctcctcaagctgtggtgggctccacccagtttgagcttccaggccactctgtttacctactcaagcctaggcaatggtgggcaccgctcccccagcctcactgccaccttgcagtttgatctcagactgctgtgctagcaatgagcgaggctctgtgggcataggaccctccgagtcatgtgcaggatataatctcctggctccctggggtcaagcaccagcagtgctggggatatgaactgctcccaggaagctgccaaaacactcaggtgggttagtagaggctgtgctgtacgtacccttttgaaggagcatgaggccagcagaaaagacggcatgtggatcagatgtgccctggtcccatgagaaaggatacatgtgcacaacgtgcaggactcatgtaatatgtatattggtccacttactgttattcccttgcttcctttttttcactttcatggctattttttccagggtactctctaataaactgtcatattccaggtcttcctggaattt

SEQ ID NO: 478392 - DNA, 546 bp, Homo sapiens
gtttatacatcccagttcacagaataggaaaagagtgtggaaatggtgattaggttaatggaccttgatcccttttcctgggggtatgtttttatagaaagaggaatgcagtccatcctattaaaacttttactggacctgttccttccaagtggcatcaataccatttccccaccaagacttcagaattcaacaggaccccaatccaagaaaatcatccttgcttacgaggatgtacacagtcacatccctggtcctaggacccttggcatcaggcagtgctccagtgcttcttactgggacaaaaaaaaagtgagattatatgggaaaaatcatataaccacactggcagcaggagggagatttccacccctgctttgccagatcccccagaaaagtgagaaatctatccagggggagccttcctttatcctcccccatgttgagtgtgagcacacactcatgaaggcaagtccctcatgcctttgtcttctcttgttttaggtggtaaatatttcaattgcctgttccaattctctattaaac

SEQ ID NO: 478393 - DNA, 732 bp, Homo sapiens
aaggcctaggaatggattttgtgagggactcatcttcccctgccaccaccactaccatctccctctccccagatcaaaccctcaaaagaaaaaaagaacataagaacaaaaagcccccttcaaatgacagcaatttcaaaaagataaagaaacaccagccctctcagataaggaatcagtgcaagacctccagcaattcaaaaagtcagagtgtttccatatctccaaatgatcagactaagtctccagcaatatatcctaaccatattgaaatatctgaaacgacagacctagaattcagaatctggatagcaaagaagctcaacaaaattcaacagacagttgaaacccaatccaaggaagccagaaaaacaatccaagagttgaaagataacatagcttcttttcaaaataatcaaactgaacttctagaactgaagaattcattatatgaatttcaatatataagtggtagccttaacaacagtctaaaccaagctgaggaaagaatttgagggttgaaagactgggctttcagatgaatccagccagacaaaaaaataaagatttttttaaaaaataagcaaaaccttcaagaactatgaaactatgtaaagagaccaaacccatggctcattgcaggtttggttcttgaaagaggaggagagagagaataagccaacactaagggaattcattaccattagatcagccttacaagaaatatttaag

SEQ ID NO: 478394 - DNA, 940 bp, Homo sapiens
cgctgtgcaaatacactgaggatatcatgctgattgaatgtgttgaagcagctaccaagatccatgcactgattcttatggagccttacccaccttccgtggctccaactgaccccaggtggtccagccctgctggcactcccaatatttctcacatgatgagacaggagcaagtctccagcaaagggtctcagaacggtacagatgctgaatgttcacctccaattcatccctcacactgcagaagctgtggacccaggagaattttctgcatgtggtgccatgccagtctggaaaagggggactgcagtcaaagaaaactgattctcttaccattcactcatggcatttttagattctgtggtccaaagaagtgtatcagcctcactcctgaattctgggatattcaagatggaattcttgcctgtgcataattgctaattggatttcttttgcgggcaaggaatgaagccagagaactccatgttgctgacataactccctgttattcctaatgattttaacttacaatatcttaattatattacagaagtttgtgagaggatgttcacaaaataccaagcaaaattcatgactcatggctatttctcaataaatatcaatttgctttctttttttcattctcttctactcattactcctcccctacactaataaattaaaatacagggatcagtcagtttaatactgttttaaggaggactacatgttatttggagagaagggcaataagtccaccaaattcacatgaccccaagaggctacaagaaaggaaccacagggagattgtatactttttaagaaagagaagggaattgacaaagatgaggtctggggggaaagaaagcttacggaaagaaaagaaaatgcatgggctcattgtcaatgtctttcatagttaccttagagtatgaaacaa

SEQ ID NO: 478395 - DNA, 593 bp, Homo sapiens
gcgaagcgccgggcagctagggaacatggccctggaggggctctgctcggccctcaaagatggacaaaatgttggaatcaagcacattcctgcaatccagtatgacatttggattcaaaccagcaatgaggtcattttgcttcaccaaattatcctgtctcatatccaccaaacaaggagcgtatctacattttggacgctgctccacgtgaaagaatcgagcttcgatgaacattattatatagagccatcatttgagtattatccaatggagcactcaaatgaatccaagagagacattgttgcagtctacgatgaaagcagttctattgaaaacctgaaggccaagtttcgcagcactgtggccaatgatggaatgcttaaaacaggaataggcgtgatacaaatgtgggcagatgaagtacaagtgaaacagcctcaagaaaaggtcatggcttgcaaaactgcttttcataaaaccgggttccaagaaatgtttgatcctccttattatgaactgttttcgctaagggacaaagacatttctgcagatctggcagacttgtcagaagaactgaacaaccactagaaga

SEQ ID NO: 478396 - DNA, 619 bp, Homo sapiens
gagtgccagaagctgcctctgtggttgagtcaccatgtgcatctcaccgtgctgaatgtgaggaagtggagtggcagcccacagtcagttccgcatggtcacaatagagatccccacaactcacttgtccatgggtcaccctgtgttccacagccttgtgcttgtccctgtgctcccaaggttactaggtgctgggcttggagctcatggccatctcactctcccccaggccgacaaccccacctgcccacctgctgtggccagctcgggggatgcagggccccactgtcccttagtcagcatgaggccaaaatgggcccttcatccccagcattcacacttgctcagacacacgagcgaggtgtctggggcctcaatggcagtgggtcatgatgctaccagtaaacaaggctcagagtgcaatggcaagagcagggactttgcaagcaaactgagcagcatttgggttctagttctgttactctgccttggggtgaattttgaatctctgagctcttcatctgattcttagaatgagaaaatagttacatggcaggattgctggaaggattataaagaatatcaataataataaagtaaacctttatcgaatattttg

SEQ ID NO: 478397 - DNA, 726 bp, Homo sapiens
tcccgccactgcacacaccttaaaggcagagacggttgtttgcttcactgtccttgatcctggtgcctggcacatagtaggtgcacaggaaatgtttgttgaataaatccctggatgggtgggtggaagtggactggcgtcccagctctgttcctggctgcctcagccctgctggcttttcccaaagcacagaggacagtgccctgcctgtggcaggaacttcgggaccttggatctaccccaaacactgctggggaaagtgctagtcctctggagggaatagatgataagagactggccgttgtcaccactgaaggcaatgaagaggtgccccctaggcagcggtgtgtgtgctggagctgcccaactctgtgcacactgacctcacgtgagcagattcaaatgggccagggtgggagcatttacaccgtggaaatcggcaaacactgccaccagaatcaactgttcccacattcaccagcacacccctgctcccaagaacttggaaatgaggctgctgtcagagttaaagcagaaattccacccccagggcatgtgattggcctttggtgggggaaaccagggggctgaccatagggtgagacatgggttgtgagagcaccccaagctcttaactcctatcaagttgggcagcgggatctggggagcacatcgcagcagccatgcggagtggctgtctcctctggagccccagaggaggtgtgg

SEQ ID NO: 478398 - DNA, 733 bp, Homo sapiens
actaatcttttgttgtgagcagcgtcatttatcatgcactacttgcccgaaaggcaggcagcacagagggatagctgagccatggaaacgtgtctgcgtcgcactgagtgggagtggcctgccagcaggagtccaaggtcatgggagtcacctcgcctttggacaaaggcccaatgcagagatacctcaagacaggaccctcagctgcaggtctgttggagtttgctagaggtccactccagaccctatttgcctgggtatcagcagtggtggctgcagaacagcgtatattggtgacccgcaaatgctgctgcctgatcgttcctctggaagttttgtctcagaggagtacctggccgtgtgaggtgtcaaaaatcaagaagggaaacagaaacacagacactttcttaaactctatggtagcttatacaataaagtcttatagcccacaacgtagaattgctgtccccagagcacaggttcagggatgtctgtggccttccaaaagctggccggccatggcatgccacctcatcatgctgacagctgaaggctcctgggacaggtgcatacttcaccctcctggaacccccaggacctacccagttacaggcttctggaccagctcagctccatctttttagagccacattctctcaaagctttgtcattctagtttttgctcctctccacatgctaagaaaatcaggtagagatttcttttctgatggca

SEQ ID NO: 478399 - DNA, 698 bp, Homo sapiens
gttagtgttgctctgtacatccactcagcccagcacgaatattgtaggcaaacccatgcctcagtaccagcactgggaaaataaaaacacacatccactgaaagtgcatcagcagcacctgaaaccctccagaaatgcaagttttgagacctcacctcggaacagcaaagtcagtatccctgagtcagcccagccatccatgatgcagcaagcctttcaggtgactctgatgcagcataagtgcctatggaaagcagcttccctgccccagggctggaggaacaaagcctcagtgtgggaagctctgatggggccctgcatggggctgggtgcttccttgaaaaaggaggatcccacagagcagagtgaaaacctgaggaggggcatgcttcacctcttaggggacgcaggagggaactcttcgctgatcctcaccctggaccaaagtcagtcctcctgcactttttcccatggcactgtcgagcctttccatcccggagttatcctcaccgagttgctggtctcccctgctgggccacaggctctgttaagggcagggactgcgtcagacttcaaaacttggaggaaaataaatgctaatcagtgttttctaagttcctgcactcgtgtcttggcacagaaggcgattataaatgtttgttggatgtgccaggcattgtaacaagcagtgtaaatat

SEQ ID NO: 478400 - DNA, 559 bp, Homo sapiens
agatcttcttccaagatggcttcttcatggcgtgtttggcacctcttggccctttgcctttttctgtcctcatatgtggtgtcgcatcttctaggccctctctacatagcttgggcttctcacagcatggtggtctccaagattggcttccaagacataggaactgggagctgctccccagggaagggctgcctcgggcagtgcctcttcctcctgctgcgtctgttggttggaggagtcaccgagtccccctgcttgcgggtggagaagcagactcgcctcttgatcggagtggttacagacacttctagagacagtcttcattttgatgctcaactcaaccaaacccatcaatgggccccactactcacttcttgtgagggaatcacaaggcctttcagtggtgctccatcgcacgcagaggacatgtcagttccttaatgggtcccgtgggacggacccctctctttgctctctgacttctctccctacccccctcccctgctttctggatcttttgaacacatcccatgttccggcgtcaggaggtatccgcctg

SEQ ID NO: 478401 - DNA, 571 bp, Homo sapiens
tctttttttttttgagacagcatctcactttgtctcccaggctcgagtgcagtggtgtgatcatggcacactgcagcctcgagctaccagtgggcctatttggattttggggacaacacattcatcatttcagtgtgttactccagcccattaatcaagtgacccgaaaggctgccagttttgagtggggtccagaacaggagaaggctctgcaacaggtccaggctgttgaattttggagcaatgccctgccatcttctgcagataacatctctgcttttgagagacagctcttggcgagttactggaccttggtggaaactgcatgtttggctctgggtcatcaagtcaccatgcgacctgaactgcctataatgaactgggtgctttctgacccatctagccataaagtggttcaggcacagcagcattccatcatcaaatgtaagtggaatacatgtgatcaggctcaagcatgtcctgaaggcacaaataagttacatgaggaagtggctcaaatgcgcatggtctccactcctgccaccctgccttctctcccttagcctgcacc

SEQ ID NO: 478402 - DNA, 841 bp, Homo sapiens
agggctatcatggtgggaaaggccaaatggaagccattagagctgcctctacctagaaaaatagtaaatcaaaaacaatattgcatacctggaggaactgaggagattagtgccaccatcaaggaattgaaagatgcaggggaggtgattccgattcccaccacattcccattaaactctcccatttggcctgtgcggaagacagatggatgttggagaatgacagtggattattgtgagcttaaccaagtggtgactccaactgcagctacagtaccagatgtggtttcattgcttgagcaaattaacacatctcctggtacctggtatgcagacattgacttggcaaatgccgttttctccattcctgtccataaggcccaccagaagcaatttgccttcagctggcaaggccagcaatatacctttactgtcctacctcaggagtatatcaactctctaggtttgtgtcataatcttattcttgtgatggttaatactgagtatcaacttgattggattgaagtgaagagagaaccttaatacaagtttatattaccaatattaccaatattttgggggagatgtagcaatggatttttcaattgtgacttttaaaattctggttttaaaaatgtttaagaaaatcaactatattaaatatgtgattgtattttgaaatgtttaatagggtttgttggtgttaaataaggaaacttcacttgtttaatttattagctaagttgtaaagaaaataagtgccttgagtttcaaggcttaaaacagcttgtaacagttacagttttaaaaactttggattactttaaacattagttactaa

SEQ ID NO: 478403 - DNA, 550 bp, Homo sapiens
cagccggggtcctagtagaaacgcatggaccttttgatattgtgatgttgttctacaaggccctgagtccctgttcattttttcaatatttttctgtgttcttcagactagataatttctatggctctatcttcaagttcacggatttttttattagtcatctgtattctcctgttgaaaccatccagttatgtgaatcagatcaccctcaggtaaaagaaaaaaaatccagaaaactcaccagtattcctgtcacactgacacttttctgggttgctaccaatggccattgcaagctggaatcagtagtaatggacaatagaccacctttgttttccagacctcttttgggaggtggcagtgagtttagaagagatgctgctcaatatctggctgagaagagcataaaccacttaagtcaggtagaaaggcctgaaagcatgggtactttaagttttgatgaacttggtgctcactaaaaagcagttcccaaaaactctttgatacctatgatctaacaatgtatacagcacagattagtccaagtttg

SEQ ID NO: 478404 - DNA, 1341 bp, Homo sapiens
taggcgttcccctgctgagcagagaagatgactgcagaattgagagaagccatggccctaggcccatgccgcccagtgaaggtgaaaaaggaggaggaggaagaagaaaacttcccagatcaggcatccagccaacaagtgcactctgagaacatcaaagtctgggccccaggggagtttcgtcagacaggccttgatggatcagaagaggaagaaaaggtgctgaaaccaagaaccttcagttactggttccaaaaactgagatacagtgcaaacctcgttgtgcatcagagaatccacaccggggagaaaccttttgaatgtcatgagtgtgggaaggccttcattcagagtgcaaagctcgatgtgcatcagagaatccacactggacagaaaccttatgtttgctcaaaatgtgggaaagccttcaatcagagttcaaatctgactgtatatcaaaaaaacctctccttagaaaaaacctttaggcgtagtaaatgtgagaaagcctttagttatagctcacaacttgctcggcaccagaaactccacattacagaaaaatgctgtaaatgtaatgagtgtcggaaaacatttactgggagctcaaaccatattgtccaccagaggatccacactggggagaagccctctgcctgtaacgattctggcaaagcctttatgcagattgcaaatcttattgtacatcagcgaagccatactggtgagaagccatatgagtgtgagtttgggaaaacctttagttgtttttcacaccttattatgtaccagataattcacactgcagagaaaccttatgactgcagtgaatgtgggcaagccttcagtcagctctcttgcctttttgtccaccagagaattcacagtggagatcttccttttgtgtgtaatgaatgtgggaaggccttcacatgtagctcatacctacttattcatcagagaatccataatggagaaaaaccttacatgtgtaatgagtgtgggaaggccttcagacagaggttgagcctcacggtgcaccagagaacccacactggggagaagccctatgaatataagaagtgtggtgcagctttcatttccaactcacacctcatgcgacaccacagaacccatcttgttgaacaacaagtaaggaagaggaagacttccagcattggtcataaccttctgcctcccaaatgagacacctctttgctgttttcttcttcctttataaagatgaggcctatgtccttaaaagttacagttttcaggaatgcagcacaaaacacaagataaacatttcagcagttaatttaaagaaaacagaaagtaagc

SEQ ID NO: 478405 - DNA, 571 bp, Homo sapiens
tacccttcctagcgtctgggcaggtagagaaagaccatcagttgggggcggggttaagcatgtctgagttcagactctccttgggcaggacttgctgcagccactgtggggttggtggttctcaggccaatgaggttatgttcccagggggattatggctgcctctgctgcatcatacaagccaccagggaagtgggggaaacccagccatgatgggcctcagccagctctcatgcagccagcaaggccagtctcactcttaccatgccccaacaaatcaccaggtttatatccaggcagtcagtgtgcagggctgagttcttgccccaggctacaagccttcctgctgagaaagcaagtagggctttcaggcttcacccctacccacatgccatggcttctgtgctcaaatctgcacttcctgtttgctccccacccccggattttaccctggaaaattcatgttcagccaaaattattacaaagttcagctggaagtttcctttaccctgtggttcttccacaattccactggcagccctccccaaggacccttgtgagataaagtctt

SEQ ID NO: 478406 - DNA, 576 bp, Homo sapiens
agctccctgacacctcaccagaagacaagcagatgcttgtgatgggctggacagtggatagcctgatgccatgagcttcttcttcccaggatgtagggggacagagcttaacagaactggagcccctggcttgcccacaaagacaccaatagtgagtgcagacatcaactctgatgagagcggctgggaggcattcctggtgaaatgcactgatggagcgtcctggtgtcagttaccacctcttggtggccataaacagaaaaaggctaaaccctccaaacttgtgcacttagcagactccgcttctacaaagaccagccatatccaaagcagctctctaatgaggagtcggcatgagaatcggattcacacttcagagaaaggtcagagactcctgctgagggcaccaggaaatagtggtgctctccaagatcatggcgaaccatacggtgattttaatttagagagggaaagaaaagaaactccattttcaaaaatagcctatttcgtatgtgttgacaagcaggaagtgaatgaagtcagaaggttaatctcatagcagagcctgcaagtcac

SEQ ID NO: 478407 - DNA, 769 bp, Homo sapiens
ctggggagagtttcaggaagcgggctttgctctggattggatgtgatcaagaaacaggggcgtcgccatgccggaatgtcttatctatagagagggccaattagattgctcctctggcaccctgctttccaatctcagctgccttatcatctcccacctctggattcaaccccctctgtccagtgaggttgccccttccaacttggccttcaccttcctgtgccatgatctggaaatcattcccagggagaaagcatgggatgtagggtgttttttctggatgtatctggttatgactgggtgttgccagaggagattaacttttgactcagtggactgggagaggaggacccaccctcaggagggcccactcacaatgtgggtaggcaccatccaatcggctgccagaggaactagaaaaagcaggcaggagaaggtggaagaagcagatttgctgggtcatccagccttcatctttctcctatgctgggtgcttcctgccctcgaacatcggacttcaagttctttggcttttggacccttggacttacaccagtgacagtcatgccagaataaactgtcattgtgattttattaaaatcaatgacataaatcattacaatcaatgattataaaataattgtaattttctaaaatcaatgaataattgtattcaatcattgggttaggcaatggtctaggtatataaacataaattatcacagcagaaaaaattaagctttacatttatttcttttgtaaaatttgt

SEQ ID NO: 478408 - DNA, 602 bp, Homo sapiens
agggaggagctgcccacagccctgggagtgggtgatgtggaagggaacccatcgtgcctctaggtgactgagccatgggttcgagggtctctgtatgtctttatcagcagcatgaaaacagactaatacatagctcattctactttacaaagaagggtgtggaagctctaagaaaggaagtaaaacgtgtaaggtcgcatgactattacttcactgccagagatgaccaccgtaaagagtttactatttatttcttacaatttttatgggcttatgttcattttatgtttgtgtcccttcaatatatattacttccctgtgctagaataccctgctggatatcagagtatggcaagaacaagacagacaaggcctctgacagacttcaccttcgaatgaaggaggcagacaagaggcaaacgaatgagtcaacaacgacatcccacaagaagaggcgacagggtgaccgggaaaagaactactccagaaaacgcatctctctcagtaacaaaggtccaaatcatacgtaagaatcagatattttaaaatatgaggaatgttaattgaaatggtgatcgcatttgtgtaatttcaatttgttc

SEQ ID NO: 478409 - DNA, 693 bp, Homo sapiens
acaccgtggccccttctgcagtcaacttgcccagcctcaacccagcccaatctctgcctccaacatttagagccacctgaatcgcaaagaaaggccagtgggtgtgagatgtttagttccggttttattaccatttattgccaagtgaccctaatggaaataccaaccatggtgccagatacaggacaaggacactgcctggcaaagaggctctgctcgattcctatccactctcatccacatcaccggtgtccccatggtcaagataccgtcatccccatcagaagtagcagccccagcatcctcatcaacatcaccatcgtcattctcaccatcgcatcatccagctcccatcaccttcatcatcgccatcaacaccatcatcatccttactatcgcatcatccagctcccatcaccctcatcatcacgatcaacaccatcaacctgtgtcatcatccccatccccaacatcatcatcatcaccgtcaacatcaccaccgtcatcatctacaggcccagggctagttgacttcttagattcgtaatgttttgaaagtaggtccatgttttatttacctttatgtctgctgcaataacagaaaatatccagccctatagacaagaaggttacctcatttgggagaacgcaaggttttgtaatttattgatctcattttacagatggagaaat

SEQ ID NO: 478410 - DNA, 1981 bp, Homo sapiens
ctgactgacgtgaagaagatggaatggaaggagcggaggcaaggagagcaactccaaggccatgttaataatttaggaggggtatttgatttggatggaagatcaaaccagctacaaggcctaatccagagcaaatccttaaatctcttaaattctctgaaagctgagagagaaaatgaaacttcagaagaaacgtctaaatctaatagaggttggttcatgacgtttaaaggaaagaagttgactctatttaacacaaaagtgcaaggtgaagtagcaagtgctgatggagaggctgcagcaagttatccagaagacctagctaagatcatcgatgaaagtagctactttaaacaacacattttcaatgcagatgaaacacccttctgttggaagaagatgctatctaggactttcatagttagaggggagaagtcaatgccgggcttcaaataatcaaaggacaggatgaccctcttattttatgtagagggttccactatattcattcattcatgaccatatatttgatattttggtgctgttttaggaaactcatttttaaagttcagttttctagtatagtatgcttatatataaaattcagcagatttttatattcatacctattaatcttaatcattcctttgtaggtaattttgaatgttctatttatacaatcatattgtttataaataatggctattttatttattcctattttaatcttaattatgtatttttcatgacttttgggtatgaaaaattgaatgtaagaggggatattaaacattcctatctcatttcccatctcagtcataaagcttttaaaatgttgctgttaggtatgatgttgtatatgattttgaatatcattgataaagtcaaacacatttcattctattactaattttctattttaaaaaattataagtaggtgttatattttatcaattgattctccaccctaatggaatttttatatatttttcttctttattatattagtgttgcaaaatgcattaaacccttcagcagtggggtagtaccactgtggaaaatagtatggaagttcctcaaaaaagtaaaaatacaactacaatattacccagaatcccatttctgggtacataaccaaaagaattgacatcagggtcttaaagagagacctgaactcccatgcacattgcattattcacaaaagccaagatatgaaaataactcaaatctctattgacaaacactaatggataaataaagtgttatatgtgtatgttaatatgtatgtgtgtgtgtgtgtgaatattatttagcctttaaatagaaggaaatcttaccatttaaggataaaggaagatcttaccatttgtgacagggtggatagacctgaaagacattatgctaagtgaaataagtcagtcacagaaaaacaaatactgcgtgatttctattatataaggtatctaaaatagtcaaacttatagaagcagaaaatagactggtggttgacaggggttggggggaaggataaatggggagtgtataaagttacagttatataagacgaatatattctaggtatcagttttacaacctagtgcctatagttaacagcaatggtgctgtgcccttacaattttgttaagagggtagatctcatgttaagtgctcttactacaaagaaagcaaagagacaccagggaaaattctggagataatggatatatttattaccttgattgtagtgatggtatcttgggcatatgcttatgtccaaactcatcagattgtatacattaaatatgtacagttttcttgtatatcaattacatcccaataaagatgtaaaaataaagaaaaagatgattcaaataaaataaaatgtgattaattcataaaaaataacaactgaatgttaaggtatttaaaaaaggcctatttttcaagtattatgttgaaattttggtgaatattttgatgt

SEQ ID NO: 478411 - DNA, 627 bp, Homo sapiens
acagctgcagtgctggcccctaaggagcatgcacagtgttaactctccagctagggaaaacaaaacaaagcaactcgctcaggtgctccacacatctcaggaggatggcacacgctccatccacctggcagtgcctcattggctggagcccagattgctctgtctggggacgccagcaattctctcacataccattgcaattcctactgtattggacgttgtggttgctgtcggattaaagcagacatctatttgtatttttgatggggaatttttggaggaatctgatgtcaccactgatctgacaggaggtgtagctcaggcagtaatgcaagtgatagggagtgactgtaaacagatgaagctttgctcacttacccgctgctcacctcgtgctgtgtggcccggttcctaacaggccacggaccattaccagtctgtggcctggggtttcgggacccctgctgtaattttaccatgttttttagaattttattttaatttatctgttggctttttaatatgtatttttgcatcattttaagtggttgctttagggatgacaatatgtattttaaaaaaaaaatcttcatttcttcttaacattaacatcacttcacataacac

SEQ ID NO: 478412 - DNA, 3889 bp, Homo sapiens
ctggtgtcctgtgtttatctggccatgggctgggagaagttagccaagaaggtcaagctcttgaccctttggggaactggagaggaagagaagacaccagacgccagcaccaaaggaccagccctgacaagggcccagtggcccaatggcagtgagggagtggcctggagagggtgccaagggcctcagtccattgggaacccccagcccctgctccaagggcaccaggatgggggcacagtgggctcctcactccactgcaagaggaaggggactcaggcctgctccatgctggatccacgggcaacaccaccatggccagttctgggtatggaaacaggtagcagctgccacatgcccaagtcagcccctgctctgcacaggtgcagggaccagtcccatgctccaccgcagcagggcatgcagctgtaaaagctgagggctcaaagcatgtttgttgggtgagagagagaagtagtgattttccccaggacatgctcctagttagaaaataatatccctctagaattaattaattaatgggagttgatacaattaacaaatactgagtgacaaattctacagaggtgccattctctaattagtgctgtggtttagggcactgcagagcctcttagcttccataccctgaccggtaaaacgaggggctaacctgaaacttcccactacaatctatcttcccagggttttttttttttaaagtagaaaaacaattaaaatgtgtttttatatttatttaaaatgtaatacactgtcatgaggagtattttggaaactaagcaaacaagcaaaaaggcactgacatcattcattgttcccagatgtaattaatatattagcacattttctttcagacttattctttcctgtaggtttgttttttcattgtaatcaatcagaatataaacttcgatttgtttaattctccctttgatgagaatgttcaaaaaacattataatatagtctgtataagtatagtttgtaatgattccataatattctagtaaatgcaacaactgtaatttgcttagccattcttttatttatttatttattttgacatttaggctgttttaaagtttttgttattataaataacacttctctgaacatctttataaagtttgatatatttagatcgttttctttggttagattcccagaacaaaattatgaggtcaaacgacatgaatattttaaggcttacattactcccagccaaattttcttccagaagtgctgcgctggtttctcctgcccccagcactatgtgagaatttccgatttcaccactccatctcagttttggatattaccattaaaaatttctgctggttggatgggtcaaaaatggtgccatgtttcatattcattttattattaaccgtgaggttaaatggtttttgtcgcattatgctttgcattctatccccttggaattgcttgtttctgtccctttcccattaatctattgggatgtttatgtttttcttccccatttgtatgagctatttatataataaagttattatcccttaattgtatttctgcacactttttttctaatggcattgatttctaagttggctttcaagctcacagtaattcttaaatgatttgaggacaatgcagcctttctagtgctttcccttctgttgaccgccaagtttagaaggatatgagccaacaaaacagaaacctgtgcaataaagatgttgggtgttttaaatatctgccatgtgaacctggcttttaaaaacctttctttcctagccaaggaatccttgtatgaattaaatatgaaacttcctttccttacaaagtaaacatgtaatgatatacttcttgtccccattacaaatctgaggggagcctgctctctgatctcacatgaaacaggtgactcttcaattaaacataaattttcaattaaagcacatccctctgggtggcggatcgcagttcccaccctggctgggcagagcctgcctgggcagcctctcagcgtccagctgctgctggagaggccaggctccctggcggctcccaggagtgtgggctcagctggctgcttgaggagcccgggcctgggcagaggggcccagagccctgctgtgatgcccaccgtgcagggcagagccggaacctttgaaaaccaagggagagctctctccttctgaccctgcagccctgaagtttcatcggctcagcatgaggctccgaggttacttgaaaatagcatcttccaggaaaagatccaagggctgcaggatacttgggggcacttgtcatactactcaggcccagccaggccccttctcattcgtttcagcaacagtgatctgaaaagatccatgtttatctgtataagaatttttaaaaattcttgtaaacttaagaatgttcaacaatcaagtaaagtcaaattccttgcctctcccatgtctatcccagtgtccttccccaggggaaccactgatatcagctctctgtgtgcccttcttccagatatatgcacacctggaaatatagtgtgcatgtgcatgtgggggtgtatgcatgtgtgggtgtatgtatgcatatgtttatatgtgtgcacatgtatacttatacacacatgcatgtatgcatgcctgtgtatgcatgcacctgcatgtgtgcatgtagacattcatgtgtgcatgtgtgatgggggtacattatgcatagtttgtagcttgcttttttcatgtaacccgcatggagacctttttacttcagcccatttggcccgatcttgtcttgttgtgactcctgtaggaattagaagttcaggtcaggtagtgaactaacatgcttcagcaaacacagagcttgtggaatcctggacttacttgggcactagacctccctcacccctggatcaaagatgtttcttcccttttgcattttaatttcttacctgtatagtggccctaagctccttccagttttattattctaggctaaaaggttaaaaacagttgtttgatggaagagtcaaaagatatggggagattttatgtcaagaagaattgaaaacatttttgtgttgattatttaaaacgtaagaattacagcaatcaaaatgtgccatttccttcacattggtaatacagtattgttgcagggatctaaaagcgactttacaatgttacaatctagaaatcagtgatacttcatgccacacaggatgagaagcagttggatccagaggtgggagtcagactaagactcagaggaccacggttcaagcctaggccccctccctgcctcagtttcctcatcctcgagatggattgtgaaaacggatgaagtaatagatgtgagagtgcatgtgtatgccatgaagagacacacaagtgttgacgattgttgttaacaaggcagcaagcttgaagttttgtattgtgaagtaactgaaattgatcagtgaccctgaatttcctccaaaggggccgctggaaaagcttcaaggagcttccagctttagcaacctgctactcaatgctgtgcagaatgttctgtgaggacacaccctcgggcccttggagaccatgttctgagggagatgccttcataaggagtggggaccagtggccagaatgagcagcaccatggatcctttttgctgatggagagtgctctcagtgaacacggtggaaattctacagggcacatggagggtattggtgagagctgcctcccaggcttggccaggtatcccagatgttctgtggccaactgtgcagctggaggcaagtgggcttcaccctacagccctggctgggtcaggccaccctagagtcctttgccttcagtgcacagcagattctggggtggggacag

SEQ ID NO: 478413 - DNA, 482 bp, Homo sapiens
tgcacccagaatgaaagccaaaaggagactgacatttgagtcagtggactgggagaggaaggcccgccctcaaggctgtgggcaccattcaattggctgccagtgtggctacaacaaagcaggcagaagaagcattcttctgatgctcacccttggggtccagtcacagctgggaatggaacattcaaaatggcttcgctcacatgtttgtggcctcaacaaggaagaatggaaggcgggtttcagcagggacaatgggacactgggcttctctctccatgtggtctcaggacttctccttctctaccgcctttccacatggtctctccttgtggtctttccagtagagtcattgggcttcttacatgatggctcaggactccaaagtgcacagaagcagaagtcaccaggtcttctgaagactgccacagtgacccttctcctgcattctcttggctaatgtgagtcacaacaccagtgcc

SEQ ID NO: 478414 - DNA, 614 bp, Homo sapiens
ccaagcgcttcctgcgggtcacgtcatgtcacttgcagcaccatttatgaaggaacatttggtatacagagctatcttactagattgctccaagacacacacatcagggtctaagaaatgtcacctgtcagttgtcctggcttataatttcaagcacccaagctggttggaaagctcagaccatttgcaaagatgtgggagaggaggttttcttaaagaatcagagtcagttggaaacatggggaatgaggcctttagctggcttcggagagagtcctggacctggcataggatggataacggcaagagctgggggcctttgaaggcagggtcagtgcttgtgggacagccagaggcccctccagggcctcctgtcttccccatggcaccacggatgaccctggaagaggagccagggaaacccaaggtgacatacaatacgttcctggtgctgtgtgaccctcaccactgtccacctctgaaactccgtcatccctgtagaaactctgtgtcattaaacagcagccctcgctaacccacccccagcccctggcagcctctgttcattctttctgtgtctataaatctgaccattctagatgtttctcaaaagc

SEQ ID NO: 478415 - DNA, 655 bp, Homo sapiens
cgtcgcagcgtgagcagccgagaagtgacgacaccacggggcggaggggaacggagaggaaagctgctgacgccagggagagatgccgctgggccaggcacggctgcccgcaggagaggcctccgcagggagaggtaccgctggatcaggcgagggtgcgcgcaggagaggcctccgcagggagagggagaggtaccgctggatcaggcgagggtgcgcgcaggggaggcctccgcagggagaggtaccgctggatcaggcgagggtgcgcgcaggggaggcctccgcagggagaggtaccgctggatcaggcgagggtgcgcgcaggggaggcctccgcagggagaggtaccgctggatcaggcgagggtgcccgcaggagaggcctccgcagggagaggtaccgctggatcaggcgagggtgcgcgcaggagaggcctccgcagggagaggtaccgctggatcaggcgagggtgcgcgcaggggaggcctccgcagggagcggtgccgctgggccaggcacgggtgcccgcaggagaggcctccgcagggagaggtgccgctgggccaggcacgggtgcccgcaggagaggcctccgcagatctctgatgatgtgctaactaaattagataaatccccgtcatgtctcattca

SEQ ID NO: 478416 - DNA, 744 bp, Homo sapiens
ttcagctgttgtagggcctgcctcagtggcaggaatgtggttttggaaatactgagcttcaggatgaggtccctgagatgcgatgaagctctggagaaaagcttcccacatgggaaatgctcccacagaaccgtgtattcccatgggcactttcagcatgaatgcctctgttttctattaattcatgtgctcccagcgggtgtgtacggtcaggagcgttctctgtgctccccactcaacactgggaccaaagctgagtgtgagctgcaggaatatggtgtggagcaatgggacctccatgtgcaacaaaatgaacccagaaccagaccttacaccctttacaaaattaacacaaaatgcaaaactataaaagtcctaggagacaatgtgggagaaccctggcgaatagcagagcttctgacctgtttgctgcggctgagaaatgaaaacagccctgggctccagaaacactttcaaggctctccattatccatcgccttggcttttctgtcccaatggaatgaatttcattgtcctggaccaaatgacttcgctggggccgtagagaatgggaagggcatgcttcttggtgatggagacacggcagaggatatgggttatttgaatatctgagtcagtttgtgtctctctccagaaatacagatatgaatatggcagtgaaatggatttcagggacatgctgtgaaatcttgtactttgctatttgtgaattgtctatgcatg

SEQ ID NO: 478417 - DNA, 1413 bp, Homo sapiens
cctcgggatctcgcgggccgtgtgcccagtgctgctggcatgagctcggcctggtgttcgaggcagcctggccagtcctcggacctgtgcagcctgcagaagaaggggccgcaccttgtggataaggagccgtttggcctgtacgtctccccacactctgggttctgcaagcgcatctacacggtgcacacctgcatgtctccgtacactctggattgtgtgagcgcgtctacacggtgcacgcctgcacgtctccccacactctggattctgcgagcgcgtccacacggtgcacgtctgcacgtctccccacactctggattctgcgagcgcgtccacacggtgcacgcctgcacgtctccccacactctggattctgcgagcgcgtccacacggtgcacgcctgcacgtctccccacactctggattctgcgagcgcgtccacacggtgcacgcctgcacgtctccccacactctggattctgcgagcgcgtccacacggtgcacgcctgcacgtctccccacactctggattctgcgagcgtgtccacacggtgcacgcctgcacgtctccccacactttggattctgcgagcgcgtctacacggtgcacgcctgcacgtttccctacactctggattctgcgagcgcgtccacatggtgcacgcctgcacttttccccacactctggattctgggagcgcgtctacacggtacatgcctgcacgtctccctacactctggattctgcgagcgcgtccacacggtgcacgcctgcacgtctccccacactctggattctgcgagcgcgtccacacggtgcacgcctgcacgtctccccacactctggattctgcgatcgcgtccacacggtgcacacctgcgtgtctccctacactctggattctgcgagcgcgtccacacggtgcacacctgtatgtctccctacactctggattctgtgagtgcatttacacggtgcacgcctgcacgtttccccacactctggattctgcgagcgcgtctacacggtacatgcctgcacgtctccccacactctcgattctgtgaacacgtctacatggggcacatcgtgcattcgtctgtgttttcagccttggcagctggatccagagactggatccccttgtgtattctgtttggcaggactcagcagtggctgtgccctttcatccagggacgctgtgtctagctctcactctctggtgatgtcagaaagtattgactgatgagagcctaggcccattaattcactaggagttggggagtggtaatattttgattttaccttttatttctcatatataaattgaacttgtttctataaaacaacagcccttcatctatttcattatgaaatggagcagttcatatggaaaaggcaagataaat

SEQ ID NO: 478418 - DNA, 973 bp, Homo sapiens
aggaagataatgaatataaactcacactatctggacacagatggagaaggcggtggagcatttgagtggatgattaaagagaaaaacaaatcaggagaagctacaggaaataaacgctctttccatcctggtccctttgccacccacaaatacggagaagttgcgtctagggtccatccaggaaacacacagcgcacagtcaaaccgcagacggcctgtacccacagtcaaaccacagacggcctgtatgcacaaccaaaccgcagacggcctgtacccacagtcagaccgcagacggcctgtatgaacagtcaaaccacagacggcctgtacccacagtcaaaccgcagacggcctgtacccacagtcaaaccgcagacggcctgtacccacagtcagaccgcagacggcctgtatgaacagacaaaccacaaatggcctgtattcacaatgcaaaggaaggaaaagcaaaagcaaaagttaatattcacctagatgcaacttctctgtattaaattggctttatgttccaaccctgcatttccagatgaattttaaaatctgcctctcagtttttaaagaacaactcattgggctttgattaggaatttatggaatccgtaaattaaaatttggacatttggcatccttatattgagtctttcaaatgcattgacatggtagtttcttccatttctttgggccctctgaagtttctcccagtgttttacagttttctgtgtatttgtgcatcttccttagatttatcatagtgatttcagtcttaaaatctacttatctgattttagtatatatcagttttctttgggttaatatttgcatgttatgtcttctttcatcattttactttcacacttactatattctaatatttaagttttattctttaagcatatagttgtttctattttcatctggtcagactgtatatattaaatgtaattcatgacat

SEQ ID NO: 478419 - DNA, 800 bp, Homo sapiens
agctgcaaatgccctcacagaacacaacaccgggagcaggtcctcacggaacacaacaccgggggcaggtcctcaccgaacacaacaccgggagcaggtcctcatggaacacaacaccgggagcaggtcctcaccgaacacaacaccgggagcaggtcctcaccgaacacaacatggggagcaggtcctcaccgaacacaacacggggagcaggtcctcacggaacacaacaccgggagcaggtcctcaccgaacacaacacggggagcaggtcctcacggaacacaacacggggagcaggtcctcatggaacacaacaccgggatatggtgcacaaccgtattgaaatcaatgtccatcggatgcaggagggtcagccaagtggtctgaatgccactgccccaaatgatgagcctgggagccacagcaccctccggggaaaagcaacgcgaggctctaacgtggccacgaaggggcctccacacacgaaggggcctccacacacgaagggacctctacacgtgaatgggcctccatatgcagggccaccagacctggggcccatggctctcagcctgcccggacaatccagtgaggcccctcatctgcaccacaatggggtggtgccttccagagcccgtgggagtctccagacccacgtctggtctcctggacccctcaagagtctctgcacatctttccttccagagacaacaaatgttctttccaaaagacattctgactaacatgaccctgagactcttaatcaaagccctcagcagcagagcaccgcccacagc

SEQ ID NO: 478420 - DNA, 914 bp, Homo sapiens
caggggggcccaggcagcttgggctggggatgcggcagaagccactgggccgcctgctgcgaccaggaagcccctgaggtccgaggcaatgggtatcatgggctctgacggtgacttaagaagaaattgggactgagactatactgggccgcagctctcccacgtcccatcagggtctttttcaccatgaagacctgccctacaagcacagctttgccatccagacagcagggacggaggtgccgcgtgtggaggccaaggacaaagacaggccagtcgtggtggagctgccctcctcactcagacttgaccatggtggggaactgtcctcactcagacctgcccatggtggggaactgtcctcactcagacctgaccgtggtggggagctgccctcactcagacctgaccatggtggggagctgccctcactcagacctgaccgtggtagggaactgccctcactcagacctgaccgtggtggggaactacctgcccaaggtggggagctgccctcactcagacctgaccgtggtggggaactgtcctcactcagacctgatcgtggtggggaactgtcctcactcagacctgaccgtggtgaggagctgccctcgctcagacctgcccatggtggggagctgtcctcgctcagacctgaccgtggtggggagctgtcctcgctcagacctgaccgtggtggggagctgccctcactcagacctgaccgttgtggggaactgtcctcgctcagacctgccccacaagccagcgagcggacctagccccagcaactgcacagccgggacaccaccacgacgtggccacgctcaggctggacagtgtccagctcggcagtgtctcctctgagggctcctgacactcaagtcaggcccagagcattctccccacag

SEQ ID NO: 478421 - DNA, 1222 bp, Homo sapiens
aacaacccgaatggaatagaatatattggagagtaagggagttgaaaagaatcaatccgattgtaatggaatggaatggaacggaatggaatggaatggaatggaatggaatggaatgcaatggaatggaatcaacccgagtacaatggaatggaatggaatggaatggaatggaatggaatggaatggaatggaatggaatgcaatggaatggaatcttccggaattgaatggaatggaatggaatggaatggaatgcaatggattcaactcgattgcaatagaatggaatcgaatggaatggaatggaatggaatggaatggaatggaattaaaccgaatagaatggaatggaatggaatggaatggaacagaacggaacggaacggaacggagtggaatggaatggaatggaattgtatggaatggaatggaatggtacggaatagaatggaatggaaagaattggaatggaatggaaaggaatggaatggaatggaatggaatggaatcaacccgagtgcaggggaatgtaatggaacggaatgcaatggaatggaatcatccggaatggaatggaatggaatggaatggaatggaatggaatcaacccgagcgcaatggaatggattggaatggaatggaatggaatggaataacccgaatggaatggaatgtaatggagagtaagggagttgaatagaatcaatccgaatgcaatggaatggaacggaatggaatggaatggaatggaatggaatggaatgcaatggaatggaatcaacccgagtacaatggaacggaaaggaatgtaatgtaatgtaatggaatggaatggaatggaatggaatggaatcaacacgagtgcaatggaatggagtggaatggaatggaatggaatggaacaacccgaatggaatggaatgtaatggagagtaagggagttgaatagaaatcaatccgacatgtaatggaatggaatggaacgcaatggaatggaatggaatggaatggaatggaatggaatggaatggaataaaccccagtgcactggaatggagaggaatggaatggaatggaatggaacaccccgaatggaatggaatgtaatggacactaatggagttgaatataatcactcacaatgtaatggaatggaatggaacgcaatggaattgaatggaatggaatggaatgcactggaatggaatcaaccccagtt

SEQ ID NO: 478422 - DNA, 3091 bp, Homo sapiens
tggaatcaacacgagagaatggcatggattggaatggaatggaatggaaacaacccgagtacaggggaatggaatggaatggaatgcaatggaatggaatcatccgtaatggaatggaaaggaatggaatggaatggaatggaatggaatggaatcaactcgactgcaatcgaatggaatggaatggaattaacccgaatagaatggaatggaatggaatggaatgcaacggaacggaatggaatggaattgaatggaatggaatggaacggaacggaacggaatggatggaatggaatggaatggaatggaatggaatcaacgcgagtgcaggggaatggaatggaatggaatgcaatggaatggaatcttccggaatggaatggaatggaatggaatggaatgaaatgcaatggattcaactcgaatgcaatggaatgcaatagaatggaatggaatggaatggaatggaatggaatggaattaacccgaatagaatggaatggaatggaatggaatggaatggaatggaatggaatggaattccttcaaaccgaatggaatggaaaggaatggaatcaacacgagtggaatggaatggaatggaatggaatggaatggaatggaatggaatggaaaggaatgatacggaataggatggaatggaacgaaatggaatggaatggaatggaatggaatggaatggaatggaatggaatggaatcgttccgatggaatggaaaggaatggaatcaaccagagtggaatggaagggaatggaatggaatggaaactaatagaatggaatcaaccctagtggaatggaatggaaaggactggaatggaaaggaatggaatggaatggaatggaatggaatggaatggaatggaatcaacgccagtgcaggagaatggaatggaatcgaatggaatggaatggaatgtaatggaatcaacccgagtgcaggggaatgtaatggaacgcaatgcaaaggaaaggaatcttccggaatggaatggaatggaatggaatggaatcaacccgagtgcaatggaatggagtggaatggaatggaatggaatggaacaacccgaatggaatggaatgtaatggagagtaagggagttgaaaagaatcaatccgaattacaatggaatggaatggaatggaatggaatggaacggaatgcaatggaatggaatgcaatggaaaggaatcttccggaatggaaaggaatggaatggaatggaatggaatggaatgcaatggattcaactcgattgcaatggaatggaatagaacggaatggaatggaatggaatggaattaaaccgaatagaatggaatggaatggaatggagcggaacggaacggaactgaacggaacggaatggagtggaatggaatggaatggatttgtatggaatggaatggaatgtgcaggggaatggaatggaatggaatgcaatggaacggaatcatccggaatggaatggaatggaatggaatggaatggaatcaacccgagtacaatggaatggaatggaatggaatggaatggaatggaatggaatggaatgccttcaaacttaatggaatggaaaggaatggaatcaacacgagtggaatggaacggaatggaatggaatggaatggaatggaatggaatgatacggaatagaatggaatggaacgaaatggaatggaatggaatggaatggaatgcaatggaatggaatggaatcgttccgagtggaataggagggaatgtattcgagtggaatggaaaggaatggaatcagcagagtggaatggaagggaatgtaatggaatggaaactaatagaatggaatcaacccgagtggaatggaatggaaaggactggaatggaatggaatggaatggaatggaatcaactcgattgtaatggaatggaatggaatggaatggactggaatggaatggaattaacccgaatacaatggaatggaatggaatggaacggaatggagggaatggaatggaatggaatgcaatggaatggaatcatccggaatggaatggaatggaatggaatgcaaagcaatggaatcaactcgattgcaatggaatggaatggaatggaaaggaatacattggaatcaacccgagtggaatggaatggaaaggactggaatggagtggagtggaatggaatggaatgggatagaatcaactcgattggaatggaatggaatggagtggaattaacccgaatagaattgaatggaatggaatggaacggaacggaacggaacggaatgaaatggaatggaatggaatggaatggaatggaatcaacccgactgcaggggaatggaatggaatggaaagcaatggaatggattcaacttgaatggaatggaaagaatggaatcaacacgagtggaatggcatggattggaatggaatggaatggaatcaacccgagtacaggggaaaggaatggaatggaatgcaatggaatggaatcatccgtaatggaatggaaaggaatggaatggaatggaatggaatggaatggaatcaactcgattgcaatcgaatgcaatggaatggaattaacccgaatagaatggaatggaatggaatggaacggaacggaacggaatggaatggaatggaatggaatggaatggaacggaaaggaagggaatggaatggaatggaatggaatggaatggaatggaatggaatcaacgcgagtgcaggggaatggaatggaatggaatgcactggaatggaatcttccggaatggaatggaatggaatggaatgaaatggaatcaacgcgagtgcacgggaatggaatggaatggaatgcactggaatggaatcgtccggaatggaatggaatggaatggaatggaatgaaatgcactggattcaactctattgcaatggaatggaatataatggaatggaatggaatggaatggaatggaatggaattaaccccaatagaatggaatggaatggaatggaatggaatggaattaacccgaatagaatggaatggaatgtaattgaacggaatggaatggaatggaa

SEQ ID NO: 478423 - DNA, 686 bp, Homo sapiens
cgcaatgcaatggaatggaatcatccgcaatggaatggaatggaatggaatggaatggaatcaaccccagtgcactggaatggagtggaatggaatggaatggaatggaacaacccgaatggaatggaatggaatggaattaacccgaatacaatggaatggaatggaatgcaacggaatggagtggaatggaatggaatcaaccccagtgcaggggaatgcactggaatggtatgcactggaatggagtcatccggaatggaatggaatggaatggaatggaatggaatggaatggaatggaatcaactctattggaatggaatggaatggaatggaatggaatggaatgggattaaccccaatagaatggaatggaatggaatggaacgcaacgcaatgtaatggaatggaatggaatggaatggtatcaaccccactgcacgggaatggaatggaatggaatggaatggaatcatccggaacggaatgtaatggaatggaatggaatcaactctattgcaatggaatggaagggaatggaatggaatctaatgtaatggaatggaattaaccgcaatataatggaatggaacggaatggaatggaatggaatggaatggaatggaatggaatggcatccacccgactgcaggtgaatggaatggaatggaatgcaatggaatg

SEQ ID NO: 478424 - DNA, 8466 bp, Homo sapiens
tcttccggaatggaatggaatggaatgcaatggattcaactcgattgcaatggaatgcaatagaatggaatggaatggaatggaatggaattaacccgaatagaatggaatggaatggaatggaacggaagggaacggaacggaacggaacggaacggaatggaatggaatggaatgcaatcaacacgagtgcaggggaatggaatggaatggaatgcaatggaatggaatcatccggaatggaatggaatggaatggaatcaactccattgcaatggaatggaatggaatggaatggaatagaatggaatggaattaacccgaatagaatggaatgcaatagaatggaatgcaacggaaccgaatggagtggaatggaatggaatggaatcaacccgagtacaggggaatggaatggaatggaatgcaatggaatggagtcatccgtaatggaatggaaaggaatggaatggaatggaatggaatggaatggaatggaatggaatcaactcgatggcaatcgaatggaatggaatggaattaacccgaatagaacggaatggaatggaatggaacggaacggaatggaatggaatggaatggaattgaatggaatggaatgccttcaaaccaaatggaatggaaaggaatggaatcaacacgagtggaaaggaatggaatggaaaggaatggaatggaatggaatggtacggaatagaatggaatggaacgaactggaatggaatggaatggaatggaatggaatggaatggaatcgttccgatggaatggaaaagaatggaatcaaccagagtgaaatggaagggaatggaatggaatggaaactaatagaatggaataaacccgagtggaatggaatggaaaggactggaatgggatggaatggaatggaatggaatggaatggaatcaactctaaatggaatcaacccgagtgtaatggaatggaaaggactggaatggagtggaatggaatggaatggaatggaatggaatcaactcgattggaaaggaatggaatggaatggaatggaatggaatggaattaacccgaatagaatggaatggaatggaatggaacggaatggaatggaatggaatggaatggaatggaatcaacccgactgcaggggaatggaatggaatggaatgaaatggaatcatccggaatggaatggaatggaatgcaatggaatggaatggaatggtatcaacccgagtgcaatggaatggaatcgaatggaatggaatgcaatggaatggattcaacttgaatggaatggaaagaatggaatcaacacgagtggaatggcatggattggaatggaatggaatggaatcaacccgagtataggggaatggaatggtatggaatgcaatggaatggaatcatccggaatggaatggaaaggaatggaatggaatggaatggagtggaatggaatcaactcgattgcaatcgaatggaatggaatggaattaacccgaatagaatggaatggaatggaatggaacggaacggaatggaatggaatggaatggaatggaacggaacggaatggaatggaatggaatggaatggaatggaatggaatcaacgcgagtgcaggggaatggaatggaatggaatgcaatggaatggatgcaggggaatgtaatggaacggaatgcaatggaatggaatcatccggaatggaatggaatggaatgcaatggaatggaatcttccggaatcgaatggaatgcaatgcaatggattcaactcgattgcaatggaatgcaatagaatggaatggaatggaatggaatggaattaacccgaatagaatggaatggaatggaatggaacggaacggaacggaacggaatggaatggaatggaatggaattgtatggaatggaatggaatggtacggaatagaatggaatggaaagaattggaatggaatggaatcgaatggaatggaatggaatggaatggaatggaatcaacccgagtgcaggggaattggaataggagagaatgtattcgagtggaatggaaaggaatggaatcaaccagagtggaatggaagggaatggaatggaatggaaactaatagattagattggaatcaacccgagtggaatggaatggaaaggactgaaatggaatggaatggaatggaatggaatcaactcgatttggaatggaatggattcaacccgagtgcaggggaatggaatggaatggaatgcaatggaatggaatcatccggaatggaatggaatggaatggaatgcaaagcaatggaatcaactcgattgcaatggaaaggaatggaatggaaaggaatagaatggaatcaacctgattgggatggaatggaaaggactggaatggagtggaatggaatggaatggaatggaatggaatgcaatggaatggtatggaatggaatggaatggtacggaatagaatggaatggaacgaattgtaatggaatggaattcaatggaatggaatggaatggaattgaatcaacgcgagtgcaggggaatgtaatggaacggaatgcaatggaatggaatcatccggaatggaatggaatggaatggaatggaatggaatcaacccgagtgcaatggaatggagtggaatggaatggaatggaatggaacaacccgaatggaatggaattacaatggaatggaatggaatggaatggaatggaatgccttcaaaccgaatggaatggaaaggaatggaatcaacacgagtggaatggaatggaatggaatggaatggaatggaatggaatgatacggaatacgatggaatggaacgaaatggaatggaatggaatggactggaatggaatggaatggaatggaatcgttccgagtggaataggagggaatgtattcgagtggaatggaaaggaatggaatcaaccagagtggaatggaagggaatggaatggaatggaaactaatagaatggaatcaacccgagtggaatggaatggaaaggactggaatggaaaggaatggaatggaatggaatggaatggaatggaatcaacgcgagtgcaggagaatggaatggaatggaatggaatggaatggaatggaatcaacccgagtgcaggggaatgtaatggaacggaatgcaatggaaaggaatcatccggaatggaatggaatggaatggaatggaatcaacccgagtgcaatggaatggagtggaatggaatggaatggaatggaacaacccgaatggaatggaatataatggagagtaagggagttgaaaagaatcaatccgaatgtaatggaatggaatggaacggaatggaatggactggactggaatggaatggaatggaatgcaatggaatggaatcaacccgagtacaatggaatggaatggattggaatggaacggaatggaatggaatggaatggaatcttccggaatggaatggaatggaatggaatggaatggaatgcaatggattcaactcgattgcaatggaatggaataaatggaatggaatgaattggaatggaatggaatcgaatggaatggaatggaatggaatggaatcaaaccgagtgcaatggaatggagtggaatggaatggaatggaatggaaaaacccgaatggaatggaaagtaatggagaggaacggaatggaatggaatggaatggaatggaatggaatggaatggaatcaacccgactgcaggtgaatggaatggaatggaatgcaatggaatggattcaacttgaatggaatggaaagaatggaatcaaacacgagtggaatggcatggattggaatggaatggaatggatcaacccgagtacaggggaatggaatggaatggaatgcaatggaatggaatcatccgtaatggaatggaaaggaatggaatggaatggaatggaatggaatggaatggaatggaatcaactcgattgcaatcgaatggaatggaatggaattaacccgaatagaatggaatggaatggaatggaacagaacggaacggaatggaataatggaatggaatggaatggaacggaacggaatggaatggaatggaatggaatggaatggaacggaatggaaaggaatgaaatggaatggaatggaatggaatggtatggaatggaatggaatgtgcaggggaatgtaatggaacggaatgcaatggaatggaatcatccggaatggaatggaatggaatggaatggaatggaatggaatcaacccgagtgcaatggaatggagtggaatggaatggaatggaatggaacaacacaaatggaatggaatgtaatggagataatggaatggaatgcaacggaatggaatggaatggaatggaatgcaatggcatggaatcaacccgagtacaatggaatggaatggaatggaatggaatggaatgccttcaaaccgaatggaatggaaaggaatggaatgaacacgagtggaatggaatggaatggaatggaatggaatggaacgatacggaatagaatggaatggaacgaaatggaatggaatagaatggaatggaatggaatggaatggaatggaatggaatggaatggaatggaatctggaatggaaaggaatggaatcaaccagagtggaatggaagggaatggaatggaatggaaactaatagaatggaatcaacccgagtggaatggaatggaaaagactggaatggaaaggaatggaatggaaaggaatggaatggaatggaacggaaaggaatggaatggaatggaatggaatggaatggaatggaatcaacgagagtgcaggggaatggaatggaatggaatgcaatggaatggaatcttccggaatggaatggaatggaatggaatggaatggaatggaatggaatcaacccgagtgcaatggaatggagtggaatggaatggaatggaatggaacaacccgaatggaatggaattgcaatcaaatggaatcgaatggaatggaatgcaatggaatggattcaacttgaatggaatggaaagaatggaatcaacacgagtgcaagggcatggattggaatggaatggaatggaatcaacccgagtacaggggaatggaatggaatggaatgcaatggaatggaatcatccggaatggaatggaatggtatggaatggaatggaatggtacggaatagaatggaatggaacgaattgtaatggaatggaattgaatggaatggaatggaatggaatggaatcaacgcgagtgcaggggaatgtaatggaacggaatgcaatggaatggaatcatccggaatggaatggaatggaatggcatggagtggaatcaacccgagtgcaatggaatggagtggaatggaatggaatggaatggaacaacccgaatggaatggaatgtaatggagaaatggaatggaatgcaatggaacggaatggaacggaatggaatggaatggaatggaatggaatggtatggaatggaatggaatggaacggaatagaatggaatggaacgaattgtaatggaatggaattgaatggaatggaaaggaatcaacgcgagtgcaggggaatggagttgaatagaatctatccgaatgtaatggaatggaatgcaacggaatggaatggaatggaatggaatggaatgcaatggcatggaatcaacccgagtacaatggaatggaatggaatggaatggaatggaatggaatggaatggaatgccttcaaaccgaatggaatggaaaggaatggaatcaacacgcgtggaatggaatggaatggaatggaatggaatggaatggaatggaatggaatggaatcaacgggagtgcaggggaatggaatggaatggaatgcaatggaatggaattttccggaatggaatggaatggaatggaatggaatggaacggaaaggaatggaatggaatggaatggaatggaatggaaaggaatcaacgcgagtgcaggggaatgggatggaatggaatgcaatggaatggaattttccggaatggaatggaatggaatggaatggaatggaatggaataaacccgagagcaatggaatggagtggaatggaatggaaacaacctgaatggaatggaatggaattgaatagaatcaatccgaatgtaatggaatggaatggaacggaatggattggaatggaatggaatggaatggaatggaatggaatgcaatggaatggaatcaacccgagtgcaatcgaatggaatcgaatggaatggaaagcaatggaatggattcaacttgaatggaatggaaagaatggaatcaacacaagtgcaagggcatggattggaatgcaatggaatggaatcaacccgagtacaggggaatggaatggaatggaatgcaatggaatggaatcatccaatggaatggaatggaatggaacggaacggaatggaatggaatggaatggaatggaatggaatggaatggaatggaatggaatggaattcacccgaatagaatggaatggaatggaatggaaaggaatggaagggaaggaaatggaatgtaatcaacccgagtgcaggggaatggaatggaatggaatgcaatggaatggaatcatccggaatggaatggaatggaatggaatggaaagtgcaagggaatggaatggaaaggaatgcaatggaatggaatcatccggaatggaatggaatggaatggaatgcaaagaaatggaatcaacacgattgcaatggaatggaatggaatggaaaggaatagaatggaatcaacccgagtgtaatggaatggaaacgactggaatggagtggaatggaatggaatggaatggaatggaatcaactcgattggaatggaatggaatggaatggaatggaatggaattaacccgaatagaatggaatggaatggaatggaacggaatggaatgggaatggaatggaatggaatggaatggaatggaatggaatggaatcatccggaacggaatggaatcaactcgattgcaatggaatggaatggaatggaatggaatcgaaaggaatggaatggaattaaccagaatagaatggaatggaatggaatggaacggaatggaatggaatggaatggaatggaatggaatggaatcaacccgagtgcaggggaatggaatggaatggaatgcaatggaatggaatcatccggaatggaatggaatggaatggaaaggaatggaatggaatggtatcaacccgagtgcaggggaatgtaatggaacggaatgcaatggaatggaatcatccggaatggaatggaatggaatggaatggaatggaatggaatcaacccgagtgcaatggaatggagtcgaatggaatggaatggaatggaaaaacccgaatggaatggaatgtaatggagagaatggaatggaatggaatggaatggaatggaatggaatggaatggaatggaatcaacgagagtgcaggggaatggaatggaatggaatgcaatggaatggaatcttctggaatggaatggaatggaatggaatggaatgaaatgcaatggattcaactcgattgcaatggaatggaatggaatggaatggaatggaatcgttccgagtggaataggagggaatgtattcgagtggaatggaaaggaatggaatcaaccagagtggaatgggaatggaatggaatggaatggaatggaatggaatggaatggaatcaacccgagtgcaggggaatgtaatggaacggaatgcaatggaatggaatcatccggaatggaatggaatggaatggaatggaatggaatggaatggaatcaacccgagtgcaatggaatggagtggaatggaatggaatggaatggagcaacccgaatggaatggaatgtaatggagagtaagggagttgaaaagaatcaatccgaatgtaatggaatggaatggaacggaatggaatggaatggaatggaatgcaatggaatggaatcaaccggagtacaatggaatggaatggaatggaatggaatggaatggaatggaatggaatggaatggaattgaatgcaatataatggaatcttccggaatgcaatggaatggaatggaatgcaatcgaatggaatgcaatggattcaactcgattgcaatggaatggaatagaatggaatggaatggaatggaatggaattaaaccgaatagaatggaatggaatggaatggaacggaaaggaacggaacggaacggaacggagtggaatggaatggaatggaattgtatgcaatggaatggaatggtacggaatagaatggaatggaaagaattggaatggaatggaatggaatggaatggaatcaacccgagtgcaggggaatgtaatggaacggaatgcaatggaatggaatcatcc

SEQ ID NO: 478425 - DNA, 1508 bp, Homo sapiens
taagggagttgaatagaatcaatccgaatgtaatggaatggaatgcaacggaatggaatggaatggaatggaatggaatggaatggaatggaatggaatggaatcaactcgagtggaaaggaatggaatggaatggaaaggaatggaatgaaatcaactctagtggaatggaatggaatggaatggattggaatggattgcaatggaatgaaatggaatggaatggaatggaatcaatcattccgagtggaatggaagggcatgtaatggagtggaaagaagggaatggaatcaacccgattggaatgcaaggcaatggaatggaatggaaaggaatggaatggaatcaactcgattgcaatggaatggaatggaatggaatggaatggaatgaaatggaatggaatggaattaaccagaggaatggaatcaacacgagggcaggggaatggaatggaatggaatgcaatggaatggaatcatccggaatggaatggaatggaatgaaatcaactccattgcaatgcaatggaatggaatggaatggaatagaatggaatggaattaacccgaatagaatggaatgcaatagaatggaatggaacggaaccgaatgcagtggaatggaatggaatggaatcaacctgagtgcaggggaatggaatggaatggaatgcaatggaatggaatcatccggaatggaatggaatggaatggaatggaatcaaaccgagtgcaatggaatgcaggaattgaatagaatcaatctgaatgtaatgaaatgcaatggaaaagaatggaatggaatggaatggaatcgaatggaatggaatggaatggaatcaacccgagagcaatggaatggattcgaatggaatggaatgcagtggaatggattcaatccgaatggaatggaaaggaatggaatcaacccgaaatggattggaacaaaatggaatggaatggaatggaatggaatggaatggaatggaatggaatggagtggaatcaagtcgattgcaatggaatggaatggaatggaatggaacggattggaatggaatggaatggaatggaatggaatggaatggaatggaattaaatggaatggaatggaatggaatggaatcaacccgagtgcaggggaatggaatggaatggaatgcaatggaatggaatggaatagaatggaatggaatggaatggaatggaatggaatggaatcaacccgagtggaatggcatggaatggaacgcaatggaatggaatggaatggaatcaactcgagtggaaaggaatggaatggaatggaaaagaatggaatgaaatcaactcgagtggaatggaatggaatagaatggagtggaatggattgcaatggaatgaaatggaatggaatggaatggaatcaatcattccgagtggaatggaagggaatgtaatggagtggaaagaagggaatggaatcaacccgagtggaatgcaaggcaatggaatgcaatggaaag

SEQ ID NO: 478426 - DNA, 1028 bp, Homo sapiens
agctgcgtagacctaagatgaacaaggacagccacagcaagacctgtaaggagactatccttgtaatccaggcaagagatgatggcagcttggaccagggtagtagcagtggaattgatgagaagtggttgaaatctggatatattttgaagatggagcccgtgggatttcctaacacattggatatggaatatgtgagacagaaaggacatgattctggcaatttagtatttggactttgctatctgccttcctctatagaaacaattgggggtggggcggtaaaggagtgggccaaatgcacatacacaaatgcactaaaccggatacttcactgctctgaagactggaagccaaggagagtattgattaaatctgcaacaagaccctatattcctattttcaaagtctcaccaccagaaaattcttcctcgtctcttatgacaccaatctaaaggcttctttttaatctaaagttcccaggtgtactgggttgaataattcccccaccccgcaaccttctcccatattcatgtccatctggaacctgtgaatgtgaccttatttggaatagggcctttgcagatatagtcaagatgaggtcatgctggattgaagtgggtcatactgaatgcagtatgactggtgtccttagaagaggaggtaagcttggacaccgacacacagggagagtgccatgtggcttgctagggagagatggtaagttctgctgccacaagctaaggattgccagcagccaccagaagctaagagagctgcatggaacaggttctccctctgaatactttaagaagcaatcagtacaccaacaccttgattgcagactgccggcctcttgaactgaatagtgttcaaaaatatttctgtttctggcaaaggcagtatctcctctctggattgaaacctatttcccctattatagtgatatagaaagtacaaaagcatccaattatctacctttggtttattaactcatatctctgatattttctggttaattctttatg

SEQ ID NO: 478427 - DNA, 724 bp, Homo sapiens
ggcggctcctcgtcttcttccatctctaaggagattattcctatgtggaatacgggctacaaaagcccaaacataatgatctgttatggacagagatcacagtgcctgcggtttccagaagctgctgctgacatggtcttgacaagagcaccagctcaggggtcactcgagttggagctatgggcttggcgccatgagaaaacttcagtactggggaccgttgagcatcacacagagtgtgaggtggctttctttcatcaggtgtttgctggcctgactgtccactgggaaaggagcctacccaaggagagagaggggcttgctagtgataaaccgctgacagcccatacattattgacaagatttggcagagaggggcctctgctacctctgctcgtcctggttctctttgagttttgtgcttgcaccgactactgctttatcccaacatcttgctgcccacatgaaagtacacacacggaaaaacccagaaactaacaccaggttgaattttttttctttctgttttgcacataaaatgtctatggatctaagagaaagtttaactgtataattggaacagtctttgattacaatcactcagttcaaaattaaagtagataaataagcatgggtctggaatgttaagaaaaaaaaagtgggctgttgcaataaaacaggttcatatcccttgagtgacaagtttcagatgctaggcctaaaa

SEQ ID NO: 478428 - DNA, 727 bp, Homo sapiens
gctcatggaaagacctaagctgacttatctgtagactgggccattctcagaagaagacacgaagatgaaggaaagtttggaacttcttagagactggttaaatgactgtgaccaaaatgctgatagtggtatggacagtgaagtccaggctgccaaggtctccgatggaaatgaggaacttattgggaactggagcaaaggccacacatgttatgtcttagcaaagagcatggctgcattgtgtccatgccctaaggatctatggaagtttgaactaaagggtgatgatttagggtatctggcagaagaaagttctaagcatcaaagcattcaagatgtgaccaggctgcttctaacaattcactggcagcttgctggctgtgcctggaaaagccacaggcactcaactccaacacgtgagagcagctgtgggggctgcaccctgcaaagccaaatgggtggtgtggcccaaggccctgggaacccatccttgcaccagtgtacattggatgcagcatatggagtcagaggagattattttggagttttaagatgtaatgactaccttgctgattttgaacttttcatgggacctgtaacccctgtcttctggctgatttctcccttttgaaacaggaatatttacccaatgcctgtacctccatcatatcttggaaataactaacttgtttttgattttaagggtcgcaggttgaagaaacttgtc

SEQ ID NO: 478429 - DNA, 707 bp, Homo sapiens
aaagaagccagacaaaaaataaatattggatattggccccccccgcttctggcttctggtttctgcagagagatctgctgttagtctgatgggcttccctttatggtcaggcccttcagctgcaggtctgctggagtttgctggaggtccactccagacactgtttgtctgggtatcaccagtggaggcgataggacagcaaagattgctgcctattccttcccctggaagcttcgtccaagaggggcacccgccagatgccagtcagagctctcctcagagctcaagtgctgtgcttgagatccactgctctcatcagagccagcagacaggaacatttaagtctgctgaagctgcgcccacagctgcccgttgcaaagactgtgggaaaagcatagtatctgggccagaatgcaccacccctcatggcacagtccttcacagcttcccttgtctagaagagggagttccccgaccctttgcaattcccagacattgacgtgacctcttatcttaaatactgatatgagcagcagcttccttttaagagagagactccaaggagaatgttatcttgcccaaaggaaagtggaaggatgcaacttttatattcaattattccatttttttcttaaaatagatgaagcaatcttgggaagaatatttattttttcttgctatatcatcagacttccatggaccactca

SEQ ID NO: 478430 - DNA, 695 bp, Homo sapiens
tcactatcacaaagacagcagtatgccacgagggatccacctccctgatctaaacacctcccaacaggtcctacctccagcattggagatgacaattcaacatgagatttggactcatgacagggacaaacttttacttgtctcgcttcactcaaccccttgcaggagggagcacatcagcaaatgtgtgtgggatctggccagccactccaggatccagcaggagcaagcttcatgtggggctgatggccagatcaggcatgagttagtgagtgcaggatccagctggcagctctgggcaccagcaggagcaagatctgtgtggaacccatggctagaaccagagggagtattccattactctcctaactccactgtctgcagactaacagctcagttgaccccttgccacatcacctggggaggctgccctctgccagtgaccatgaatagttggtgtgatagcatttttgggtacccacagtcaatgtgtcctgagctcttgttcgatgtccaaggataatgaggtggcatgggattctcaaagggtggtaatgggggagaattttgttgagtggtggaaatggttttcagtggagagggcagctggagaagggggcaggtggggttgagggagaataagaggccccctcctatacatacatgtgaaaatcttcaggagaaagtataatttg

SEQ ID NO: 478431 - DNA, 673 bp, Homo sapiens
caaattgtactcatgatataggtgtacctcagtttcctgaatacttatataaaaatactgaagtaatgattccagctagtttggaattattagtaaatttcctgggcactaatattttgaactattttccccttacaacagcaccaaagggggaaattcactgccatgatctcatcacctttcgccaggagccatctccaacattggagagtacaattcaagatgagattttgatgacacgagaacaatacatactagcaacccaacagaataacctgccaaggactgagaatgcacaactttacccagtgggaatttatggatggcgaaagaggtgcttatacttctttgtccttctgctgttggttaccatgatagttaacttagccatgacaatatggatattgaaagttatgaatttcactgtgaaatataattatatggttcatccaaatatgtacctcttctcctctatcaacgtccccgcatttccttgtccctttgaagtgtaaattccctaaggagcagaagctgttcttatttaccttgatatcttggttgagcacatagtaggtgatacattatttttcgctgactttttttaagttttaaaagtgtaggttcactttcagtagagggatcttcaaatttaatgttttaattttttcacttg

SEQ ID NO: 478432 - DNA, 1979 bp, Homo sapiens
ctctccactctacagcaggcaccagcgggcatccccgggacacaggcaccaacaaccacctcaccgatcaatcggcctccttcggcatctgctcctccttcctcctgttttgaaggaagttttgtataaacggagactgcagcttccctggatgcagctcgtgctggtttctacccctcccctctgtccttctgggtccaggtttagtggcagcaaagcccccacctggggccgttccaggttttcctttgtgccttgtcaggagggtcccctataaacagacacagtggcagaggcctctccagacatctctgtcacatctgtgcacgcaagcaggacccagccaagcctgggtcggatgcccgcaggcactgggagaccacctgctgctctgaattctgcccccaggtccagggaggtctgggaaatctgtcctccctggtcctcacctcctccgggaaagccggcttctgtgctgtccctggaggctcagggctgtgagcccggccttctctctccccagggtcagaacaagtgacagaggtcaccaggggctgcaccaacaaccgcatcgtctcggcccgtcccggctgggaggagttcacctgggacagcatcctctgtgccagcgtcttgtgctgtttggagaccctgggtaaccgggaagccatggcaggcagcgctgcccaggccctgcaagggggctgcagctcacccagtggttagcaccctccctccctgatgcccgcccccctcatctgcatggtcctttgatgaccatctccacgtctcatcccccatctctgtttggactggtcatggggcctgccctcgcaggtgaggctgccttgactcgctgcctccccctaacagtggagggagaagcttcctcttgagcctgtaagtctgggcaggtccagcccccgtcccctcccccagggccaaggggtggccagtgccccggtgtgtgctttctgttccagcccaggagggcgtcccctgacaaagccgcccctctgtgctgtgaggtgggaggagcctctgcctgtctaccggccccagattccacgcccatcggggaagcccggcaaaggcaccagcactgggaatgtgccccagcaaacagtgagcaacgaggagggtgaggaaagcgaggaaggcagccaggactcagtggcagtgtggacgccgatggctggatcatgagcaccccagtgctgttctcatgacagagttctcacgagatctgggcatttaaaagtgtgtagcaccttccccctctccctcctccccccacccctcgcccccagctttctcctgctacggcctgtgacgcacctgctcccccattgccttccgccatgctctcaccactagcgttcaacacaacacagtgctggaagctctggccggtgcacacagcaagacaaggaaaccctcgcgttcaacacaacacagtgctggaagctctggccggtgcacacagagagacaaagaaaccctcgcgttcaacacaacacagtgctggaagctctggccggtgcacaaagagagacaaagaaaccctcgcgttcaacacaacacagtgctggaagctctggccggtgcacacagagagacaaggaaaccctcgcgttcaacacaacacagtgctggaagctctggccggtgcacagagcaagacgaagaaaccctcgcgttcaacacaacacagtgctggaagctctggccggtgcacacagcaagacaaggaaaccctcgcgttcaacacagtgctggaagctctggctggtgcacagcaagacaaggaaaccctcgcgttcaacacaacacagtgctggaagctctggccggtgcacacagagagacaaggaaaccaaaggcatacacatcaaaaaggaagacacgcccttgtcccataagcagatgactttgtagcccacttaaaaaatcgtaaggaatctgaaataaataagagc

SEQ ID NO: 478433 - DNA, 627 bp, Homo sapiens
ggtttcacctcggccacggttcccaagatgattgtggacatgcagtcgcatagcagagtcatctctcacgcaggctgcctgacacagatgtatttcttggtcctttttgcatgtatagaaggcatgctcctgactgtgatggcctatgacggctttgtagccatctgtcgccctctgcactacccagtcatcgtgaatcctcacctctgtgtcttcttcgttttggtgtcctttttccttagcctgttggattcccagctgcacagttggattgtgttacaattcaccatcatcaagaatgtggaattctctcattttgtctgtgacccctctcaacttctcaaacttgcctgttctgacagcgtcatcaatagcatattcatatatttcgatagtactacgtttggttttcttcccatttcagggatctttttgtcttactataaaattgtcccctccattctaaggatttcatcgtcagatgggaagtataaaggcttctccatacgtggctctcacttggcagttgtttgctgatttgatggaacaggcattggcatgtacctggcttcagctgtgtcaccaccccccaggaatggtgtggtggcgtcagtaatgtacgctgtg

SEQ ID NO: 478434 - DNA, 1038 bp, Homo sapiens
ggattttcatgtagcttgtagcagatcacgaagtcaaaaagggtgaagtccaatttgaaccaggcagtctaagtccagacacatggcatttggccagtcctctccctgcaaccaacctgccctctcaaatcctcgtcactcaggcggatggccctgctcactgtgcccttccctttgggggttccttgtagaccacagctcgacaaggacgtctttggcttccatcatgggggtgcaggcaactggattatccaccccaagaaatctggacaaaggaaaacgaggttctctgaggaaggagacatagagcccagggagctaaccaagagacaaatattggagctatggcggcggcagctgtcactgggcctagcccggagtgtggacctggggactccccagaagggcccgagggggaggctcacggagcgtcggcggaaggcgcacagaatgctaaagctttacaacggcctctcgaaaggggaggcggtgggactccccgcggggaccgaccccctggaccccactgatctgaacggggcgcacttcgacccggaagtttacctagacaagcttcctagagagtgccctctggcccagctgatagacagtgagacggacatggcgcagcagatccgggctctagacagcgacatgcaaaccctggtctatgagaactacgataagttcatcccagccacagaaattgacaaacagcataaaactgtatgaagaattgcaggagacccagaatttcccaaataaccttataaaagaagaataaagttggaagacccatgcaaaaaaaaacatatatatatatatatatataatatatatatataaataaagatgtgttttcgttcagttgtaaatgtttagtaattactattgtgatttttcatttaactcatgaaaggatatttttaattttccaaatgtatgcttgtgtttagctatcttcttgctgttgacttctaattttgttgcattatggtcaggataatgtggtctggacaatgtcaatcgtgtagtgga

SEQ ID NO: 478435 - DNA, 950 bp, Homo sapiens
gtggttccaagtcaagttccaaattgtggcaggtccttacttagtatgacccgcaagaaagaaccaacatgaggtgggcagctttgaaaagggacacaaccttggggctgggttttgctttcacctccctctgcctcctgctacttggctcagtgtccaggccaggaaatggcccggatggttcctcaggctctgtgttccaaacagcagccctgggaattccagctcagcccctccacccagacctgcgtggaggcacagtgaacttcaatctcattgtgagtggcaatgagctcagtgggaaaggctccatttctcagctggccttgctgacaagtggctgcaggacacttgtggccatgttatgtggcagtggtcagttgaagcgggatggggaagctccttcaaaggggagtggaggctggcggcatgtgctttttcccttcctccctgccttgcctcctggaatgggggagtggaggggttcagcgctgatggccaggtggggccggcttgttcatgaggatgagagtggctatcagggtgacggcacaggagacagaggagcttgggacgctctgactttgagggcgggagctgctgcctgcagactggctgtcgtgtgtgaagaccccctgtttggtttaagtggtcctagcatagccgaaagcaatccccagtggaattgcttgcatctcttccatactacacaacttttacacaacccctctagaattcctcccttgatcccatcacattcctgttgaactctaagggggcggtgtggggagacttcctggagcaggccatgctgtggatgtggctctgaccccatccagtctcaggagctcgtcaaggatggcccagcttttcatcaggaatttacctagggcagccaaaagatcagagaacatggactcaatcatttctcaagtttgtaaaatgtgcct

SEQ ID NO: 478436 - DNA, 3548 bp, Homo sapiens
gcaaacacctgctcaccctcccacatcatgcgtgcacgtacaagtaaatttttcagcagctgccgcctggctgtgcggtcttccctgctgatgattattgatgggctgctgccctccgtgctccctttcctgggccagctgcacccccagggctgcgggcttggctacacctgtgagcaaaagtcatggtggttcagaacccggagacaccagatggacccaccgtctcctatccgatatgcaaaccttggagaaacagaccaaaagcccacagtgaatgagttagagatgataaccctgtcatggcttaatgcagaggaagggattcaaagccttggggaggttggaatgcaagagaggattcgtctttccagacatcctcactcaccctgggagggcccagaactcacaccttttcccacgattatgggaaatgcatgtgagaggggagccccagaacccttgatgagctgtgactgctcttctctgtgggccacaccctacagtggggaaacatccacacagtgggagtattaaatccttaagtggcaggggccaagtagcatcactgcatggatgtggaccctgtaaaggatggcagaatccaagctgcaatcagaagagcctgactcatgccagcccggggcatcggctggtggatcatggtattctcagcagtgaaacacacaggaaacctactaaattcttactcgagctgtataagcagttaaattctggatcaagcaaactaaagtctaacttgaaccatgaaaagagagtcatgccccctcaatcaattcccagacttgagccagtttacagactcaaacccattgaatgaaggggaggttgggtctccttgaacaaggaccctggtatgcagccaaaaacttacactccatctttcttccagccttccctaaaggaacttacagccttcagaatgggactgcaacataagccttttcctagttctccaatctaatggccattaggcttcagctgcaacatcagccttcttggggtctccagcttgccagcccaccctgtagattttggacttgccagcttccataattgcatgggtcaatctttaaaataaattgctctctctccctctatgcatatatacctcctattggttatccttctctggagaactccagttagtacaggtatagtacagtcattgtacacagagcgagtggatgtcactgtccactcaccctggggttgcaagttcagagggtggtgatctctgtctgatcacagggtgagctgtgtgagctggggacactgttcctcatgtgcttggcatggccacttgtgcttttgttctctctttgctcgtcccacacaggcccagactcactgcctgtgcccctcctatggcgtgctcattctctgcctctgcaccttcagagctgtgttctgtgacactttggaaagcccagtttccccattcacctcctggccccttctgacagtcactaactagtctctgtcctcgttcattttcaaacactttgcaggactctgcttctccagatgctcttctgtttaacctctctaggctctagttgaacccagctctgtgagccacccactgctgtccaccaggctgtgtttaagatgttcccatggcttgctcttggtggggtcctccctcgcaggcattcagtttatcatctgcttgactgtggaattgtaaatgttaatgttttgtctttgttcttcctctacgtctctaaggagtacaggcacctaaagtgcaatgcctgctgttgacaggactcaagtagatgctgagtggtgacacttaaaagtccccttttctagaattcataaaaaacaagtgacttcacctgtctgagttgtcattccttggtgccttgttgaacttttagcatcgtcactgccatacatgataacttttcagcgaggtgcttcctagcagcagggcaaaaaatactaaagtctgactgttttcccccatgtcttactccttcatgcaagctcgtctttgacatcatggttctttctttgcagaagctcttcaaggttcttaatggtgtctgtcagcctgtctcccttcctgctgcattctgtggcttttaacaaaggcaggcattggaatgcatgaatattgaagaggtacacgccgacagtgttacaaacacatcttgaattttgaattttaagttaacatccagtagagccaagttcttctgcatgtgtgcaccacccatgagccttaacacacgtgtagatttgtctcattacaggcaagacacagggtagctgcagcacctggaggccctgagctgccctggggcgatcacaccctcccccatgccaccccaaagccatcagtctgctcagtcatgtaaatagggtcatacaggtagaaacctcttgatattggcggtggcttctcctcctcttcctcctcctccttcttcttcttcaagctattattattttcattttaggaaacagagattcaaataaattaattgtataaggtaacaaaattcagggatgccagagttgattctgagcctagttcattttgagttccagtcttacaattagagactatacaaatctgtccccacactggattcagagcatctttaaaataatgagatattgtacttgatagattgaaacttacaataaatattatttgcctagcagcatacagacatggtttgaaatatcataaaatggaggaattaactttggatattggcatcttctgattcacccatgtgattgaggatatcagtggtttgttccttgttgctgctgactagtatttcattgtatagatgtgtcatagtttgtttattcattggttaaaggacatttatattgttttctgtttttcatgattattactagagctgctatgaatatccatttacaaaatttttggtgaacataagtttccatttctctagagcagggatggaaatcttttttttttaatggtcagataatacatattataggcttttcaggtcacaaaacaactcaaaatcgaggctactatgcaggaacttttataaccacttaaaaatgttaaaacgatttgaagtttgcacaaaccataaaaaacaacaaaatgaaacaaagcaaaaacaagttccacttgttttgtgaagttttgctgaaatatagccatgcccacttgttcatgtatctttgtgtggctgcattctacaaccggggagttgactttctgtgacaaagaccttgagtctaaaacatttaccatctgacactttaagaagttttccaactcctgctgtaaacactgaggagtatatttttacatttgtaagaactgcccaactttttcagggtggctgtgcccttttacactctaccagcgatgtatgaaagacccagttttcccccatcctcccctgcactcagtattgtcagcagtttttgtttcagtcattctaatttgtgcgtagtgttactttaccgtggttttaatttgtattttcctaatgaattatgttgaacatcttttc

SEQ ID NO: 478437 - DNA, 567 bp, Homo sapiens
ccctcaagtaggaacgaggcaatcataatgtctgcaaatgcagacagtttttatttcttcttttccatcctgtatatctttgatgaatttctgtcttgtagcactatccattgcagcaagtcacccaatttaggttcagcccacaagttttggactgtttttgtggactgtggttctgatggcagcttaattttcggagtctttgctgtgttgtttggtctgcttggtttttctggttccctgggggctcccactggtccctgctggtgtggcctgtggattgggaaaggcttcactgggccagctgccaggaggctcttggtggaagaaggatgtggtgggacccatgtgcctgtgtcctgggcagcccaggcacctctggtcagggcaggagagccccaggccatggacaacagagtttctctgagcagctgcttgcagtggcaggcccctttatgaagctcttaggatgtgaagagagcagtgactctctttgctttcaggctgggacttagcttaggtgtctggctgttgggaaaatttgggaaaagcttggcatgttaattt

SEQ ID NO: 478438 - DNA, 2345 bp, Homo sapiens
tgggcgattcagagcatagagtgtcacccaccagcatcaagaagataccgccatggtggtgctgctccaaggaaaaggacaacataatatgagacaagggccaagaactgcagaactgtgcacggtgtttagaagaggctgcgagctgctgctctgcagagttgggaggtgctttcgggctctgcaggctccctgcaggcccttgctgactgtccatggcctgcacctgccctacctgctgagctgccccatcagctgctcctggctgtggtttcctgaggggtcccgtctgcatcggctgccctgtgtcctgacactatgtcctgatctgctgacttccactggagtcctgctggcactctgggtggttagaggacaggagagccatgcagtgcacggggaggaaggcggcagtgccagctcacatctggcagggggcagtggccctggtgttgggaagcccatacctcctggctgctgtagtgtgctgtgacccgcttcacctgcacccatctacagacctgccctcggggtccctcagtaagaaccaactgggattcaactttagctgacatggaagagtgatctctacactgtagatgagtaaaaggcaaaagtcttgtatttaatgatatcaaagcatggtaaattattcaaaaattttcacatggagcagttgttttgaatgaggtccacttaatgctactcaataaggtcttaatttgtatatgatttcaccattaagtctatcatggtgcaaccattaatagcgagcattggttaaatacttgcattatttgtaaggggattccataaaatatatatagtcattaaaattgttttgagtaggtagcacagtcatagagttccaaattcaaaacgtacaaaagtttaaataatgtattcttccactcttgtcttgacacaaattcccttcctatgaaacagccagttctataatttttctaatatttttcagaaataggttacatctctacaaaggaagttaattcatgttcgtattcttccttctttatataagtggtaaaaatactgtacacactcttctgcccttgtaagagcaatatattttcaagtgcattccatatttgcacacaaacattccttgcatcctttctacagctgcattatattctattgtatgatatgctgtattatttaaaagtcctttaatgatgtatacttatggctgtctccaacattttgatcttactaatagtgttataataacaagtatgtgtatatgtcatctcacatgtattagagtatttctgtgtgaaaattcctagaaataaaattgccagatcaaaaaatacatgcattagtaatttgtatgtattttgccaaactgcttttatagagagtggttcttttttgtacacaactttttataattaaaattgctacaaggttattttcttttatgtctcctgggttatatgaagtaattttaaaaggcctctttcattggaagattattaaaagtgaattattacatacttttcaagaaatgtattgatatatattcacatggattatgtataaagaggtatatataattcacatgaaatatatataaaaatatacgttctgtgtgaattttattctgattgttaggtgtgatattttcaatgaatctatataatactgtttttaaaattgtgttacaatatatacaacatgaaattaaccattttaaccattttaaagtgtacaattcagtggcattgatggtggtacacactagccatgtgcacaaccatcaccactatgtggttcaagacctttttcattgtcccatgaagaaaacccataaattaggcagtctcttcccattgccgcttctgtccagccctaggcaactacgcatctgctttctatctctatagatttgctttttctgggcatttcatataaatggaatcacacaataatgtggttctggctttttgtcatatggcctttttgtcatatttttcagtgtttttgggagggacaggtccccagagtttcctactctttcgtttttgctgtacaagttttaaaaaatttgaataacttctgtcctgtagttgtagactaacagcaaagtaaaaatgttgccctggttgactgctcagctgcatgctctgccaggctggcagctcagcaaaccctcacaggtgctcgataatcacaaccctcagaacttatgaatgagcccttagatcatcacaggaggtcagtgagatttttggccccatcatcagttggggatttaagctcagaatgcaaattacctttgagacctcctacctgaagggggctgctggctgtggggtccc

SEQ ID NO: 478439 - DNA, 627 bp, Homo sapiens
gccatttgtcctttgatgctagtgctctatttatcacttgccatttcttatcagcccgcggtccctggaaagctatttccctgggaagatggatgtggacagggttttttggggaaagcgtatgttctgtttccacatgccccactgcagggtgtctttagcagatgtgattctgagacagcccatttcaatggaggacacagcaccacacctacctgtctgctgcccctggattcagaggtcagccaggcccaggttgcccatggaggccggctgcctgaggtagacgttatgctgggtgttcaagggggctctgtgtgtgtgccctgcaagcagtccttggtggcagtgaacagagtggctttctgtggagccgccactcctgtctcaggctgccgactcagtgtctgtgaggggaattcctgttcctggcccaaacccacaggccttgctcgtgaaggcctctcacacactctctttttcttgcttggataagaatctgtgctctggagactcttccatggaacccagaaagaaaaaaaaaaaaaaacagagagagagaaaagctttcactcacatccatggctggaaaattcaacttgctctttgtaaagcagactttcccct

SEQ ID NO: 478440 - DNA, 625 bp, Homo sapiens
gagatcgcatacaccgggtgcttgctatagtttggaatgttaaaccaaccttgcattcctaaactcttggtaatgatgtcttatcctgtttatatattcttggattcaatttgctgtatttccagtaatgattgtcacacctaccttcaggaatattggtctgtaattctgtttccttgtaatatagctggtttgggtttcaggaaagtggtgacttcattaagtaaatttggaagtgttgcctcttcttttatttattatcagtactcagccaaaaatcaaggtgacccctctgtgatgctgttcccaacatccagccatctcactcttcatgaacttccatctgagtctcaacccagtgagaagctcagcctgttcatgcattttggcctgggcacagtctccaagggcaagaagcccctcaccagatgccaagcagatgctggcaccatgccttggactttccagcccccagaaccgtgaaccaaataaatgtattttccttataaatttatctgtctgtggcattccgttacagcaacacaaaacagactaagacaaatgaatgatttaaacattgttgacattgacatattcatttccatgtattatttcaataattttt

SEQ ID NO: 478441 - DNA, 678 bp, Homo sapiens
tgtcccctcccaatgcacaccatcatcttgcagccagacaatgagcataggacagctattcagaaaagcgcgtggcttcggaggctcaggacatgtcctgacggcacctgcaggttttcttttcctggggccgcgggcactggcggtgctgcacctgccgcgggccagcgccctgcctgtcagccgcatacctgggcgctggtgcaggccctggcctgctccacatcctgccctgctgcagggcagggccgcttctccgcagcgcttccgttgtctgggatggggtctgccggcgctggctgcaggggctgcacacatcacgcacacatcccacggcgtaaccgccagggtccctggaaatacggaaggtgcacccacttcctgattcacactatcccaattaagaacacagcaagtggaccacggcatgaatttggcttgttggagctcacgtaacttggatgcaagttcatgtttatctaatgggattttagacttttatcctttcatacaaatcatatctcattaatttccctttgatattttagcactttagagccagcataacaaacacattaaatcttgaatgtggttaatcagaaccctcgacgtgagcagtgtgatgccaattgctttagaattaatgaactcttgatgggatgagagagattcaaataa

SEQ ID NO: 478442 - DNA, 450 bp, Homo sapiens
aataccagttcagagcacagagtccatgagatgggagatgagcactgtctacctaaaatcttccagaaatagagccagccatctgaattcaccttataccacaatcaaaccctcaatgtcatcaggtcagaagcctcaaagattgaagggagataagcctacaaagatgagaaagaatcagtgcaagaaccctgaaaactctaaaagctggaatgccctctttccttcaaatgaccacatcacctctgcagcaagtattttgaactgggctgagatggctgaaatgacagaaatcgaattcagaatatggataggaaggaagatcattgagctagaggagtacattgaaacccaattcaaaaaacctagaaatcatgataaaacaaaacaggagctgacagacaaaatagccagtatagaaaaaagaatttaaccaacctgatagagctg

SEQ ID NO: 478443 - DNA, 450 bp, Homo sapiens
taattgaatcatggcggcaggtctttcccatgctgttcttgtgatagtgaataagtctcactgctgtgctgcgggtgtgggacccaccgagccaggcaagggagagaatttcctggtctgccggttgctaagacgatgggaaaagctcagtatttcagcaggagtgtcccatttttccaggtacccagtgaaatggccttgcattggtggcaacgtatttgaaaaagtactccagtctttgcatattggctttgctgggaacatactgggtccctgtggatccagatatgagactttggtctatggggctgtcctagagcacatgtttacagaggtggtccctgaaccttggtctgcaggatctgggatggcactggggtctactggggtgtgcttggaccctaggttctgcggagcctgtgtccacagaggcctgcctagaacgtgaag

SEQ ID NO: 478444 - DNA, 3773 bp, Homo sapiens
agagaagaggaaggagaggaggaaaaggcagaggccagcttggaggaaggagaggaggagaaggcagagaccagcttggaggaaggagaggaggagaaggcagaggccaccttggaggaaggagaggaggccttccttggaggcccctgcatcctcccttgctctgctctcactgctcctgcagctcccccactcccctcggagactccaccagatgtctggaatctccccccctgtctccacatccatgaaggactcatcttgcatgaaggtacaccaggactctgcccgcagggacagatggtcacaccccaccaccatcctgcttcacaagtcgcagagcagccaggccacactgatgctacaggagcacaggatgttcatgggggaagcctacagtgcagccaccggcttcaagatgctgcaggacatgaacagtgctgaccccttccacttgaagtacatcatcaagaagatcaagaacatggctcatggctcccccaagctggtgatggaaaccatccacgactacttcatagacaacccagagatctccagcaggcacaagttccggctgttccagaccctggagatggtcatcggggccagtgacgtcctggaggagacctgggagaaaactttcacacggctcgctctggagaacatgaccaaggccacggtgggcctcccctcccacagcaagtgggccaaccccccacgggttctgggaatgccagcagctgccccagggacccaagtgatgctgggcatgcccagccttgtgggttaccaagcaatttccatccagtgactcacgttcttacccccagccccttcagcgggacaatcatacttttccatctcacgttcccattccaggaaggggtgtggtctggcctcagcctccctgagggtggacaagaccctcctggggcttcatgaggaggggcccctgcatggagtctggcatgaatgaggccaggactggtctacattttctgcttctgaacacactgcagccccgctccagcccccagagtaagtcgacacttctgtgggtcctacccgcctcctgggacacagacagacacttctgtgggtcctacccacctcctgggacacagtgggacacttctgtgggtcctacccgccccctgggacacagagggacacttctgtgggtcctacccgctgcctgggacacagtgggacacttctgtgggtcctacccgcctcctgggacacagacggacacttctgtgggtcctacccgccccctgggacacagagggacacttctgtgggtcctacccgcctcctgggacacagacggacacttctgtgggtcctacccgccgcctgggacacagagggacacttctgtgggtcctacccgcctcctgggacacagagggacacttctgtgggtcctacccgccccctgggacacagacggacacttctgtgggtcctacccgctgcctgggacacagacggacacttctgtgggtcctacccgcctcctgggacacagacggacacttctgtgggtcctacccgcctcctgggacacagagggacacttctgtgggtcctacctgccccctgggacacagagggacacttctgtgggtcctacccgctgcctgggacacagagggacacttctgtgggtcctacccgccccctgggacacagagggacacttctgtgggtcctacccgccccctgggacacagacggacacttctgtgggtcctacccgctgcctgggacacagacggacacttctgtgggtcctacccgctgcctgggacacagacggacacttctgtgggtcctacccgcctcctgggacacagacggacacttctgtgggtcctacccgctgcctgggacacagacggacacttctgtgggtcctacccgcctcctgggacacagacggacacttctgtgggtcctacccgctgcctgggacacagacggacacttctgtgggtcctacccgcctcctgggacacagacggacacttctgtgggtcctacccgccgcctgggacacagacggacacttctgtgggtcctacccgcctcctgggacacagagggacacttctgtgggtcctacccgcctcctgggacacagagggacacttctgtgggtcctacccgctgcctgggacacagagggacacttctgtgggtcctacccgctgcctgggacacagagggacacttctgtgggtcctacccgcctcctgggacacagagggacacttctgtgggtcctacccgctgcctgggacacagagggacacttctgtgggtcctacccgccccctgggacacagacggacacttctgtgggtcctacccgcctcctgggacacagagggacacttctgtgggtcctacccgccccctgggacacagagggacacttctgtgggtcctacccaccccctgggacacagagggacacttctgtgggtcctacccgccccctgggacacagacggacacttctgtgggtcctacccgcctcctgggacacagagggacacttctgtgggtcctacccgccccctgggacacagagggacacttctgtgggtcctacccgcctcctgggacacagagggacacttctgtgggtcctacccgcctcctgggacacagacggacacttctgtgggtcctacccaccccctgggacacagagggacacttctgtgggtcctacccacctcctgggacacagagggacacttctgtgggtcctacccaccccctgggacacagagggacacttctgtgggtcctacccaccccctgggacacagagggacacttctgtgggtcctacccgccccctgggacacagagggacacttctgtgggtcctacccgccccctgggacacagagggacacttctgtgggtcctacccgccccctgggacacagagggacacttctgtgggtcctacccaccccctgggacacagagggacacttctgtgggtcctacccaccccctgggacacagagggacacttctgtgggtcctacccgccccctgggacacagacggacacttctgtgggtcctacccgccgcctgggacacagagggacacttctgtgggtcctacccgctgcctgggacacagagggacacttctgtgggtcctacccacctcctgggacacagagggacacttctgtgggtcctacccgctgcctgggacacagagggacacttctgtgggtcctacccgccccctgggacacagagggacacttctgtgggtcctacccgctgcctgggacacagagggacacttctgtgggtcctacccgccccctgggacacagacggacacttctgtgggtcctacccgccgcctgggacacagagggacacttctgtgggtcctacccgccgcctgggacacagacggacacttctgtgggtcctacccgccgcctgggacacagacggacacttctgtgggtcctacccgccccctgggacacagacggacacttctgtgggtcctacccgccccctgggacacagacggacacttctgtgggtcctacccgccccctgggacacagacggacacttctgtgggtcctacccgccccctgggacacagacggacacttctgtgggtcctacccgccccctgggacacagagggacacttctgtgggtcctacccgccccctgggacacagaggggcatcaggcactctgttacct

SEQ ID NO: 478445 - DNA, 619 bp, Homo sapiens
cttgcaataatccagttgagagatgatggcagctcggactacagagaacacggcagaggtgtgtctgacttgccagataaacatccgtgcaatgacagaaatggaaatgtatctttgcctgaggagaagagaaaaggcagttagcagcttcccgcaaggtcatcagtacaaggcagaaagatctccagccagagcattagcacaatcggctgtaactcagagactcactaaattcctttccaattttgcaggaatggtttgggtattccgaaagaaaaagagcagtaaattgaatgttctgctcttaagagagactcatgcagagaggaaggaaactcacaaggccctaatgacatcatttactaagaaagtccttagaaactgtcagcgctgccaatggactcaactgagaagtctgcagctctttgtcaataattctctatctccatacttggcacagcgcctgcattgatgattcacttaataaataactgactgaatgaatgttggcaccatttggagatatttattcattcattaaaagaagacaactttattgagcattttgtgggttaggtataccatgcaaaggtttaagcaaaattggtcctgccctcac

SEQ ID NO: 478446 - DNA, 725 bp, Homo sapiens
tccctttgaagacctggagagccttccaaagaaggacaggcacaaacaagcccagactgtgaagattatgataaatgtcaaactcttcaattttttaaagacgggccatttgaatatacagtctgtggagacaaaagaaaaaattttaaaaaatgaagcacacgtacaagatttagaaaatagcctcaaaaaggcaaatctaagatttattggccataaagtggtaatgaaagagataggagaagaaagtttatccaaaggaataatatcagataactacccaaacctagagaaagagatgagcattcaagtacaggaaggttataaaccaccagacaaatttaacccaaagaagactatttcaaggcatttaaaagtgaaacccccaaagataaagggtaaagaaataattcttaaaaacagcaataaaaagaaacaaataacatacaatgaagctccagtacatttggcagaaaacttactggtgaaaaccttacagacaaggagagaattaggttaacttgaaagccttgtctttgagctctaaagctctttctctacttgtttgattctatttttgagactttccagtgtattctgcatttctctaagtgtgtcctttatttctagaggttgtgatttttttttaatttatgctgtctatttctctggagacattttcatccatatcctgtaactttttttaaaatttctttaagttgata

SEQ ID NO: 478447 - DNA, 702 bp, Homo sapiens
ttcagtctctcggtatcaaggttactggtccattctttttcttctgctagcacacagtccaagctgtcaatggatctaccattctggggtctagaggatggtggccctcttctcacagctccactaggcagtgccccactggggactctgtgtgggagctccaacctcacatttcccttccacactgccctagcagaggttctctgtgatgcagacacaggattagaagtagggatgagaatagaaacagcacctatggagaaattgtcacatccaggtaacatgaaaatgaaggaaggagctatagaactgtcaccctgtcttccagcactatggctagatcagccctcaacaggtgccaacttcacttggcacaaagacggtgttctcataactacagcaaggaaaacgtataaaaataaagtttctcagaatgtgattagcaatgtgataagcagcatcctgcccgttccacgtttctggcagaagctctaacagtgcattcgcatacttgtatattttttgtaaaattggcaaaaataagatattttaactggaatcctttaggaaactcttccctctcattatatttcccttcatgtcaatggcattgctatggctgcagcatttgcaggatagctttgtggaaggtgagttggtaatgtgtctctttatctgcaaatggagagacatttcatgtca

SEQ ID NO: 478448 - DNA, 794 bp, Homo sapiens
tgtgcgttgtatgaacagtgactgccaaatgaaaatctttggtgttaaaatagtgaggccccaaatcaaaatggccctttgtcctgtggtggagaaggtgggaggggcgccttccgttgcaggctggctgccttctcctggctgctgcaccagcgaggttcttgccgttacaaatggatgtcagggtggctgtccctgcttcatgtccagaccctgctcccagccatttccctggggtcctctcaccctcatggctctggttcatgctgtcccctttgccccctgcctggaagaattatccttttcctactcttcttccttgtcctgtccaacaggcacctcaaattcaacatgtacaaaatggatcctggtgtctttattccctgcatcagaagtagctcctgagttttcatcatggaaaggattcaaggaaggcatcaacctttgtgaaaagaggatgaaggaaccaggggatttatcacaaatctgttcacaccaccctatgcttgtccatagcaaagaattggggtgggggctgatgaggattgcagagggagaaactaatggctccttccaaggagtttcatggaaatgatgatcctgttcccgtcattgctcctcctgtgcttctgtgctggctgatgatgttggtttggatagaatccatgcagaggtggtaattttcaaaccagctcagtcccattatcttacaacaagcatttactgaaggcatgctatgtgcctatcactgtcaaccagacaaggacctgcataccttgtaggatggacttatc

SEQ ID NO: 478449 - DNA, 4624 bp, Homo sapiens
agtgggcaactcaggactgaccctcagaaagttagtgacctggctcatcatgacagcccagatttcaatggtagtgaaaagggccgtcgtcaatgctaagatgagtgatgatgaccaggatgaatttgactggcttcaaaggcaagtagtggaaatattcttggatatatttttagaagtggcaaaccctatttgtggcaaactcttaatgttaagaagtctggaggaagaggaagagtcagaaaaacagcctaaaaagaagtgtccagttagaagcaaaagatctgggcattggtcagtcatcagccaagggcagcccacaggcagagggtggatgcaggatcacctgggcatccctgggcaagaggctaatgccagtcaagggcaattcttcagagaagagttccagtgtgagccatgggcagtagaagaaattgataaatttctagacacatggaccctaccaagactgaaacctgaagaaatagaaaatctgagaacaatgtaaaataagaatgaatcagtaataagaattcttcaattaaaagaaaacatccttgattggatggcttcactgctaaattcactcacacattcaaagaagatctgatgccaattattgaaaatttccaaaaaaatgaaatggagggaatacttctaaattctttttatgaggctggaattacactgacaaaaaagacaaggacactacaagaaaaatatttataggcaattatttctgatgaaataatgcaacttattctcaccttgagttcagtttgagaattgaactcaaacacattacttcaaagactcattttcaagtgcacacagcacattctccagacatatgttaggttgcaagacaaatcttaataaatttaagaagattcaaattatatcaggtgtctctgtgtgtggcaatggtatgaaactagaaatcaataacaagaaaaatcttggaaaatacataaatatgtggaaattaataattaccacaataaagtggtatttgtcattggaatacaaagatggctcaacatatgcagatcagtaaatgtgatacacaacattaataaaatgaaagatgaaaattatatgaccatttaatggacatagaaaaatcatttgacaaaattcaacacccttttatggaaaaagttttcaacagcttagatatagagggagtgtacctcaacccaataaaggccatatatgacaaacttgtaggtagcatcattctcaatggtgagaagttaaaagcttttccttcaatgtcagaaataagataaggatgcccactctcaccacctgtattcattatagtactggaagtcctagccagagcaattaggcaagagaaagaaatacaagcatccgagtagggaagaaagaagtaaaattgtctgtatttgttgatgacatgatcttatatagagaaaaccctaaagatacccctaaagaatttgttacaattaaaattgaattaagtaaagttacaggatacaatattattacacaaaattaatagtgtttgtatatactaataacaaattatctgaaaaggaagttaggcaaacagttccatttacaatagcaacaaaaattaaatacttagttctaaattcagcaaaggaagtaaaagtcctgtacaacaaaaacactgacgaaaaagttaaagaagacacaaataaattgaaagatatcctgtgttcatgatatataaaaattaatattgtgaaaatgtctgtactacccaaagtgatttataaatttgatgcaatctctatcaaaatgccaatatcatttttcacagtaataaaaaaatcaatattaaatttgtatggaaacaccacaaatacccaaaacaatcttgagcaaaaagaacaaagtggaggcatcacacttcctgatttcaaaccatattataaagaacttataatcaaaatagcatggcgcctgcatacaaacaggcatatcggccaataaaacagtatccaaaacccataaatatgcccatgcatttatagtcaaaatatttttgtgtcagttttgatggctacatttttcattaatttgaccattccatctgaatagtcaaattcactacaaaaatgttattcacaaatttcttattttttaaattactgaagttcctctttcctgattattaaaaatttgtgttgtctctcattctttccttttaaaatagcttgttgaggtataataaccaaacaataggctgttcatattaaaagtatatagtttaataagtgttgagatatatgataaatgaacactacaattcaggtaatgaacattcccatcacttcctcatttcctcatatctctttttaatccctccgtcctaactgtcccaataccactcctttttctagacaaagcctaatctcatttctattgctatatagatcagtttccatttcctaaaatttatataaaggaatcatatattattcttttgtttgatttcttttactcagcaaaattattatgagatttatatatgttgctgcatgtatcatttgttccttcctttttatttctgagtaatattctattgtatgaatacatcaccatttgtctatccaacatattgtgggtgggcatttcaattgtttatagtttctggctattacacataaagtgttctgaacattcatgaacaagtctatttaaagacatgtgctttcatttctctggagtaaatacctaggagtggaatagtttctcctatggcaagtgtatgtttaactatttaagaatttgccaaagagctttccaaagtggttgtaccactttacattccagaaggcagtatataaaaactctggtctctccacatccttagtctttttaaatatagccattcttgtgatatccctttgtggtttgaatttgcattttcctagtgataactggtgttgagcatctttcagtgtattcatttcccatctgaaccttttacttgtacaaatctttgtcggttcaaatcttatgtccatttgttttttaaactgttttttaaattactgagttctgataaatttttatatattatggctatatctcctttatcaaatatgtaatttgcaaatattttctcccagtatgacctatatgttcattctctaaatacaatcatttttgaagagtagaagttttaaattttgatgaagtttaacagttttttttatggattgcacatttgcattttatcatagcaatttttgcctaactcaaagacacaaggaatttctccaatgtattattctagaagttttatagttttaggcattccagttaggtttatgatctattttgagttaatttttatatggtgtgagctgtgggttgaagtttattattttgtatatagatatccagtggttccagaactatttattgaaaaactattattttctctactgaattgcctttgcatctttgtagaaaatttgttcataaatgattgagtcaattttgggggtcttgttgtgaagacagggtaatagatgagtgaaacaaatagtgacgcaaactcatctactgtctttacaacaagactacactggcttgcttaccatagctttataataaataagtaatgtttgtcctccaaaattgctcttatttttcaaaatcattttggatattctaggtcctttgaatttccatatgccagtacttattttcatggttaatttacatctcagtgactccatatttttagaagtaatcataatttaattccaaaggcaaaatactaatatgaaatgtggtatgattccttgaataacacatgtaattacttttaacatctcaattaatgtggaagatacaggtagatttttatgggaaatttataggcttagaaagctataattcattttattaatagaatatgtgagcaagaagcatacattttgcttatttattgatttttttacttccttatttttatattatatataaattatatattatatttatattatatataaattatatattatatttatattatatataaattatatattatatttatattatatataaattatatattatatttatattatatataaattatatattatatttatattatatataaattatatattatatttataatatatataaattatatattatatttataatatatataaattatatattatatttataatatatataaattatatattatatttatattatatataaattatatattatatttatattatatataaattatatattatatttatattatatataaattatatattatatttatattatatataaattatatattatatttatattatatataaattatatattatatttatattctatgtaaattatatattatatttatattctatgtaaattatatatatttatattctatgtaaattatatatatttatattctatgtaaattatatatattatatttatattctatgtaaattatatatattatatttatattctatgtaaattatatatatttatattatatgtaaattatatatataatatatatattatatataaattatatatattttttattcta

SEQ ID NO: 478450 - DNA, 675 bp, Homo sapiens
gtggagtagtgacggcagggaggcagctaagcggattgtggatgattactgagtatgttagtgcgtggcgctgttcttcgcctacgtgttgtgagccaaaactgtggaagcgactttggaactgggtaacaggcagaggttggaacagtttggagggctcagtaaaagacaggaaaatgtggaaaagtttggaattcgctagagacttgctgaatggctttgaccaaaatgctgataatgatatggacaatgaaatcaaggctgaggcgatctcagatggagatgaggaacttgttgggaactggagcaaaggtgactctcattatgttttagcaaagagactggtggcattttgcccctgccctagaaatctgtggaactttgaacttgaaagagatgatttaggatattgggtggataaaatttctaagcagcaaagcattcaagaggtgacttgtgtgctattaaaggcattcagtttcaaaagggaaagagcacaaaagcttggaaaatttgcagcctgaccatgtaatagaaaagaaaatcccattttctgaggagaaattcaagatggctgcagaaatttgcataagtgatgaggagctgaatgttaatcaccaagacaatgaggaaaatgtcatcagggcatgtcagagacctttgctacagcctctc

SEQ ID NO: 478451 - DNA, 607 bp, Homo sapiens
tgtcttctgccatcaatgtgggacagaatggctagagtggggcagaggaagggaaatgtggggttggagccccaacacagagtccctactggggcgcaatctagtggagctgtgagaagagggccatcatcctgcagaccccagaaaggtagatccaccaacatcttgcactgtgtgtctggaaaagctgcagacactcaatgccagcctgtgaaagcagccaagagggggcttataccctgcaaagccatagggacagagctgctcaaggctgtgggagcccacctcttgcatcagtgtgacctgtattctcctaccaggacctttgaaaatccagtcctcaccagaagtctgctgacagcaagaaccatagggaaagaacaaggaatgaatctagtaacacacaggtcaagaatcagcaaaaaaaccttcagaattaaacatccaggaaataatcaactaagagccagtcacccttttaagtcctataaaaaacaatttacaacctgctgtctctaaagtctgctatctaagagcttcctctgaacaataaaacttggtctccacagtcctttacctttaacctgaacattcctttctatcaata

SEQ ID NO: 478452 - DNA, 658 bp, Homo sapiens
tgtcataagttaaggcaggaacaggccattttcatttcttttgtggtggaatgtcatcagttaaggcaggaactggccatctggatgtcatcatgggtggaaccggaggccattatcccaagagaaataactcagaaacagaaaatcaaatgctacatgtttccacttataaaaggagcaaaggcattctctgggaactcttttatcagggcactaatgctgttgatgaggactctaccgtcatgacccagtcacctcccaaaggccctgtgtccaaataccattacaatggggattcgatttcagcagatgaatttgggaaatgtgaaactggagtggaacaaatgtcccgtggtattgccctagaaagaaagtttcacaggcttcaccagccaaagttccctttccaacctggacaggagattgccttagactatggagctaaattcagcactgatgcccggacatggaagcagggaaagagggccagggcagcagcagaaatgaatgggaacatggacccagctgtgccctgctcctactggctaaggagataggttgatcaacccatgagggcagaccagcagccagttgataccacattcacatggcattgatgtctgtaagttatttgcaatttattgagcatattcagtac

SEQ ID NO: 478453 - DNA, 651 bp, Homo sapiens
tcatcagtaaaggcaggaacaggccattttcacttcttttgtggtggaatgtcatcagttaaggcaggaaccggccatgtggatgtgtatggcgtgcgatgggtatgtggctcacttcttcagtatcctgctgctcaaacctctaggagaacacacagatgggcaggctgtggggcttcgatcccatggcaatgtgaaactctacatcgttcccccagttgatggcctgctggcctaccggcatctgccagtgtgctctccacatcctctcgatgtccagcagcttgtgtgttcctcggttgatgtgtttcttttgacatctttcgagctttgccccctgggctatgaccttcacaagcgcttctccgtccccctccttctatgtgatacaggaagcctggaggaagctaaaattggatattttccttctctcatgtcagttaggctctggattcaaccaccaaaaaactcaagatcatttttcaatgtctcacctttatttatgttttcagggaaggagagttagaaagaaagtcagcagtctggaaaatgaaacattctgcccttgtctcctgaacacagccaggccaagttgtaactcaaatcactctttgtactgcttggtcgtaaatcccttcaaactgagttggc

SEQ ID NO: 478454 - DNA, 441 bp, Homo sapiens
tttttcctcctacgccctaggcctgtgatgggaggggctgccatgaagacctctgacatgccctggagacattttccccatgctgataagaagtttagctatcatactggaaagatcttgtggagatacaacagaatattcaaaaggagaggccttgagagttgcgagaaaggaaggagagaagagacagggaggaagaagagaggggagaggaagaaggagaggaagcagagaggagaagagaggagaggaaaagagaagagaggaaagaacaggagaaaggagaagaggaggggagagaagatgacagaagagaagagaggacatgatagatacctggctatttcagcatctcaaccttctctactgaggcacctgacatccagacatgtgaatgagccatctagggtgttccagtccagaagagctctcaaatgactg

SEQ ID NO: 478455 - DNA, 770 bp, Homo sapiens
gtgagtaccgcgcgaagccctggtttccgcccgcgcctcgccctctacacctccctggaagctgagggagctggctcccgcctcagccaacccagaaaggggctcccacagtgcagcggcgggctgaagggctcctcaagcgtggccagagtgggcgccgaggaggcgcctagagcgagtgagggctgggagggcgccagcacgctgtcacctctcacctctatctgtaaaacggaggcctctggacctgtgatgggaagggctgccgtgaaggtctctggcataccctggagacattttcctcatctttatctgagaccacctaaacctgactttactgtccatatcactatcagtattttggggactattctaaggcagcatgtttctgtcgggcctgatcggaggtgtcctgtacaaccaaatgactgttcacaactttgcattgagctcactcccttcaggacctcttataaggcaagtctgttggtaaggaattccattagcatttgcttccctgaaaagggtgttatgtctccttcacttatgaagcttagtttggtgggatatgaaattcttggttggaatttcttttctttgacaatgctgagtacaagcccccaatctcttctggcctgtcagatgtctgctgaatggtccactggtagcctaatggggtagcctttgtaggtgacctgcctcttctctccagctgactttaatattttttctttcatttcaaacttggagaatctgacaaccaggtgtct

SEQ ID NO: 478456 - DNA, 851 bp, Homo sapiens
cagcctaagaaagggacaaattccctatcggtcagcaagccatccccagtatggatacccagtgggacctcaactcagatcatggggactggagtcacaaacgtctgttgacctgtgttctagaaggactaaggagaattaggaaaaagcccatgaattatacaatgatgtctaccataattcagggaaaggaagaaaatcccaccttccttgagcggctacaggaggccttaagaaaatatagttccctgtcaccccactcactcaagggtcaattgatcctgaaatataagtttattacccaatcagccacagatatcaggagaaagctccaaaagcaagccctaggccctgaacaaaatgtggaggtgttattaaacctggcaaccttggtgttctataatagggaccaagaggaacaggccataaaggaaaagcaagatcagagaaaggttgcagccttagtcatggccctcagacaaacaaaccttggtggttcagagaggacagaaaatggagcaggccaatcacccagtaaggcttatcaatgtggtttgcaaggacactttaaaaaagattgtccaacaagaaacaagctgccccctcacccacgtccactatgccgaggcaatcactggaaggtgcactgccccagaggacaaaggctctctggaccagaagcccccaacagatgatccaacagggtgcccatggcaagtgccagctcatgtcatcaccctcactgagacctgggtatgtttaaccattgagggccaggaaattgacttcctcctggacactggtgtagctttctcagtgttaatctcctgtcccagagagctgtcctcacc

SEQ ID NO: 478457 - DNA, 1137 bp, Homo sapiens
ctgacttggtacagaagacagcaaaggtgatcaggtgtgtatcaaggattggaaagtagcccccttgtggccatggtggaaaggaccccagaccatcgtcttgaccactcccacagctataaaggacaaaagttgtataagagcaggacagggacagtcatctggtggggtctcaaccgcactgaaaataatccattcaataaatttcccaagttacagactgtttgggcccatccagaatctcaccgacactggacagctcccactggactatactggatatgtgggcatagagcctacaccaaattacctgaccaatgggaaattgaaaagattatgagtggacctccaaaaggatcatacagtactataggcctgccacatgggcacaagacagctcaggggataccaaacccccatctacatgctcaactggatcatacggttaaggctgtcttagaaataatcactagtgaaactggcagagctttgactcatttggcccggcaggaaacccaaatgagaaatgccatcgatcagaagagactggccttagactatttgctagcagctgaaggacgagtctgtgaaaaattcaacttgaccaattgctgtctgcaaatagatgatcaaggacaagtagtcaaatatatagttagagacatgacaaagctggcacatgtgcccataaggtttgccataggtttgatcctggatccctgtttggaaaatggtttccagctctaggaggatttaaaactcctatactacgaataataatagtgttaggaacctgcatgttactcccttgtatattaccctgtaagagtagtttacaccctacagttatgatatcataataataacttttgttttactgtgtacttactgttaccagtgcattttctaccttcagtccattaagtcttagatttgcccttttgaggctattttctagatcctgtagcgtgcttccttgttttttactcttttttcttttgtctcctctgactatttcaaatagcatgtcttcaaactcactaattctttcttctgcttgatccattctgctattaaaggactctgatacattcttcggtatgtgtgttgcattgttttaaaattatactttaagtt

SEQ ID NO: 478458 - DNA, 1662 bp, Homo sapiens
atctataatcccagcgcttttggaggcagaggcggatgatcatctgagtgagccaagatcatgccattgcactccagcctgcccaacaagagtgaaactctgtcaaaggaagaagaagaagaagaagaagaagaagaagaagaagaagaagaagaagaagaagaagaagaagaagaagaagaagaagaagaagaagaaggaggaggaggaggaagtagtggtggaggaggaggaggaggaggaggaggaaagaaggaagaagaagaaggagaaggagaaggagaagaaagaagaagaaagaagaagaagaaagattatgcaccgagggaaaatgatttggggctgcttttcattaaacagaaaagccttaccgaggacgcccatacccttactatctgcctaagtgatttcttcttaactcctgtagcagtagagaatggcaacatctgctggagtcgccaaaactgggaagaaggtatggtgagacacccaagctggcagagtgaagaatgcaggaaccggaacagtcaaggactggaggtgggaattgaacaatgagatcacatggacacaggaaggggaatatcacactctggggactgttgtggggtggggggaggggggagggatagcactgggagatatacctaatgctagatgatgagttagtgggtgcagcgcaccagcatggcacatgtatacatatgtaactaacctgcacaatgtgcacatgtaccctaaaacttaaagtataataataataataataataataaaagaaagaaattacagtaggtcttgcttgaagtttattttcttttttaaagaaacaactgcttctttcatcgatttttaaactttttctgtttttcattttattaatatatactttttatttcctcacctttatactttcatattaatatatgtttacatcatttttctaagttattgagatagaagcttaaattattgatttgagactagttttctttactaatttcagcattttagtgctataaatttcccctttggttgtgttctacaaagtttgatatattgtatatttattttcattcagttcaatgcatttaaataatttctttgaaattatttttgatccatggattacttgtaagtgtgtttactttccaagtgttttaatattttcctgttatatacctgttactgattcttagtttgagtccattgtggtcagagattaaactctgtatgaatttgattattttttcaggttgaggcttgttttatattccaggatatggtctatgttgttatatgtttcataagtgcataaaataatgtatatcctgcagttatttgacagagtattccataaattttgactaaattctgttgttgatggggtggttgggtttttctatactttcaatgtctaatttttcagtcaattactgaaggaaggtctccaaatataattgttaatttgtttttttctttcggttttatgagtttatgcatcacacattttgcatctctgctgtttggtgcatatatgttaggattggtatgttttcttggtggaatgaatcttttaccattgtataatatccttctcacttcctggcaaggaacttttctttgctaagaactatacttcatatgatattaatatagtga

SEQ ID NO: 478459 - DNA, 1521 bp, Homo sapiens
acctactgacctgtcttctaagttccctcccctcaaccccccaccccccaacaggccctgtaatgtgggcttcaaactatgatatcctttattccacttggtccatttggctgttgatgcttgtgtatgtttcacgaagttctcatgctttgtttttcagctccatcagggctcaggcccagggagatccaaattctgtccctgagcctctggctggagttattggagatcctgcaaggaagcctgactcactgaagaaggataggcagctgccagtcccagtgctggctgctgaccctcccccaaggagctcaaatggcttacacagcaggcaactctcacccctccccctggtaagcttaagcagattcccactgagaggctgtaagaatgcaggttccatggttgggtcgctagaccctggtggcttgggttttgctactgtaatgattgagtcagcaaagtgtccagagacagaatcccagatgctgtttttaatagaatggctagcgtaagaacacttaagatgtacttattttcttagcacatatcaagtatacaatacagtattgttaagcatagtcaccatgctctacattagatctccagaacttattcatgttgctctgttttcaaataaaattatgccacttcaagtataactgacaaatttaaaacatgtgctatgactatattttaaaatacatatgttataaagcccatgatacattgttattatttttgtttaaactgttagttactttttaaagagattgaaaagtttagtaacatcttctatacttacccaaattttgttttatatttatttattatttagtcatcatgcattctgcattcaatcttacccacattttgaatactttattcctttaagtagatccaaacttgtatttgttactattttccttttgccaaaggaaatttctttatcatttcttatagtataggtctgctgtagatacattttctcagcttttgtttgtccaatatatcatattttcatttttgaaagctatttctgctgaatatagaattctgagtagaccattttttctttcagcatttaaatatgttactgtattgtcttctaagttgcatacttctcattagatatcaagtaaaatttttgtctttgtttctttgtacttaatatttcttcttttctgaatgctttaaagacgttctatttatcataggttttcagtaatttgataatgatgtgtgttattgtagttttattttgcttattctatttggagtttattgattgagattctttattcattgcattctaagtgttcatcaaatttgaaaaatgaaatgacattatgttatcatttttttccatcattctactttttcctgctgaaattcccagtacatgtttcttagatcattcaatattgctccacatgtcaatgatctgtacacttttttctttcactttgttgttttcccctgtgtttcattttggataatttctatttctgtattcaaatt

SEQ ID NO: 478460 - DNA, 1047 bp, Homo sapiens
tcccttttttcctgtgtcacacaaccacagtaaatgctcccctggttacccaagccttttgaacctaggggaagatgaattactgccaaggcagaagtgcattggctccgacccttactgtgttctcctgtgattcccccaaacaagtttccctgaatctactccaggatatcacaggactgaaaacaaggtgttggtctgggctgtggttctcatctgatgctcgagaccttctttcaggctcacagggtgtgggcagaattcatttccttcgagttggagctaagttcctagttttcctgctagcttttggcaaggagctgccctcatctcctagaggctgcctgcagttctttgccccccaaggacagaaggggggtactgatccagaccccaagggagggttcttggatctcatgcaagaaggaattcaggctgaaacgaggtgctctgtggacattagttcagacttggaggcttggaatcagttctttgtaactggcttggtctcattcctgaggatgacggagcttcttcccatgaccatgcacagatgacatcagcactcagaatctcattcacaatgaaacccatctgcagggagccacctttaccccgagtatggatttcagctttgcttctatttaatcgtgagtgaccttgagtccattacttggcctctatcattctcagtttcatgatttgaaaaaggaggggtcaaaatgaaaaatcataggtctttttaaaactgagggctaacctgattgggcccgccaatgttaacttttctcccttgttttttagtcacttgcttttagtttattttaaaacccatagacctaaaagtcatgaagctaagcaatatataactaaccttgcactggcttccttataggtaatatctctggtgtataggtcaccacagtaacagttgcttaagttgttttgtgggaacttagagtccatttttgtttagctcgagctggctgagaccttttgactggcctgcattaatctctgatgggtgaccctttgatgtcagagggt

SEQ ID NO: 478461 - DNA, 494 bp, Homo sapiens
aagggggataagggaaaactcctccttgtcaccagaatgatgataggacctcgatttctttttcaagttttcctcttcactccaggggactccactgtgtccacaatgagtgacacagtgagtcacacatgtgcttctgatatgatcctggtcactgcctctgccactcactttacttggctacagatgaccagtcttgcctgcacacatcaacttccgtctgcacaagtctggggcagcaaatactaccttagaggggatctggccatggtcagcttagctaaacccagattgtatatttatcaaaagagtaaggaacatttgaagattaaggaagcatctaatgcagaagaaacttacaacttactactagatgacgttgttctcaggacctggaagcctatccccattgaatgtcaaatagggatctccctagatgtctacaaagcaacctccttgactaactagaggaatgctctgttgtagagcttccc

SEQ ID NO: 478462 - DNA, 1146 bp, Homo sapiens
gtctggtgggaaggatccaactctgccgtctccctcaacttgctgacactgagcagatctatgtgtctctttgctgttgcacagggacgcaggattagtcgtgtacctctcacaattctcagccctgtgctttgcacacagcagatgaccaataagtgtggctatgaagaaggcatggaagacaaggataactcagggaacagagaagatggcagcacagatagtgtcacttggggttttgagaaaggcgatagatattggctgccactcagatcatgtgggataatgatgctagaacaggtttccaccttcattcatatgcaggaggtaccattcaaatatttgatttcaatcagtaacgcattttggcattctgtgaaatgcaatgtgattttagttacatgttatttcatcatgttacaaatgtacattgaaataacaatacagttggattatctgcgatggagtttagatatttccaggaatgttgctgagtgggttgcttaggcaaaggagataagcaagcaatgtgacattcactgaaaataattctcatggaattgattttcacaggcattgactcgaatgctgtgccagctccataagacaccatggaatcatagaggaaacgatctcagttttaaagaggactgactttgtttcgatgctccttaatttccaaacttgttttaactcttctaccagagactgactctgttttatatctcagtccaattgtcccagtgattgttgtgctcacacctttacatcattaataattccatatgactgtggacataccttccattaactattgaagtatttcctaagtagagtagtaagacaaagcccagggtcatgaattgctgaaactctaaagccattgcagtttatcctggataccttttgttctagttcattctttcttggcttttaggtaggtataacttttttctcccatcaaattttacactcagggtagaatccagaattagttaactagactttgatatgagtttgacacgatgttcacagatatcattgacttttagatatgaaaatgattgtaaatatatcctagtccaatctccatgtgttatattgttatatataagaaagctgtgtctcagagataagctttggatt

SEQ ID NO: 478463 - DNA, 760 bp, Homo sapiens
tagttcacgtgtttttgtatcaatggcctcatcgagagttccctatgatcagttgacagaggaagagaaggctaggttcacagatggttctgcacgatatgcaggcaccacccgaaagtggacagctgcagcactgcagcccctttctaggatatccctgaaggacagcggtgaagaggtcttagttacagagggaagaatgctgctaccaagagacacaacaataattgcattaaactggaagttaagattgccacctggacactttgagctcctcctacctttaagtcaacaggctaagaagggaactacagttttggctgtggtgattgacccagactatcaagatgaaatcagtcttctactccataatggaggcaggactacaaatggtccagacccctcaggaatgaaggttttggtcactctaacaggaaaaaatccacgacttgctgagatgcttgctgaaggcaatgggaatacagaatggatagtagaagaaggtagtcatcaataccagctaccactatgtgaccaggtgcagagataaggactgtaattgtcatgagtatttcctccttcttttgttaaaaacatgcttgtgcatgtatacatttatactaagaaaatttgttcatttaattttattttcctttatcatgtgacataagatgtgttgacttcatatcagcatttaagtattgttaactttatgtaatagtatttggttaactttaacttttttgaatatcatggtgag

SEQ ID NO: 478464 - DNA, 592 bp, Homo sapiens
tttctgctagagcccatctgagcagcacagctcaggatcctgtttgtgatgacaattccagcttatagaggctgtgcacaaactgtctttgtgtcctatagttcaccttttgacataaagagccatattccacctcattttaatgctaaaactctgacccaagcaaaggaaaatgccaacagaatgaaaagacaacccatggaatgggagaaaatatctgcatactactcatccaacaggggattaatatccagaatatacaaggaaatcaaacattgcaacagcacaaaaaaccccaatccaattaaaaatgggaaaaatgatctgaacagacatttctcaacagaaggcatacaaatggccaacaaatatataagaaaatgctcaacatcactaatcatcaggaaaatgcaaatcaaaaccacaatgaggaaatgtttccagtttttgcctgttcagtatgatgttgtctgtggatttgtcatagatgacatttctcaaaagaagacatacaaatggccaacaaacatacaaaaaaatgctaaaaatcactaatcatcatggaaatgcaaatcaaaactacaataagata

SEQ ID NO: 478465 - DNA, 683 bp, Homo sapiens
cttaggaactagaatcaaagcaggggcaatagagaacacagacttgccatatatgtacaaagcgaaagcaaactttattgtcaattgtcacctctctggcccctgtgggaaggaaggagagtcccctggtgctgatgcggaatttgcttttcacccctgcaggcagggcccaacacataccgatcccagaggttcagagtttcagccaagagggaactgggagtccatctctccagatgagaagaaagaagaacagcacaggccagagtgtaagggcacacaaagaaatgagtcagcaaaggacagaaggattggccagtggaggaggaggagaactggaagacaagcaaagggagttagaggattggatggccatggatacaaaatgccgggtcagggtcaaggaagatgcagttcaacgaagagtaggattggtgtagctgcaagaagatcgcgagggccttttgccagagcagtttctgtggagtgcagggagagaaggagccaaactgcagtttgtttgaagaaggaaaactgggaggtggacagatggaaaacaagtcaagaagcaagaatttgtaggcttggatggtaagaaaagaaaaggaggtgtaggatcaggggaggactttaagatggacaacatgcttgatcataattttatgatatgaagaaggagccaa

SEQ ID NO: 478466 - DNA, 1282 bp, Homo sapiens
cgcttcactttcttgcccttcgcagaaattgcattttttacaaattgaagctggtaacctaagagctctggtaaagatgtacaaagagatgaatgctgttttcctgcctgctaacaaagaatccattcaacagcccctagatcaaggagtaattttgactttcgagtcttattatttaataaatatattttgtaagtctataagtgccctaggaattgattcctctgatgggcctgggcaaagtgaattgaaaattttgtggaaaggattcacaattatagatgccaaaaagaacactcatggcgcaggacaaagggaagtgaagccggaactgcagccactttttatgcccgtggaaagaccgtattatgctccacctctcaccccagctcctgcaacacaaatgcccagcacaccagggtttgtgagatacaatccatacagtcatctcacctacaacaactacaggcttgaagggaacccaggcaccaacagccaggtcacagcatcctatgctattaccataccaaaacccccaaagccaccagataagctgctgatgccctaccctcctgaagatccagatgattatgacgatggcttttcaatgaagcatacagccaccgcccatttccagagaaaccactgcctcatcagtgaaatccttagtgagagtgtggtgccagacgttcgaggaaatgacaaccaggagaagaggaggaaatacttggaaagcacagattcatttaatgatgaacttaaaagtttgtgtggtctgaaagtagaagtggatatgaagaaaattgcagcacagagcagcattgttcctaaggaaaagcaagcagccagcaaaggcgaggagaagaaagatgacaagaacattccaatggagatggaggaggcacgctttgaagaaatgacagagagccaacagaacagtgaagaaggcacgtttaatcctgaggacaaggagagtgggcaggagtgggtagacagtatggcagaggaaggaaccagtgatagtaacattggatcggacagcaacagcacaatagtgcaggagccaccaaaagatcccataccagaagatgagaaaaaaagagtaaatcttgccttgttttatgtgttgtaaatagttttttaaatgaaaaaatgtttttgattaaaaaaaaaagaacattcatgattaatgggaggaggtcaaaatattctcattaacaggagtctggaagaagttgattccagtcctcatggatgacattgagaggttcaaggcttcaac

SEQ ID NO: 478467 - DNA, 513 bp, Homo sapiens
ggctctttgggaaccatatgagacaattctggttaatgagataaatgcctaatttgctgctggtcagccatcttgtgactatagagtcaaacagggcaaaagccaatccctacgagattctaaaacagacatttagaaaactgatccggcacctcccacctctggacttccgttatgtgagaaaaaataaatacttctttgtcacagaaggcaggtgcaaggttttagtgaccatcgtgtgtacgaagcacactcagttggaacctctccaaggtacctggggaatgggagtgtggcaagggtgtgaggatgggccgtggaagtggagaagcctacatggcatctttagtgtgtcttgggaacctggatattcatccccccatgcctccagatattgctaaggagttgtgctactgtataaatcatcatgtttcacttcaacactttatattctatagtactaggtagcctaacctgcgttctggggctccaacgcaaggccagagcatctac

SEQ ID NO: 478468 - DNA, 1051 bp, Homo sapiens
gaaccacctgtaggccaaatcaagtgcctggtgtcctaccgtcactaccctgaatcactgccgactttacagacacacatctcccacctgctgggacccacaccaaaatgcctggtgccataagcatatctcctgcaagacttcacagtcaaccagaagagggaccgggactcatttttcttttctggactctaataggcccaattaattcagctacaacatgggcccttacaagcctgggacaagcctgggtggaattctatattgagggtaagaaaagggatggaagtagatgttttccagaaggttctgtggactctgggggtgacctgtggacagctgctgctgcccactacctggcagtttggctatgtgatacatgtcagccttacaaggagatcccccttaccctggaatctactttgggggagcagaacttgagcctcaggcaaatcagagacgagggggaaactttgctttttcctccagtggcagggagctctgggctggggaaatgtctttttgaacacaaagttccagttgcattcatccacaggaaaatgtaaagagcttaatttaatgccctctgggagtcatttcgatttaaaagtggtattatagcttgtggctagaagaatgggcttaacggttagtcaccttctgtttgggcatgtcatttaatctctttgaggctgtttcttcatcttaaaatatgagtgagaaggtagtacccaccttacaatgtggacaagattaatttagggaaaacacgtagcacagggcttcacccatggtgctttcattatgttgggtcctggccttgatggcctgggcagtcagagatcctggggaggttacttcagcaacactgcaggccaatgggattcctggctttgtggatctggaagtggagagctatttgctgattattttaatgatctttccctccacattctttgagatcaaaatctttgagcggcatttagggagttgctttagtttatctaggtggttgcttttgaacagaggagaaccttgcagcagcccctgc

SEQ ID NO: 478469 - DNA, 709 bp, Homo sapiens
accacagcagtcatgataataacaatggacaacagtgacaaagtgaggcctccacagccatgtggaactcatgctctgaatttgacttgcaactttcagtaccagcatggaggtgtcgtaagaagcttaaaacacataacccctgcaaagatggaaatgaatatttttcggcaaaagaggaaatagaggggcccacacattgtttgatgatttcagaaaaagatgacatttggactcataaacattataacttgtggaaaatggtgtccaatttctccaccatgatgtcagagccttggtgggagcctcagcgagagagcaggggagagaagtttctaccttttgtctcaaccgggttctacatgcctgatacttgggagctgcagcgacccttgtgggtttatctggcctccaggatgaaggtggatctatgtgtctgaagggatccattctgtccctgccttgttacgagattccagataagtcacatcgcctttctgattctctgaaaagtggagtgtggaataaataacttcccaagttcctttctaatataacactccatggttcctttaataatattgacatgttatgttagtataccattatagagcaataataataatcacttacataatgtcttgtattgttcttagttgtttgcatatattaattcaatgaatccttgcaacaaccctacttttgttgt

SEQ ID NO: 478470 - DNA, 1398 bp, Homo sapiens
gaccagaaaaatggggccaatatcatgattcctcagcagtgcctggagaagaccaggagaggaagcagaagaccctcctcaaagaagcagccttcacctccagacctcccagcgggacttagacaatggggttaggcagtcacatgtctgcacgtggaaactttctgggactgtgcttggatcctggctctgccttttactagccatgtgaccttgggaaaatcacttgacttctccgtgcaggattcctcatctgtaaaaatggtctaagattaggagccacctcaaggttgttgtaggaattaaattaattcatgtttataaagtgctttgaacagcgtttggcacatggtaagtgctatgtggtaagtgctgtctattgattacataaataaaagtgatcaccattagactttccatgcagatgatattatgcatatacatatctcccgcatatgacgtcattggatcgttttgcaatggtggggggtttattcttttcctttttgttttcttcttttttttgtcagatgaagaaactgatgggaagtgaattggtttctgtggtgtggtgtgatgatgctgggataggcactcagatggttgagtctgagtttggctctgatattatatcaactgcatgggcagctgtggtgtggtgtgatgatgctgggataggcactcagatggttgagtctgagtttggctctgatattatatcaactgcatgggcagctgtggtgtggtgtgatgatgctgggataggcactcagatggttgagtctgagtttggctctgatattatatcaactgcatgggcagctgtggtgtggtgtgatgatgctgggataggcactcagatggttgagtctgagtttggctctgatattatatcaaccgcatcattttggggaagacacaatttctcagaattttatttagttgtaaaataaagataatgatattacatgctctgtctaccatctagagtttttgtcaagacaaactgaagtaaaccgtgttagagaaaaatgttacaaaattttaagcgtgaattagacaaaacttaactggaagccaactgccaaagagatctgggaaatgtagttttcagacttccagccccattattatagagggaagttatgggaccatgcttaacaaagctcagttttggcttggggcagttttgtaaagagctacatattactagctattattatgaggctattgttcaagtcttaatggatctgccaaacaatcattttgacttatactctcttctaaattaattagtagtttgactaatcagtgtgatcatttaaggccaacatgccccaagggaaaacgtgtaaataagtttttttgaattattcaaataagagaaaattctatttg

SEQ ID NO: 478471 - DNA, 3260 bp, Homo sapiens
cacttgtcctgccagaggggccctggaaaatgcctgtgctgatctttgaagcctggagctggcttccattgctgcttctgctgctgctgctggagccacagctgcccgaggagcctgctgtcacggcattccctaataaagcactggcacacgaaacaaccaaaaaagagacaacgcccgtgaacccatggcctgtccttgtgaccatcgggaacggtggcactggcaccccctgccttgcgtcaatgctcttcatctttccgggagggcatccacctgggcagttcttggaagacaagaccctgcactgtctctggtggacttcagggtggctgggaaccacagtcagcagccccaggactgttcttattctgagggagatgctgggcctcctgagggcctggcctgaacgactgttgcagaacatgttcacctgggagctgcacactgcctaactgaatgcaacaggagtttcccagatagaaatggccaggtgggtggagctcacacggtaattgacaaccgttatatggcccctaagccttctctttttttcaggctaaacatgcccagttcctctaacaattacatatgtgacatgtctccttctttttgggaaataaatgcaaataaaaatactccaaacctatataggtggcttgattcatattcagaaagtggacacccagggatggctaaaatgggtggttttacctggagctatgacccgaatcagaacacccactccctccaaagtaaccactcttctgatttctgtgcaaatcattccattgcttttcctcatagatttctaatttatatattcatttccaaaccatatggtttgcccattttaaatctatacatgggtgacatcatcctatatgtacacttttgtgccttttttttttttttgctcaatgttatgttaatgtgatttatccatgtttttgcttactggtgtagctagttcattttttactgatccataaagttctgtacattttatatgtatatgtagatgtacttttattgacctgtgcttctttattgattattccatgatataaatgtaccataatttatgtaatgtgttctatcactgatgaacttttgagctgtttccagtttggggcccttatggacagtactgtgatgaatatttatctcagtgtacatgggcttgcatttcactaggatgcatacctaggagcagaatgctgagtaataggtcacatgcatcctcacctttaccaaactggggtccaaaatgcttgtgttacattacaatgccatcagcagagtaggcatgtttccgtggtacacccaaaggtgtgctgtgcagatttcccttccagaaagacttgctgcccaactcagctcctgcagagcctacctccactgcagagcagcctttcccagggtcttgccctgcctgggacagcctgacaatttgttccttttcattgaagtagtattccattgcatacacaaatcacagtttatccattctcttgttgatcggcttttggactgtttccagtttttggtaatgaagaacaaagcttctaagacatacatattcgaattgtcattgtcacggctgtgtggggtggaggtgggaaggcttggccactgtgtaccactgtgggatgattctgatgggcagcactggctccggagtgtggtctatctgggctcctctgcctcttcctgctcctcccctcctttcataggagctgatccctaataaacacttcctacaccaaactctgtctcagagcttgcttcctgggaactcaaactgcaacggttactggactctatccttgccagtgtttgatatcaacagactttaaaaatgtatcgctaatctggtgggtatttaagggtagctcattgtggttttttccttaattaaaaatttaaaaattaaatccttaattaaatattttaagcctttacaattattgaggtatagacgaaaaacagtaaaataatcccccttttgaagtgcacagttggatgagttttgacaactgtatgctgtcatacagtcaccaccataatcagatgcatttatatcgcccaaaaagttccttcatgcctctttgcagtcagtcccctgctcctgtcactgatctgctttctgtcactatagctttgccttttcttccggtggaaccaactagaacacactcttttgtgtcttgtttctttcacttagtggactgcttttgagatgcatccatattgctgcatggattggcagtttgttccttttcattgcagagttgtatttcattgcatacacaaatcagtttatccattctcttgttgttgggcttttggaatgattccagttttgggtaatgatgaacaaagcttctaaagcatacatttctgactgctttttgttgatcttcagtacttccaaatagttgtttaaaaaatatacatattatacatattatctgtgagagtgttagttcaatacagattactctgtcttatcatagagtggtacttagtatatctgtctatctatcttgaaatgtttttacaaattcaaataattcacttgtagattcttctagatttttaatgtgtacaattatattattggtgtataatgacagtattatttcttctttttcattcaatatcccttttatttctgtgttttgtcttactgcatggactggcatctctagtaaagggttgagaagaaatggagcactagaagtattttttaaaaatatatgaatggatattaaattatatcaagcttttttcttcatgtattgaaatgttcaaatgttgttttctctaatatcttagtatgtaagattacaacaatttatttactaacgtaatcaactttacattcttgcaataaatccaatttggtaagatttattatccttttttatatattgctgcattcattttgctagtattttgtttacgatttttgcatctatgtttatgagtgggattagaatatctatccttgttgagtttgatataaagtttttgtaagacatatttgtactggttattaggctcttgcttttattcttcaagtacatccttgtagcttctgctctgtgctgccagtgctgggagtctgcaaacaatctttctcctttattgtctggcttcttggtggtttctgcagttggcgactctagaaggagatggtagacaggagcgaagaaggtacttctgctctgttatttgcttctgtacttatccat

SEQ ID NO: 478472 - DNA, 912 bp, Homo sapiens
ctgagtgagctgggctgggggtcttgacagggtgaaagggacaggatctgctcagagccaggcctggcacttggagcccatatagaacaggggagtcacccccctggcccccgatttccaccccggtgatgcagtcggggaatcctgtgagcagaggctgcctagagaatgactcattaactctctccatccctctgagcagtaaagtggcgagagaggtctgggaatttcctctggttctggaccatctgtatctggctctgctttttgatgagggcagagcttccaagaaaggaggccagatgaccatggcaggccatgggggaggagagccaggaggccagctcaggtggtgtggatgtgccatgctggagaggaaggcccccaggccaggcgagagagccagggctttggagcaaaaaaggggattccttccttccttccttccttccttccttccttccttccttccttccttccttccttccttcctccctccctccctccctccctctctccctccctccctccctctctccctccctccctctctccctccctccctccattcattcaacaggtgatggatgcttactcaactttaaattctgttggagtctcttgtttccccccctcacccaccatttcaagcaggtccaagtcttggctgttggctgtatgataaaggtctaaagcaagacagtacacacaatgactgaaaccttgctatggcttggaaattcttggaatttaacgtaagagtaaatcataactcttgccattacagtgggaattgatggatgttgaaaacacaagataactgtaacgaattcacatttcttggaggtgtcacatgttttgaagcagtggggctctgaaaaacaaatgctgtcattctgctgaacttcagag

SEQ ID NO: 478473 - DNA, 938 bp, Homo sapiens
tttggctccttgttacttatgcaaatttctgcagctggcttgaatttctccccagaaaatgggtttttctttctgtctaatgaagcttcctcagacacctggtgaagtttctcttacaggaaccttaacttgtgaccaaatagttgaaggagtagtagatggagagttactccttttcgggaagtacggagggcaagaaaagagctcttgctttgaaaattccaggatttttagaagccctgtgccaggaaccgaggacaaagaccatacaaataattattatacaataaagggttcagtaggaacctctgaagagcccaagaaagcaccaggagagagagatccattttttaaacttctgccagtcccagaatgtgagaaagcagctgttaatgaaaatgaatcctacgtgggctgcaagggctgcaaggactgggccctgcagaacagagagaggcgaatgaatgggagggggactgcagagaggagtaagagccgtgcatccaagaatgagatgcagagtcagtctaaatctagacccactcccgagtcacagccatcccatttcacctgtgaacctcattactacagacctggtggtggccctgaggctagcaatagatcccattcactcaggccctgcttgacttcatggagcatccagatcccatctttgacaccgagagaagttaccgaacaaaaggctgctctactccctgctcaggtgcatacaaagcacaacctaagcgggaagctctggaggaagtggcagaagcggtactgccgaaaactagttgtgaaacgggagccacaatgttatgggaatcctgaaactgaggcagctctatttagtgaggaggggagagcttagagctgccaaagcaccatgaggtgactgcagataactctgaccccaaaggtggtagagcagtgggatc

SEQ ID NO: 478474 - DNA, 859 bp, Homo sapiens
tgaggggcactcttctcatgcagctcttgaccaagatttagaggggtatacatgtgccatggtggtttgctgcaccctatcaacctatcatctaggtttgaagcctcgcatgcattaggtatttatcctaatgctctcccttccctttcccccaacccccacaacaggccccggtgtgtggtattcccctccctgtgtccaaatgtcctcattgttcagctcccacttatgaagatgccctgcccagtgaagaggaatctggtgaggcagtctggctacagctgtgttgagttctacccagtccttagcactgtgaggggaaacccacctgctcaagcctcagtaatggtggacacccctgcccacaccaagctcaattgtcccaggttgacttcagactgctgtgctggcagcaagaatttcaagccagtggttcttagcttgctggactccctgggagtgggacccgctgagcgagaccacttggatccctggcttcagccccctttccaggagtgtgaacagtttttgtctcgctggggttccaggtgccactcagttggaaatgcagaaatcacctgccttctgtgttggtctcactgggagttgcagaccggagctgtttatattcggccatcttgccagatccttccatagatttttttttaaagggtacctgcccccatgtttctgctccttggtctttcatttgttatgggacctagcacaaaagttttttgtattaatcagaaatttcacaatgataaaagttacctttcctgttcaattttcaacctaataaatctaaaaaaaaaatttataatgtgttttctctttaaagtgtaaaatcagagaatat

SEQ ID NO: 478475 - DNA, 508 bp, Homo sapiens
tcattttatcagtgtccaggaatgttcaaggacccagtctgggggtcaagtctgctggggaaaacctgccactggctggattatagagtcaacaggacacagaaagaaagcgggggtcctgggggacccaacacagggttacttccttccctatttattctcatccatccaaggaaagcatttttccagtattcccaggaatattggaaattctcaggaaatattggaatattccctgagatttttcttattatccagaaaccacagccagagagtgaagtaagctgcgcaaggtcatcaacagccagtcaacagccagtcaatggccagtcaactcaacagtcagtcaacggcagacagactcaaaaagggaccaataattattttccagtaaccttgtatactcggccagtgctaaatagcagtgatagatacttcctgagaaggcgatagcaggaaagaaggggttttttagctggaagccctaaaagttgtgcaggatgtattc

SEQ ID NO: 478476 - DNA, 595 bp, Homo sapiens
agaagagttgtccctgatgcagattatgagattatggacttcaagcctgacgccttgtttagatgggaattgggagtcctagatgctggagggattgttttacatgtgggggagacattccacgggggcctgaagatggactgtgggagattaaaagaattcaagggcaaactggaggtagaaggcaacaactttactgaagcagcattgttacagctcctgcagaggaggaccaccccatcggtggagagcggcagctcagggcaaacttacacaaagcaaggaaaaataggtccacacaaaaataggaatagaattggtgctgatgcctggtttgttctagcgacaagttacattcactcttggatacatgatctaattgaaacaaccgtatcatttgtaattggactttgctttgtttgcttcataatttttaaatgctaaaaccaatgtgtaaccttcatatattaatttactaatttgcctgtaacttctgctttcctgaaatttatccctccctttaaaaacccttacctgtgattcatctgggaattctggactgaagctttagctgctagattctccttgcttggca

SEQ ID NO: 478477 - DNA, 1051 bp, Homo sapiens
aaactcagtaagctttaggtgactgagggaaaaatgaatgaggggcaagggatcccacgtgtgcggttctaactggggaaaacgtcaggctggcaggagcagggggaagcaaggagagacagcagagaaactataggtctacctttctttacggcgcaggacatatggccctcctgcgcagatagcggacataactcacaaacttcctgctcaccatcacgcacctcagttgatcagacaccccggctgaaagaagaataaatgatattccaaagtttatcttcaactatggctgaacgttcaactgtgtgtttgcacatacactttgtatacagcttcccacgtagtttcctgtgcagcctgcttcctgtacagccaggcttcccatacggcctgcagaactctacccaagacctggaaaccacacttcaagttgcctcacctttctggattaaaccaatgcacatctcacacctattaattgatgtctcatgtctccctaaaatgtatgaaaccaagctctgctctgaccaccttgggcacatgtcatcaggacctcctgaggctgtgtcatttatttcgaaagtggagaggccggagtggaatccagggctatttgattccacattccagggtcttctcatgagcctctcttcctcccagtacagtgtgcagcacagccagctggaggctctcagccctggggcatttttcaccctggttcttaagatggatgaacattctctactgtttcctgtgttcctgattacatacagaacgctataaaagccacatgttttttgctggcaacactcaccagttttaagcattttcaaaaccacagaaatgtgtaaagaacaggacaaaacaggtgcatgaatccagcgcaggagggggagatgagacagggctttgggacgtgggaaatgtctctttgttagtaagaaaatgggtagcttttaatttctccttgactctgaatgtctccaaattttctgaccagttagtgttaacaaatgggtgagtaggtgataaagtgaataaagtttcc

SEQ ID NO: 478478 - DNA, 1087 bp, Homo sapiens
aaaccatagcacatcacctcagtcacgtgaagcagtcttcctcccccaaacccacaatccttgtctaatcatgagtaaaacatcagaagaggctgaaattgatgagaatgtaatgaattctgagatgcaaatgaaaattgagactttgatacctgctccacctcatgttggtagagcagccagtatagctcagaagagtaaagactcttctaaacaagcacacagtgacagaaacagcccccaaagaataagaagttggaggaaatcaaaacgggcttgtttagcaataactgaaaactggacatcatggggccacatctttcatccccaactggatggaaactttcaaactggcttcatgatatctcactcaggaataaagctctcttcaggaagatgcagaattctctatcctgtgttccgaggcctcgtgggtgcacaggatggtcatacggtcgagaacaaggtgtgcccagagtccattcagaacacacactgcgtgggttgttgctgcctgctggcaggtgaaggaccccctgggatggccacagaagatgatctctcatctagtcgctggggtccactggtgctcatgctacagattctatctacatcccctgctcttgggcccaatgccctcatcgcccttattgattctacaggcttgagagatggctgttacgcagatgtgccctctgctattccaggcaagaatacttcggatggcttcatggtggaggaagcacgtggaaatgagtgtggatttggttgcgaaagacagaagggtacttcacacccagagaatgacatgaatgagtgtggcagacatggcattgaacagctaatatgcaaagatggcccagagttggaaagatgatgctctgtttacggaaagatttgtgtgggagataagcagtttggaattcttgtgtaggcaaccaggagccatggggatgtttgaaagataaatgtgacgataaaacctgtgtttaaacaaaataattgtcagaaatacatagaaggcctttgaatggggaaaaaagggacacaggaaaatatgtaggaagaaattactgcagtgtgaaat

SEQ ID NO: 478479 - DNA, 710 bp, Homo sapiens
ccttttcagaatcttcaggctgcttcgagcaggattaggggtggcgtgggaacctagagtgggaaggattaagctgaaggaagattttgtggatagatttccacgatgggaaggaaatgagaggttctaagaggcgggctagtggcttatattatagcatagcctgcctttgctggtgtgtggcgattaggcctggtggaactgccatcaataaaccaagtgtgttcagagtgaggaacagggaagaaggaaatacggggaaatgggatgaatgccaggtggatcagagagatacagtcatgggggtcaggtgtggtatcaggaataacatgggagcccggattgaagtctgggccaggaacaatggtaactgtgggagacttaacaaagagacagcagcagctgctgcacggagacatgatggctggcctaaaacagtaaggtcaagttgtatggacaaaaaggctacaggacacaatcccggtccttgtgtaagaattcccactgcacaacctgcactttggctgtgggtaatgaaaaaggttgggatgagtcagagagagctaggttgggggcagtttctaaatctgtcttcaaggaatggaaacagaagtggggaaaggatttagggtctatggggtcagctaggtttctttttgtgagtttaaataacggttttgttaggatggcaaaaccaggtatctaaagtc

SEQ ID NO: 478480 - DNA, 668 bp, Homo sapiens
tttctcatctacagccatttcttagagaatgatgctgtcagagattctctcctacactctctggaagctcacacctacccctctggacctggccaacagcccacagtacaacggtgctgtttctttgttcccaggcagaggatccgcaggtcgagaaataatagacacacacaagatagtgaaagctgggtccagggggatcaccgccttctcgtcctatggtgccaccaatgcactggatataccagcatttattattaagtttagtgaagtcagggttaggccttcacattcactcattgactcacctcgagcaacttccagtcctgcaagctccattcatgatcataaaggtcttgtgcctgttaaaattgcatttcttctaatccagcccggtggcttcagctccgaccatcacgttcacacaggatctcaatgttctggactcgagagattgctgcacgaaaaaacagaatatatggggttcagtattatccatggttactgacgtccagtgggtgccttggaatgtacccctgcagataagaggggatgaccgtatacaatttctatttgtcaattatacttcaataaagctgaaatgttcgtaatgtgttagctctattgaggcatataaataaaactttatgtttggaggacactctgat

SEQ ID NO: 478481 - DNA, 2177 bp, Homo sapiens
cttccgttaccctcactttggcctgtctggttcattgcctgttactgccgagccatggaggtgcgaagaggcttccatgccatcctttcccctgccagcctcctcgatgctggccacccggcctcttcacggtcattagggtcaacattccagccagtggagcaactgccttttcactcacggatcctttgccgtgaggatctaaaggtggccaggagaccctgttcacagcatgtgctttgggccattgtccatgaaagagagaaacaatgtgagtcccagagatctcatcgcaggaggaaaagatcaactccgtggctgtctttgtggtgcccagcaagaaatgatgcctgtaaatgtgactgtgcttttctggggcagtttcctgaaaaggtgcaggtggaatggtgggcagaagtcactcacattttaagccttgggaatgaggaaagtgtgacgagctggttatctactctggagttctcttgtcaatgtcagcaagaggagccaatgcagtcacaggaggactcatataaccggccgccccggctcacaggtaggctccattgtgcctgctcttcaatcggccagacggacgtggctgcttgtacacccagagagcagttcacctggagcttgttagaaattcaaatcgtcagtcccctccctggatttactgaatcaggaactcagtttgatagaccctgcagcaaatctatcccccctcctcacccttctcccggtgaggacccctgcacgccgctgccttccttgcgagcaaggtgtccatccacagcaatttcatgtgctctccactcacagccagagactgtggaaatggagctgaaaccatcagatcacgtgaaacttattcactattatgagaaaaacatgagaaaatccaacccccttgattcaattacctttcatccggtccccccacccatgacatatggaaattattacaattcaagaaaaaaatgcaataaaaattcttattacaaaaaagtgacttctggccctagctacatagtgaacctcctgactctggggaaagccgccccgtggtgtgatcctgttcacaggctggcagcagtgggccaggaaagaagagatgatgaaaaggaaggcatggaaattgcccaatgtattatgtgtcaggaaaatctacaatgaattaatgctcttagaagtctgtaatgccggtgtttaatttaaatgttaaatcagacatttatttaacgttattattttttccagtgtgttcgtgtaggtggatgtttccactttctagttctaaattaagatttacttaaaacccattcagatccatcggttgtacgggacctactcctccccagtcccactctttcaacaattttgtaatcaagctgttttgttctctattattaccttgaatttgacacagtatgagaccagaatgaaaagaaatcaattagcatcagcgaataacatttattttgcatgtttttctagtgtaattgcctttgcaggctatagttataaaagttggttttctctatatcttatgcatcaaatgctgacctataatgtaattttataacctttttctattaacagatttcaatgctaccgttcaatgcttcttttttattttttctaatctattatgccatctattagaattgcattcagggggcctgtaagtggtgagaataccagcttttatacataacattccatttgtgggtgtgtgagtgaaatgtgggcagttcaactttgaaagagaactatttcccttttaaaagtttagactccattaaacaatatggaaacaaaatgaccaatattttctaaaatgatcattgttatttttaaaacattctgtttatttctaaatttcaaaactaaaaaacatgagtgggggtaatatggactgcaggatgatagttcaacaacctgtttttacgatagactatttaattgtgcaagacatgctaattccttgcttcataacaaaagaatctcatggtaataaatttaatatgctattgaaataaaaccagatgttaaaaagcaaaacaaaatagtttttacatgtactgataagggtctgattaaagccaatgtaaataaggtattttactgttaacaaataataagatgcattttattctgacattcactctgtcaga

SEQ ID NO: 478482 - DNA, 1718 bp, Homo sapiens
gggtaccgtgcttattacctggaagggtgtcactcgcgaatggagtaatggcgagagcacacctggacaggggaggggaaggagttcttgttcctgatacagagggaattgatgcaggccaggtaagccccaaaactggggcttttcctgggagggttctcagcttcacccaggaaagaattccagggcaagctggtggtgtcaaacagcaacttgaactgaagcggctgtgcacagaagcagcagagcgatttctccttgcagagcagggctaccccataggcaatgtcccagattctgtgagtcattttattcaactaccaaaaatgaagacgtttatgaagatgtcaacatttgcagccaactggcctgaagtgaaggtgggcctggagacccctgaaattgcagctggggtcagaatcttaggtatatttggcagttcggatgactgtgaattttaagttcaagattggctaaatcctgttagggtctttgatcaaatattaaggtattaactcctagtgcattcctgatgactcaaatgatagagctgataaaagtaagcacagtaaaacttgcatttctgaaaataagtatgactgtaatttttaagcacattgagtgttacaggaaaagagaaatatctggttaatacaacccaaaatagaaagcttaagctgggacagcttttacaatcttttcttttataaaaaacaaaatcaaagcagaaaattttatactaatttcagtagtggtgaaaagctaatttaatgaaatttaatgatctttcagggttaaaacaaacattttccaaaaaatagaaaaaaaatttgttgataagctgcatcaattaaatacctaccagtaatatcaaatttctggttgaaatattgagcactctcttcccaaatcaaaaacattatattgatgtttactttccatataatgtgtggaacttctgctaaacattgaactggtcatcacagctgatgtagtaaggcaaggaaaaagtaaaaggcataaacctgagaaaaagaagaaagctgcagaagatatgatttggtagttgcaaaatccataggaacagtcaaattcccagtggaaattactatatgtaaatgtgatacaatcacaatatgaaaacattgtatgtctatactctagtgacaattagaaaatgaaattttaaaatacatcttacaatgaatcagaaataccaaataccaaatttgacaaaacttgtttacaatctatacattggaaatgaaataagtaattgctaagaattttttacaacacctaaataaatggttttgtcatgtttgtaaattgtaggactgaatattgtacagatatcaattatctacaaataattgtatgaagcttcgggaagccaaaacaaaattccaaaaaaattcataaaaagtacaaaggtgatactgtactgtatatgaaaatgcaaagacctggaacagtcaagacattcttaaagaataaatttgacagatcactaatttcaaaaattaaaataaagcaacagtaatcatgacagtgttacattagtatcaagatagacaagaagatcaatggaaggcaataggaccaatatagatcgacacatataaagtccatcgattttcaacaaatgcattcatgcagttgcaggaggaaaggaaatcatttcagcagacagtgcaagaagagctagaaattcatac

SEQ ID NO: 478483 - DNA, 1029 bp, Homo sapiens
tcctttctcaagagcccagctggcttgaagggagaatgacagtgactgcttatgagcatgggctggacaatgtcaccgaggaggctatttcagctcttgtctatgctgtggagaatcatcctaaagatatactgacatcagttgtgtcaagaaggaaagcttatcggttacgagatgaccattttaaatatgcctttggcacttttactgctccctgtgctggtcagaatccggcttctcacccacctcctgatgaagccgagcagcaggctgcattccttctggcatgctctggagacactctatctgcatctttatctgcagcgaacatgtatgaactttttgaagctctgcgggtacacagggaagtcatacctacacatactgtctatgccgttaacattgaaaggattatcatgaaagtctggcatccaaatcatgaagagctgaagacaaagttcaccaccagtgcttggcaaccaaggaggggcttttgctgtgctaaatgaggatttgaaggtgcgggactctcatcaaattcattgattactgaaaattgaattttagtgggggggtctacatttcaaggctgaagtgtatggtatatatataaccgttcatatggaaatgagacaatgagtaccttttgtgttgctcttgtgaagccactaatataaatctttggtaatgacccatatctctatatgttcttctgtgtataatggagccagggccactctaaataaggcccatagggttagggctgttattgggacccgttgcccttgtggataatgttgtttaagatttctccccacttgttcacagagctttatgtttaacataccttctttcaggacccatggattatggtttacaacagttcgcattagatcccttatatgagcctgcaaaactgaggctccacgagccttaggcagctgtttcaatacttttatatactgtttctgttgagctaatagctgttgtcccatgatgaaactttagcctaaacactcccctccaaaa

SEQ ID NO: 478484 - DNA, 716 bp, Homo sapiens
agcaactcaaccatcagtttctatccccttcccttaggctggaagagcaaatggagtcatacagccattatgacccacatctcactcctcctggccccacgtgttcctctgggccatctgcccctgtgtgtatggtagactccaattttccaggaggctccatgggctgcacacgcggtttgagcttcttcacgctattgtttctctcaggcattttaacaggaaacattctagatcaggagtccccagtgggccacagaccattaccagtttgtagcctgttaggaaccaggccacacaacaggaggtggagacccagcgtgaaggaggctgtgtctgtaaggcagggaaaaaagccttcaccaggaaccagtgctggcaccctgatgtcagacttcaagcctccaaagctggagaggatgggcatctatgaacatgggccctcaccagacaccaaatctgccaccaactggaccttggacctccagcttccaaaacgagcatagaatagcacctttaaatgtattctgggtatacagagagctatttaatgtttcgttaggatttctcaattattctagtttgtgtagacagtcactctacaaatgcatattcatataagcaaatagtgctaatgaatacttatagtcaatatcaagtattgacacagcctggtgtctaaattatctttctggtaaggtacactttatgtaccc

SEQ ID NO: 478485 - DNA, 598 bp, Homo sapiens
gccgccaaagtgggagccgaggcagaggaagcgcctagagcgagcgagggctgtgagggctgccagcacgctgtcacgtctcacttccacttatggaaaagttgctgatccccagattacataagatctgtgcagaggagggagactgggtcctgagcagtcatggggccacagtgaccacagcatcttcctcggattcatcaccagcttctccagcaccattaccaaagcaccactgcaataggccaggcagcagatgccctcctgcaggtgacatgcagatgatgcccttagtcaacggcattgatgtggagaggctgaatgcagagggagataccagcttcccggcgcgtggtcatcaggctgctgtgtgcgtgtgggagaatgtgtatgtgattgttactctaaatccacttcccacagcacagtttcagtcatttgcttatattccttatctctatgaatatccaaattctttaaaaccctccagagttttccagggtgaagtctaagccaaggactacagttgtgtgtctttgtgctgagaagccagataagaagaagcttgtacccactacagggatgctgccttcttttc

SEQ ID NO: 478486 - DNA, 473 bp, Homo sapiens
accaattataaaatcacatcatgcatctccttgaaaaggataccccctttcaaagaggccaatctgtgccaggaagggaagttgaccagagactgggagaggctcataattacctcttgcaaaacgctgcaggaatcctctcatcatgcctgaagagggaaggtgtagcgactgctcaaagcccacacacctgtgagcatcgaccatcagttagcaaggccttctcatatgatttgaaaatgagcattgctgcagaacaaccacttataaaaccatcggatctcatgagaattcactcactaacccgagaacagcatgggggaaaccacccccctgattcaattgcctccacctggtctctcccttggcacgtggggattatgggaattacaattcaagatgagattttcggtggagacacagccaaaaatatcactgcctctttctcatagtggttttcataagctctttgg

SEQ ID NO: 478487 - DNA, 524 bp, Homo sapiens
agagccgcaggctggagtgaggtggtgggactgaaagagctgtgatgagcagagaagagctgtggcccttcagggagcccagacctccaggctccctgagccagggctgtgacatgctggatggctgcagcagaagccacttgcagtatatctggtccagccacagccttgtacagagctggcaccagtgcctggcccaccacagcagccagcatgctggaccccatgctagtttgctcacactccccttaccactctgcacctggcttgtccttggcaggcatgggatccaggctggtagcacaagtgaagcacagtctactggaacaactgctgggcagaatgagcctagtgagtgtgagcaaaactcaagcagaggtgctgccatccatggaagtttctggctggcaaagcaacacatggaggattctgtgacacttgctctggatccccagtggtgactcagctgtgatatttctctgctgactagacttttggagaaggtaactgccattgctgctggt

SEQ ID NO: 478488 - DNA, 531 bp, Homo sapiens
cttgatccttgaacaacatgggtttgaactgggagggtccacttatacacagattatttgccattaatgcagttggccctcggtattggcatgttccgcatctgcaaccaaacctgaggctggaagattccacatttacaggattcaaaacttgcttatacagaggactggctgttcctttcctatcctcaagttccgaaggacctactgtgacacttgagtatgcgtgcactgtggtatgtgcaggtggtcctaaaaccaatcccccaaggatactgagagatgactatactagctttgtgatgatgcacaactctctgtgtgctggtgatatggaaggggggcagggaagtcgtgggaaaggaagggcatggtccccggtgagggctcctccccggcctgtgcccatggacttagaagccatgctgttttcattataggatattcatttttgaattaggctttgtaacaatttttacattgttattaagccctcaggccaacttatttactgtgctgactttattaaac

SEQ ID NO: 478489 - DNA, 735 bp, Homo sapiens
gaggcatttccctgtacaagctctctctttccctgcagccatccatgtaagacgtgacttgctcttccttgccttctgccatgattgttagacttccccagaaattgaccctcttatgcaatagaacaccagaacttattcctcctgtctgtaattttgtaccccctgaccaatctctccccattcccttcaccccttatcctcccccagtctcagtgtgtactcttggcatctttgtagaaaatcagttggctataagtgagtggatttattcctgtgttgtctcttttgtcccactgggcttgcagggaggagggagcagacggagacaatgtggcctgaaggctactcctgctttacagagaacgaatatttatcaggtcacctcctccaaccatcacaaaggtcacagtgactatgcccatcttcccccatcctggcccgattttgtccacctgtcaatcctcatctcccatccttctctccagtcaagccacatgtcaaccaaccataaacaacttagagattccccagatccactgcacgccctctcacctggcatgttgtccatgtccttctgtctacctggaaggctgttcctcccctctatctggcaagcgtgcacacttcctgaggactcagctccgatgtcacttctgcaggaagtgatccctgcaatcctgggctgtgatcaagaaggctttggccactgggatgactttgaggcctagaacc

SEQ ID NO: 478490 - DNA, 2449 bp, Homo sapiens
gcagacacagcttttccagtctgcaaaaggttcccaaatggccttgggggaagaaagatcaaatctaagatgctaccagtaaaatggaacatcaccggaattccgtactacaccgtgggccagctccttagagcctgcctgggccctgagcgagttctcacaagagctgatggtttttataaggggcattccctgcccagtgcccccgccccaccaccttcgctctgcgttattttcctgccatcatgtgaagaaggacatatttacttccccttctgccatgactgtaagtttcctgaggcttgcccagacatgcggaactgtgaatcaattaaacatctttcctttataaattacccagtctcgagcagttctttattgcattgtgagaatggactaatacaggtgggttgggattttcctttacttgttcggatcattgggaaatttttgattaccaaaaggctaaattatgatgtcatatgtggccttggaacagattatctgggccttgccctgtttccactaactgctgtttctctaactttgtggaaaatgctaagacagttaccaattcttcttggtccattttgaagatttgctaaacctctaaaagccttgtgagaccccttcagccactgcggagctttttaatggagaacaggaaaggatcgtaactaggccacaggggggtattttagtccgagagcaggctggttttatgaaagtccaggctcccagcagcttttgtgaatattaacgtataaaccagggcagaaagtggcgtcagcagtgccctgagcaggaaagactgtggctttatgtagcagaggcatgtccaggtcagcagcagggacctgaattccaggactctcagctctgcctggaacttgtgagatcttgggtcaagctctcaatccgtgtgggcctggttttttgttttaaattcttctaatactacctctcctgttggtgaacgagggaaatggacatgaatgtctgtgaaagaacttatcataggtaagctgttctgagtggcgctccatcagccatctttactggctgtttgtggttttccaacaaaacatcatagcttatgtggttaagcagtgtcgtgttcacagcaggaatgcaaccagcatttggtggaattgtactgctgaatatttataactgaaaacctcaaagaagagtccacctcacagatgtcacccttattgcttgcattccaactatttaagagctaacccgttttggtcacgccctgagagccgactgctgccaccacgaccccataccttcctcacaccccaccatactaccattcccctccctgcccccagttttccaggattcttagttgggggaacccttccctggctctgtggtggacttaacgtccatcccacctcaccggtccagggacttcactgtcagtagtagcacgccctcctcccctagcatgtcaaagttttagggaaatggaaagtcacacacttactatttagctcaacccccttgggtgacagtgctccaaaaagcaacatctcctacggaaagcaatatgaatactgtaacaattcacaaatcaaggctacaaaactttgcttccaaatttgcactccagctttcaactaatttagaattcaaaataaggtttgcaaaatgtctatcatttcacattttctgtagttaacgaaaaatttaactttcatgatgggtcttgtcatcacttgtactctatgtctgtcagggaccaaaggggaccccagaggatactgtccaagggtaacagaagagttagaataatccaggtcaaaggcaggcagggtagactacttaataagctttcttcacagatatttttagacctgcttttgaatatattgtatcatttatggagcagctactatgtttctagcatcaactggttatgtttacatattatgatattcaacactctcaaaaccttaggaaataatagtaactactatttatcactcaccgactatgtgtcatgaattcagcgttcattactgccaatcctcacaaagcccctgtcttcctcagggccagaaacccaagtcagagttgactatttgccactggtcctcagagtaaacatgatcaatattccaactttacacatgagtaaactgaggtctggagagatttggcgacttgtctcccagtttgacctggaaggaaaacttaccgaggtcatggccgttggtagagtaggaagtgaacaggctgggctcctctggggtcaatgcacaacttccttgtgttcttggacaagtttctaagtgtccaagtttctgcagcagatggcaggaagtgcaaggggtcgaggaactccctcccgtagccaagggaagccatgagggattgtgccatgagggacggtgctatctggcccagatactacggttttcccatggtcttc

SEQ ID NO: 478491 - DNA, 782 bp, Homo sapiens
aatgggccttataggtgtgaaattttgcccataatgacctcaaggcaaaacacagcagaatccaccagcaattctttctctcctttccccagaagagatatgaggactcaggctttgagatgcactggggtcagaggagtgcagacagacagcgcttactcagagggggacgggatgaggaacaatactcctaaaagaaggtggctgcatttccaccgagaagcggacaagttccaggcagacaccacaatgaacatccaccaagagaaacccgatttaacacaacagtggatgccatggcactgtgataattacagttgcttctgcaagctatttatatgccttcctccctggttacatttctggaatcttggaaacagagacaatgcctttgttatggtcctttctcctatgctagcagagtctggggcacacgaggctgtgaatagtgcctgaataaatgaatgaacaaagaaaaccctccagggctcctttaccaagtaccagctcatagaaacagctaaagaaaaatctattaaagtcatttatttacaatcatagaaattttagagctagaggaaaattcaaggtaatctggtcccaaactgttagttcacaggagaggaagctagatctacaattacacaattataccatcactgtggtgtgcaaactgtccccaagactgtcatcttaataatgcatgtcatttgctgttggaaaaaaaaaatacattgaatatttaggtgaggccccaagctacacataccatgatcacattc

SEQ ID NO: 478492 - DNA, 1172 bp, Homo sapiens
aggaaccaggatccctaagtcaaacacaaaaagacaaatatggaaataaaactcatacctctcttccagtccagatatctaagtctgctgttgctccctgaagctccccagccaacagggcaactggaggaaaatgggaacaggaagaacaagtccagtggattccagaatttcattccagaagatgggggacttctctgctcagctgatgaagttccaggagcttttaatgaattaaaacggcatttgtctgaagaagccagtgaagttaccgactggtttgaaaataattatgtgcacagtaggataagaagacacttacacaacagtgacagacacacacagatgaaagaccctgtggagacacggagaagatggccatttataagccaagaaaataaagaggcttcagaagaaaccagccctgttgacaccttgatcttgggcttcttgtctccagaattttgtgaggatggaagtgacaacttccaagctgttcatatgtcagaccaaaaactgaagttgcatcagtgtgtccattatagtacttttaaggcaccagagagagtaaatcgattggaacacagtgatataagctgcttttaacactaaatgtgcacagtaactataccttatttgatttttagacttttctttaaagtgcatactttatatccacaagaaaaaaattaaaatattatcggtttcatacttcaaagatggctggggatagataaaccctatccaagtttgaatctaggcttctcctcaaactgcctttgggtcgatgagtacattgtagtatgcttgacacaaaatcagtatctgtcatacactcttaggcaaatgataattttctactgaaaactatttccttagtgatagtaaatctccaactactgttgacagatccaatttttgcaaagtgccaaaaagcctaaaacatgtagggaagaataattcagcttcacaggtattattgagcagcttgcttgtttgctctcagatttgcccctctcccattctttttcttgcaaacaggttctctatgtttgactttatgagtcaagttcagccaaagggaagtctgttaggagataggagaataggaagtgtgtaattgacattgttagtgcctcactcagattcctagggtcccttttcagttcagc

SEQ ID NO: 478493 - DNA, 8740 bp, Homo sapiens
tcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaatgtattggagtcgagtagaacagaattgaatggaatggcatcaaatggaatggaaacgaaaggaatggaattgaatggactcaaattggaatgtaatggaatggaatggaatggaattgaaatgaatggaatggaatcgaatggaatggactggaatggaatggattcgaatggaatcgaatggaacaatatggaatggtaccgaatggaatggaatactaatggaatagaatcaaatggaatggcatcgaatggaatggactcgaatggaatgtgctcgaatggaatggaatcgaatggattgatatcaaatggaatggaatggaagggaatggaatggaatggaattgaaccaaatgtaatggacttcaatggaatggaaacatatagaatggactcaaaagcaatgaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaatgtattggagtcgagtagaacagaattgaatggaatggcatcaaatggaatggaaacgaaaggaatggaattgaatggactcaaattggaatggaatggaatggaatggaatggaattgaaatgaatggaatggaatcgaatggaatggactggaatggaatggattcgaatggaatcgaatggaacaatatggaatggtaccgaatggaatggaatgtaatggaacggaatggaatggaacagaatggaatggaactgaatggaatggaatggaatggaatggaaatggaatgcaatgaaatggaacgaagtggaatcgagtggaatggaatcgaatggagtgaaatggaatggaatggacgcgaaagaatggactggaacaaaatgaaatcgaacgtggaatggaatggaatggaatggaatggaattgaaatgaatggaatggaatcgaatggaatggactggaatggaatggattcgaatggaatcgaatggaacaatatggaatggtaccgaatggaatggaatgtaatggaacggaatggaatggaacagaatggaatggaactgaatggaatggaatggaatggagtggactcaaatggaatgaaaccgagtggaatggaatcaaatggaatggaattgaatggaaatgaaatggaatggaatgcagtggacacaaatggaatggactggaatggaatggacacgaatggaatggactggagtggaatggacacgaatggaatggaatggaatggaatggaatggaatggaatggaatggaatgaaatggaatggaaaggaatagaatggaatggaatcaaatcaaatgaaatggcatcgaatggaatggactcgaatggaatgtgctcgaatggaatggaatcgaatggattgatatcaactggaatggaatggaagggaatggaatggaatggaattgaaccgaatggaatggaatttaaccaaataatggaatgcaatgaaatggaacgaagtggaatcgagtggaatggaatcgaatggagtgaaatggaatggaatggacgcgaaagaatggactggaacaaaatgaaatcgaatgtggaatgtaatggaatggaatggaatggaattgaaatgaatggaatggaatcgaacggaatggactggaatggaatggattcgaatggaatcgaatggaacaatatggaatggtaccgaatggaatggaatgtaatggaacggaatggaatggaacagaatggaatggaactgaatggaatggaatggaatggagtggactcaaatggaatgaaaccgagtggaatggaatcaaatggaatggaattgaatggaaatgaaaaatcaaatggaatggcatcgaatggaatggactcgaatggaatgtgctcgaatggaatggaattgaatggattgatatcaactggaatggaatggaagggaatggaatggaatggaattgaaccgaatggaatggaattgaaccaaataatggaatggaaggcaatagagttgaatagaatggaatgcaatgaaatggaacgaagtggaatcgagtggaatggaatcaaatggagtgaaatggaatggaatggacgcgaaagaatggactggaacaaaatgaaatcgaacgaatggaatggactggaatggaatggattcgaatggaatcgaatggaacaatatggaatggtaccgaatggaatggaatgtaatggaacggaatggaatggaacagaatggaatggaactgaatggaatggaatggaatggaatggagtggactcaaatggaatgaaaccgagtggaatggaatcaaatggaatggaattgaatggaaatgaaaaatcaaatggaatggcatcgaatggaatggactcgaatggaatgtgctcgaatggaatggaatcgaatggattgatatcaaatggaatggaatggaagggaatggaatggaatggaattgaaccaaatgtaatggacttgaatggaatggaatcatatagaatggactcaaaagcaatgaatggaatggatcgttatggaaagacatcgaatggaatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaatgtattggagtcgagtagaacagaattgaatggaatggcatcaaatggaatggaaacgaaaggaatggaattgaatggactcaaattggaatgtaatggaatggaatggaatggaattgaaatgaatggaatggaatcgaatggaatggactggaatggaatggattcgaatggaatcgaatggaacaatatggaatggtaccgaatggaatggaataatcaaatggaatggcatcgaatggaatggactcaaatggaatgtgctcgaatggaatggatcgaatggattgatatcaaatggaatggaatggaagggaatggaatggaatggaatggaattgaaccaaatgtaatggacttgaatggaatggaatcatatagaatggactcaaaagcaatgaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaattatggaatggaatcgaatggaatggaatcgaagggattggaacgaaatcgaatggaacggaatagaatagactcgaatgtaatggattgctatgtaattgattcgaatggaatgcaatcgaatggaatgcactccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggagtggactcaaatggaatgaaaccgagtggagtggaatcaaatggaatggaattgaatggaaatgaaagtaatagaatggaatggagtaatggaatggatcgttatggaaagacatcgaatggaatggaattgattcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaagggaaatgaaagtaatagaacggaatggagtaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaatgtattggaaatagactcgaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggaatggagtggactcaaatggaatgaaaccgagtggatggaatggaatgcagtggacacaaatggaatggactggaatggaatggacacgaatggaatggactggagtggaatggacacgaatggaatggaagcgaatggaatggaatggaatgaaatgaagtggaatgaatcaaatggaatggaatcgaatggaatggactcgaatggaatgtgctcgaatggaatggaatcgaatggattgatatcaactggaatggaatggaagggaatggaatggaatggaattgaaccaaatgtaatggacttgaatggaatggaatcatatagaatggactcaaaagcaatgaatggaatggatcgttatggaaagacatcgaatgggatggaattgactcgaatggaatggactggaatggaacggactcgaatggaatggactggaatggaatggattgaacggaatggactggagaggaatgcactcgaatggaaaggaaacgagtggaatggaatggagtggaatggcttgaaatggataagaaatgaaaagaatgtaatggaatcggatggaatggaattgaatgtattggaaatagactcgaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaatggaaaggaatggaatggaatcgaatggaatggactggaatggaatggattcgaatggaatcgaatggaacaatatggaatggtaccgaatggaatggaatgcaatggaacggaatggaatggaacagaatagaatggaactgaatggaatggaatggaatggaatggaaatggaatgcaatgaaatggaacgaagtggaatcgagtggaatggaatcgaatggagtgaaatggaatggaatggacgcgaaaggaatggactggaacaaaatgaaatcgaacgaatagactcgaatgtaatggattgctatgtaattgattcgaatggaatggaatcgaatggaatgcagtccaatggaatggaatgcaatgcaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaacagaatggaatggaatggaatggaatggaaatcaaatggaatggcatcgaatggaatggactcgaatggaatgtgctcgaatggaatggaatcgaatggattgatatcaactggaatggaatggaagggaatggaatggaatggaatggaattgaaccaaatgtaatggacttgaatggaatggaatcatatagaatggactcaaaagcaatgaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaattatggaatggaatcgaatggaatggaatcgaatggattggaacgaaatcgaatggaacggaatagaatagactcgaatgtaatggattgctatgtaattgattcgaatggaatggaattgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggaatggaaatcaaatggaatggcatcgaatggaatggactcgaatggaatgtgctcgaatggaatggaatcgaatggattgatatcaaatggaatggaatggaagggaatggaatggaatggaattgaaccaaatgtaatggacttgaatggaatggaatcatatagaatggactcaaaagcaatgaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaaagtaatggaatcggatggaatggaattgaatgtattggagtcgagtagaacagaattgaatggaatggcatcaaatggaatggaaacgaaaggaatggaattgaatggactcaaatggaatggagaggaatcaagtggaatggaatggaatggaattgaaatgaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggagtggactcaaatggaatgaaaccgagtggaatggaatcaaaaggaatggaattgaatggaaatgaaaaatcaaatggaatggcatcgaatggaatggactcaaatggaatgtgctcgaatggaatggaatcgaatggattgatatcaactggaatggaatggaagggaatggaatggaatggaattgaaccaaatgtaatggacttgaatggaatggaatcatatggaatggattcaaaagcaatgaatggaatggatcgttatggaaagacatcgaatggaatggaattgactcgaatggaatggactggaatggaacggactcgaatggaatggactggaatggaatggattgaacggaatggactggagaggaatggactcgaatggaaatatggaatggaatcgaatggaatggaatcgaatggattggaacgaaatcgaatggaacggaatagaatagactcgaatgtaatggattgctatgtaattgattcaaatggaatggaatcgaatggaatgcagtccaatggaatggaatgcaatgcaatggaatggaatcgaatggaatgcagtggaagggaatggagtggaatcaagtggaatggaatggaatggaatggaatggaaaggaatggaatggaatcgaatggaatggactggaatggaatggattcgaatggaatcgaatggaacaatatggaatggaaccgaatggaatggaatgcaatggaacggaatggaatggaacagaatggaatggaacagaatggaatggaatggaatggaatggagtggactcaaatggaatgaaacc

SEQ ID NO: 478494 - DNA, 3822 bp, Homo sapiens
gaaaggaaaggaaacgatatggaatggaatcgaatggaatggaatcgaatggattggaacgaaatcgaatggaacggaatagaatagactcaaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatgaaatggaactgaatggaatggaatggaatggaatggaaatcaaatggaatggcatcgaatggaatggactcaaatggaatgtgctcgaatggaatggaatcgaatggattgatatcaactggaatggaatggaagggaatggaatggaatggaatggagtggactcaaatggaatgaaaccgagtggaatggaatcaaatggaatggaattgaatggaaatgaaaaatcaaatggaatggcatcgaatggaatggactcgaatggaatgtgctcgaatggaatggaatcgaatggaatgatatcaactggaatggaatggaagggaatggaatggaatggaattgaaccaaatgtaatggacttgaatggaatggaatcatatagaatggactcaaaagcaatgaatggaatggatcgttatggaaagacatcgaatggaatggaattgactcgaatggaatggactggaatggaatggactcgaatggaatggactggaatggaatggattgaacggaatggactggagaggaatggactcgaatggaaaggaaacgagtggaaaggaatggagtggaatggtttgaaatggataagaaatgaaaagaatgtaatggaatcggatggaatggaattgaatgtattggagaatggaatcgaatggaatggattcgaatggaatcgaatggaacaatatggaatggtaccgaatggaatggaatgcaatggaacggaatggaatggaacagaatggaatggaactgaatggaatggaatggaatggaatggagtggactcaaatggaatgaaaccgagtggaatggaatcaaatggaatggaattgaatggaaatgaaaaatcaaatggaatggcatcgaatggaatggactcgaatggaatgtgctcgaatggaatggaatcgaatggattgatatcaactggaatggaatcgaagggaatggaatggaatggaattgaaccaaatgtaatggacttgaatggaatggaatcatatagaatggactcaaaagcaatgaatggaatggatcgttatgtaaagacatcgaatggaatggaattgactcgaatggaatggactggaatggaacggactcgaatggaatggactggaatggaatggattgaacggaatggactggagaggaatggactcgaatggaaatatggaatggaatcgaatggaatggaatcgaatggattggaacgaaatcgaatggaacggaatagaatagactcgaatgtaatggactgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggaaatagactcgaatgtaatggactgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaaaaatatggaatggtaccgaatggaatggaatgcaatggaacggaatgaaatggaacagaatggaatggaactgaatggaatggaatggaatggaatggaaacggaaagaaatggaacggaatggaatgcactcgaatggaaaggagtccaatggaagggaatcgaatggaatgaaatagaatggaatggaatcgaaagaaatagaatggaatggatcgttatggaaagacatcgaatggaatggaatggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaattatggaatggaatcgaatggaatggaatcgaatggattggaacgaaatcgaatggaacggaatagaatagactcgaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaatggaaaggaatggaatggaatcggatggaatggaatggactggaatggaatggattcgaatggaatcgaatggaacaatatggaatgaatcaaatggaatggcatcgaatggaatggactcgaatggaatgtgctcgaatggaatggaatcgaatggattgatatcaactggaatggaagaatggaatgcaatgaaatggaacgaagtggaatcgagtggaatggaatcgaatggagtgaaatggaatggaatggacgcgaaaggaatggactggaacaaaatgaaatcgaacggtaggaatcgtacagaacggaaagaaatggaacggaatggaatgcactcgaatggaaaggaaatagactcgaatgtaatggattgctatgtaattgattcgaatggaatggaatcgaatggaatgcagtccaatggaatggaatgcaatgcaatggaatgcagtggaagggaatggagtggaatcaagtggaatggaatggaatggaatggaatggaatggaaaggaatggaatggaatcgaatggaatggactggaatggaatggattcgaatggaatcgaatggaacaatatggaatgaatggaatgcaatgaaatggaacgaagtggaatcgagtggaatggaatcgaatggagtgaaatggaatggaatggacgcgaaaggaatggactggaacaaaatgaaatcgaacggtaggaatcgtacagaacggaaagaaatggaacggaatggaatgcactcgaatggaaaggagtccaatggaagggaatcgaatggaatgaaatcgaatggaatggaatcgaaaggaatagaatggaatggatggttatggaaagacatcgaatggaatggaattgactcgaatggaatggactggaatggaacggactcgaatggaatggactggaatggaatggattgaacggaatggactggagaggaatggactc

SEQ ID NO: 478495 - DNA, 4082 bp, Homo sapiens
gtacagaacggaaagaaatggaacggaatggaatgcactcgaatggaaaggaaatggaatggatcgttatggaaagacatcgaatggaatggaatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaatgtattggagtcgagtagaacagaattgaatggaatggcatcaaatggaatggaaacgaaaggaatggaattgaatggactcaaattggaatggaatggaatggaatggaatggaattgaaatgaatggaatggaatggaatggaatggaatggaatggaatggattcgaatggaatggaatggaacaatatggaatggtaccgaatggaatggaatgtaatggaacggaatggaatggaacagaatggaatggaactgaatggaatggaatggaatggagtggactcaaatggaatgaaaccgagtggaatggaatcaaatggaatggaattgaatggaaatgaaagtaacagaatggaatggagtactaatggaatagaatcaaatggaatggcatcgaatggaatggactcgaatggaatgtgctcgaatggaatggaatcgaatggattgatatcaaatggaatggaatggaagggaatggaatggaatggaattgaaccaaataatggaatggatggttatggaaagacatcgaatggaatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaattatggaatggaatcgaatggaatggaatcgaatggattggaacgaaatcgaatggaacggaatagaatagactcgaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggactggaatggaatggattcgaatggaatcgaatggaacaatatggaatggtaccgaatggaatggaatgcaatggaacggaatggaatggaacagaatggaatggaactgaatggaatggaatggaatggaatggaatggaaatggaatgcaatgaaatggaacgaagtggaatcgagtggaatggaatcgaatggagtgaaatggaatggaatggacgcgaaaggaatggactggaacaaaatgaaatcgaacgaatagactcaaatgtaatggattgctatgtaattgattcgaatggaatggaatcgaatggaatgcagtccaatggaatggaatgcaatgcaatggaatggaatcgaatagaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggaaatcaaatggaatggcatcgaatggaatggactcgaatggaatggactcaaattgaatgtgctcgaatggaatggaatcgaatggattgatatcaactggaatggaatggaagggaatggaatggaatggaatggagtggactcaaatggaatgaaaccgagtggaatggaatcaaatggaatggaattgaatggaaatgaaaaatcaaatggaatggcatcgaatggaatggactcgaatggaatgtgctcgaatggaatggaatcgaatggattgatatcaactggaatggaatcgaagggaatggaatggaatggaattgaaccaaatgtaatggacttgaatggaatggaatcatatagaatggactcaaaagcaatgaatggaatggatcgttatggaaagacatcgaatggaatggaattgactcgaatggaatggactggaatggaacggactcgaatggaatgtactggaatggaatggattgaacggaatggactggagaggaatggactcgaatggaaaggaaacgagtggaaaggaatggagtggaatggcttgaaatggataagaaatgaaaagaattatggaatggaatcgaatggaatggaatcgaatggattggaacgaaatcgaatggaacggaatagaatagactcaaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggaatatagaatggaatccaatggaatgcaactgtatggaatggaattgaatggaatggaatcaaatggaatggaccagaatgcagtggactggaataaaatggactcaatagtaatggattgcaatgtaattgattcgatttcgaatggaatcgcatggaataatggaatggatcgttatggaaagacatcgaatgggatggaattgactcgaatggattggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatggaatggagggaatggaatggaatggaattgaaaggaatggaacggaatcgaatggaatggattcgaatggaatcgaatggaacaatatggaatggtaccgaatggaatggaatgcaatggaacggaatggaatggaacagaatggaatggaactgaatggaatggaatggaatggaatggaatggagtggactcaaatggaatgaaaccgatggaatggaatcaaatggaatggaattgaatggaaatgaaagtaatagaatggaatggagtactaatggaatagaatcaaatggaatggcatcgaatggaatggactcaaatggaatgtgctcgaatggaatggaatcgaatggattgatatcaactggaatggaatggaatggaatggaatggaatggaaaatggaatggaattgaaccaaattatggaatggaatcgaatggaatggaatcgaatggattggaacgaaatcgaatggaacggaatagaatagactcgaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggagtggactcaaatggaatgaaaccgagtggaatggaatcaaatggaatggaattc

SEQ ID NO: 478496 - DNA, 3247 bp, Homo sapiens
gaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgaatggaatggaatcgaatggaatggactggaatggaatggattcgaatggaatcgaatggaacaatatggaatggtaccgaatggaatagaatgcaatggaacggaatggaatggaacagaatggaatggaactgaatggaatggaatgaaatggaatggagtggactcaaatggaatgaaaccgagtggaatggaatcaaatggaatggaattgaatggaaatgaaaaatcaaatggaatggcatcgaatggaatggactcgaatggaatgtgctcgaatggaatggaatcgaatggattgatatcaactggaatggaatggaagggaatggaatggaatggaattgaaccaaatgtaatggacttgaatggaatggaaacatatagaatggactcaaaagcaatgaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaattatggaatggaatcgaatggaatggaatcgaatggattggaacgaaatcgaatggaacggaatagaatagactcgaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaatggaaaggaatggaatggaatcgaatggaatggactggaatggaatggattcgaatggaatcgaatggaacaatatggaatggtaccgaatggaatggaatgcaatggaacggaatggaatggaacagaatagaatggaactgaatggaatggaatggaatggaatggaatggaatggagtggactcaaatggaatgaaaccgagtggaatggaaccaaatggaatggaattgaatggaaatgaaaaatcaaatggaatggcatcgaatggaatggactcgaatggaatgtgctcgaatggaatggaatcgaatggattgatatcaactggaatggaatggaagggaatggaatggaatggaattgaaccaaataatggaatggatcgttatggaaagacatcgaatggaatggaattgactcgaatggaatggactggaatggaacggactcgaatggaatggactggaatggaatggattgaacggaatggactggagaggaatgcactcgaaaggaaaggaaacgagtggaatggaatggagtggaatggcttgaaatggataagaaatgaaaagaatgtaatggaatcggatgcaatggaattgaattatggaatggaatcgaatggaatggaatcgaatggattggaacgaaatcgaatggaacggaatagaatagactcaaatgtaatggattgctatgtaattgattcgaatggaatggaatcgaatggaatgcagtccaatggaatggaacgcaatgcaatggaatggaatcgaatggaatgcagtggaagggaatggagtggaatcaagtggaatggaatggaatggaatggaattgaaaggaatggaatggaatcgaatggaatggactggaatggaatggattcgaatggaatcgaatggaacaatatggaatggtaccgaatggaatggaatgcaatggaacggaatggaatggaacagaatggaatggaactgaatggaatggaatggaatggaatggaaatggaatgcaatgaaatggaacgaagtggaatcgagtggaatggaatcgaatggagtgaaatggaatggaatggacgcgaaaggaatggactggaacaaaatgaaatcgaacgaatagactcaaatgtaatggattgctatgtaattgattcgaatggaatggaatcgaatggaatgcagtccaatggaatggaatgcaatgcaatggaatggaatcgaatggaatgcagtggaagggaatggagtggaatcaagtggaatggaatggaatggaatggaattgaaaggaatggactggaatggaatggattcgaatggaatcgaatggaacaatatggaatggtaccgaatggaatggaatgcaatggaacggaatggaatggaacagaatggaatggaactgaatggaatggaatggaatggaatggagtggactcaaatggaatgaaaccgagtggaatggaatcaaatggaatggaattgaatggaaatgaaaaatggaatgcaatgaaatggaacgaagtggaatcgagtggaatggaatcaatggatgaaatggaatggaatggacgcgaaagaatggactggaacaaaatgaaatcgaacggtagaatcgtacagaacggaaagaatggaacggaatggaatgcactcgaatggaaaggaaatggaatggatcgttatggaaagacatcgaatgggatggaattgactcgaatggaatggactggaatggaacggactcgaatggaatggactggaatggaatggattgaacggaatggactggagaggaatggactcgaatggaaaggaaacgagtggaatggaatggagtggaatggcttgaaatggataagaaatgaaaagaatgtaatggaatcggatggaatggaattgaatgtattggagtcgagtagaacagaattgaatggaatggcatcaaatggaatggaaacgaaaggaatggaattgaatggactcaaatgttatggaatctaagggaatggactcaaatagaatggactcaaaagaaatggtcttgaatggaacttattcgaatataatgtaatcgaatggaatgcaatagtatggaatggaatcgaatggaatggaatcgaatggactggaatgaaatcgaatggaacggaatagaatagactcgaatgtaatggattgctatgtaattgattcgaatggaatggaatc

SEQ ID NO: 478497 - DNA, 1216 bp, Homo sapiens
aggggctttccatgagagacacagatgacccagcacccactgaggcctcgctgcttctaccctttgcctatctgaacctcccccttagtttctgcctgccagcacagaccgacctgtggcccttccgccacccgtgtgggccctccaccagagacacaggcaccatcggctggatcccaaaagacctgcctgcagcccccatgctgtgtgtgggtgccttccccaagagtcacaagcaccctgggctggagcccgtggctctagccctgacactgggggtgccttgtgggcttctgggaagggagacgcctccctgggactatccagcacccactcagtcctcactgcttctcctttctgcctgcctcaatattcccctgagtttctgcctgcacgtgctggccctcctgcatccccactgcctgcccatggagccatcctagggacacacaggcaaccggggccagagcctggggctccagccaccacctggggggcaccctgggggcttctgggaagggagaggcctccctggaggacacagcactcaaggccttgctgcctctcccctctgcctgcgtcaacatccccatgagtttctcccacctgcacaacccacctgcagcttcacccttgcccatggaggacctcagagagatacagacatacttggccagagcccatggctttagccccgatctgggatgcaccctggtgcttctgggaagaaagaagcctccctgggacaatccagtacccattcaggctaagccacttctcttctctgcctgcctcaacgttcccctgaatttctgcccacccatacaggcccgtctgctttcccatagccacccccgggggccatccatgagaaatacagccaccctgggccttactccattgttctactccaacccgggggatgccccaggggcttctcgaaagggagagaccaccatgggaagacctagcaccttctcaggcctcactgcttctcccctctgcatacctcagcatcctctagagtttctgtctgcccacagaggcctgcctgaggccctgctgccacccgtggaggccctccatgacagacacagtcaccctcggttggagcccatggcactacctagacccggtgggcactctggggcttctgggaagggagaggcctcccactgtgtaaataaaagaaaggtttaactctgaactgaaggca

SEQ ID NO: 478498 - DNA, 1096 bp, Homo sapiens
ccaggaccagcatgggcttgcaactgggctgggattggcgtccgtggccacccacaccatgcccaataggtcgccatgggtctcggcttgggctttgggagttgcggcactctggtcgaccagccaggatggagccagacagccgtcgacaaccgtcgcgaacatcagcaaagcagatccggatggcgtggcagcctgtgaccgcaatacccaaaccgtgagtcgaagtcttctcgaggccgaaaacgcagcccctccacgccaacttcacagaaaccgttccccaaaagtgtctctgcatagactgcgacagaatcaaaagacaaccaatggcgtgtgggtgtttgaagatgcatctcagaaggagaaagaagaaacaggacttggtcgtggatcacctacatttcttggattctatgtgggtttgtcgcagatgcttaatgtgacaaattacacagcttctatcacttcatttgatcagcctcctgttgacttttagccaagtcctgcagggctgcttctcagattttatctttctgcaagacaaagatgttttcacagtctctctctaacttcccccttttgtggctattaatttatacttatatgtttttcaactccttatttttgttttctctttatgaaagctttaacctgtgtgaattttgtaaatatataaatatatcatattatattataaatatatatttatatagatatataaatatatcatgttacattataaatatatatttatatttatataaataaaacaaaatatataaagaaaatataaacagatataaatgtaaaaataaatataaactatatacaaaatataaaatatattttataaaaatataaaaatatgtaaaaataaatataaaaattttaaataaatataaataaaataagttatataaatatttatataaatattagaaatataatattatgaatatatattttttaaataaatgaataggattcatcacctaacttctaaagctacttctctagatgaaattccaggtactttggagtcagcaatggtatattgagtgcatggctcttgctcacaggtgtttctttcctg

SEQ ID NO: 478499 - DNA, 498 bp, Homo sapiens
ttcttgaatttgttttgctagttgtttgactttggtgttttccagtattcacatcctgcagtgaactgacatcatgcatggaaaaatcaccccttcctatccaaccagtgctagagagaagaatgaaggcaagaatggggaaagaagatttaccaatgcgatgaaatcaggaacagcaacccagtggagctattgggctccaggctggctggggagtgtctgcaaagagtcctatgatgtgatctgtgttcaggtctctcagctgtggatcctagcatctgctctggtggaggcgtatctgagctcagacactccttgggtgaggcttgctgtggctgctgtgggggatggaaatgtggtccccaggccaatggagttatgttcccagggggttatggctgtacctgaggcatcactcaggtcaccagtgaagtggaggagagccggtagccacaggcctcacccagctcccacgcagctcacaccctgaaaggatgg

SEQ ID NO: 478500 - DNA, 956 bp, Homo sapiens
gagacagtgggaaaaaagtaattatgagacaacttctacaagaaccggctgataccctgaaaaaaaacctgtcagagccttccctagaggctacaccacattgtcacattaatttagaagagacacaagattcaaagaaggaattagctactgcattatcaagctgtattatttcattcatgcagtttgatgatctcacagcagaattggaagctgtatctttacaatgtgtctatttggctgaaaacaatcaagttactcaacaggagttatctatgaaaaaagtacaacaggaatgtgaaaaacttgaggaaaataaaaagatgttggaagaaggaatagtaaatcttatgacacatatggaaaaatatggtagaacttgcctgaaggggtgtgtggaagacagaaagaaaaaaccccatctccagtgccttggtcacaatgttaggggctaattgtcttcagagatgctttagttctttttgatcaccaaccaagccatctacttctctactatgagttgttgctcagaattattcatcattgccaaatgcttaattgttcctagataatgggtgaaatgtacaagggtgaaacctgaaactggtttactaagcacaagtatttctagcggtttttttttttggttcattttagatttcttaaatgtatattatttaaggagtacaacaagccgttttgatataactatttatagtgaattggttcttatagtcaaacaacttaacatattcattttgtcacatagttaccctttaaatacaagtatttctaatagaatcttccaaatcttacaagtagagtcattttagaaagcagcaagtgttacctgttcagccccacattactgatagccatttctcttccctctctactttgtttgaattgcttattcagtagaaatcaccctagaaacacatgtacttcttttgaac

SEQ ID NO: 478501 - DNA, 853 bp, Homo sapiens
agccagttcctgctacatctgtagttaagttaatctggaaaagctgtggagctgtgaggagttcagttagttgagagcctccagatgcatcacttggagatttgcccattcattccaagatctctgtccaggacagcctacagccagtgtgagatcacacctgggacaggaaggcctgatcatttctgcccaatttgggactcctctaatgagtgtttgccagttgggttggctgacactgtccaacccgcatcccatctgaagctctgctgttcaattctgtttcatccttcctcttctttcatagatagtggttacagcaggccttgggtgagactcagtactctgctggcttcagatctgacccaacagagtcccagtggtagtggccacaggagtgcttatgtcaccccacccccaattccagtcagcatagaacagagagataggctctgtttgggagaaagtaagggaagagaacaagagtcttggcctggtaattcagagaattcttccaaatcttatttaagaccatcaaggcagtatgtctacaagtttgcaagaaccacagtgttcctggccttgggtgccctctaatgcagatacagcttagattaaaatacccaagtcctttcaaatacctggaaagccttctcaagaaggattaagtacgagcaagcccaaactgccaagactacaatgaatacctaactcgtcaatgccaagacacaggtgaacattcacaagcatcaagaccatccaggaaaacatgaccttaccaagtgaactaaataaggcacattggaccaattctggaggagagacatgtgacatttcagacagaattcaaata

SEQ ID NO: 478502 - DNA, 525 bp, Homo sapiens
caacagcacatggaaaatataatgcaccatgatcaagtggaattcatcccagggatgcaaggatggataaatatacacaactcaataaatgtcatacatcacatcaacagaataaaggacaaaaaacataggattatttcaatagatgcagaaaagctgcatttgataaaatgcaacatttattcacagcaaaagacagtcaacaaattagaaaaacctaaagatcaccaaaacactgttagaagtgataaacaaattcacaatgatatcatacctgaattttgtattcaattttggactgatgactatacaagagaattagcaaatttgtgtttgtcatttttggagtggattgatgagtcatcaaagaactatcatttgaagaaagatgatgaaattgatgatgctgacatcatagctcacttctcttaacatgctgtgcacatgaaaattgccacgattgatcatttttatttactgtacttaagttataggttctctaaagacatctatctcaggtatgtt

SEQ ID NO: 478503 - DNA, 641 bp, Homo sapiens
gcgctttaagagctgtaacactcagcgcgaggaaaaatatcactaaccatgcctggcttcattaacacattggtgtttacaggaagtgaggtatgtccagcactggaatggaagcacaatgcctggtgtaaacagtcaagggaagattaccagctctgtgagtttgcagccaatgtctggatggaactggggttgctatcacacagtggggttgacgtcaataaggaaagccagaacctctgcttctgttcgacactgccttcacccaggatgtcctttaccattaatgtcttctgctgtattttaaatctcatgaaaagttttattgtgtctcacctttacccaacacaacacaaagcagggatatgtggaaaatatcggaaaatcaccagaaacacaattgctttggttattcaggctctttttgactctatatgaattttgtcatagttttttcctaaatctgtgaaaaatgacattgggctgtgacagaaatagtgttgaatttgaagattgctttgggcagcatggccattttaatgatagtgattcttccaatctatgagcatggaatatatttttatttatttgtgtgacctatgatttctttcagcagtgttttgtagttttccttgtggaga

SEQ ID NO: 478504 - DNA, 621 bp, Homo sapiens
attgctaggattttaggagtccatggttggcatctggacagttgagaatacctcacttacctccccactatccatctgcactagggactactcttcttttagcttttattctaggtctagaggcacatgtacctttgttacacagtcaataaaagaaacatcttttgcagatactactactgctaccaaaacaccaggggttttctctgggtccttctactcactccatagaaagccaatcactgagacaatgagtattaccaaggaagaaggctctaattggaagaggcaaaggaggagaaaaggcgcatcttacgtggcatcaggcaagatagcctgtgcagggaaattcccctctataaaaccatcaggtcttgtgaaacctattcactatcataagaacagcacaggaaagacccagtgccatgattcaattacctccttccagattcctcccacaatacatggaaattatggaagctacaactcaagatgagatttgggtggagacacagtcaaataatatcattccgccaccagcccctccaaaatctcatgtcctcacatttcaaaaccaatcatgccttcccaacagtccaacaaaagtcttaactcatttcc

SEQ ID NO: 478505 - DNA, 770 bp, Homo sapiens
gaggggtccttaaggtaggacatgtcaatgcccaccagaagagctctcttccaggtctggaaggtgattgaaatcgacaagcagatatccctgtgtgctcactgggtggccacctgggtgcatgaaatgagaggacatgagggcactgcagcagtgcagagatgggctgaatctaaatatgtttctattgcaccctctcaggcacataatgccaataagaactgttctgtttgccagcaggagagacagaagctgcagatggctatgggccagattccctggtgggaaggtcccaagcacagctggcaagtgaggctgatgctggtagccctggggggctacaaatgggtcttgacaggaatagacgctgactctgggctggcctttgcttacccagtggaagatgcaaatgctcagagtgctgtaaaagaatcagaacagaatatattacacacatttgcacaggctgccgtcatttcttccgaccaaggaacacactaattccctaaaggcctgatagaggcagattgtacctccaccctatctggcaaaactggggctaatagtggatgcagctatattgtctggtagtgaaaccagcccactggttctgcacctgtgtaaccttacccagtctgaatgggagtggattgtggggcaggtacttgctagactagtattgctgcctgcagtccagacaagcacagtgttccttgcaaagatggaaaagtttgtatataaatgaagagaaggaagaatggtagctgaag

SEQ ID NO: 478506 - DNA, 1054 bp, Homo sapiens
gacctcgcccctgtcttcctgtggggcctcctctaagtcttgagccctcagttcctgagagaagaaccctgaggaacagacgttccctggcagccctggcacctacaaccccagacatgctgctgctgctgcccctgctctgggggagggagggggtggagggacagggacagcaagagaatggttacacactgcaagtgcagagggaggtgagggtgcaggagggcctgtgtgtccacgtgccctcctccttctcccacccccaggttgccttgactaactctccccaagttcatggctactggttccaggaaggggctgacacagcccaggatgctccaatggctacgaacaacccaaaacgaaaagtgaagaaggagacccagggccgattccgtctctctggaaacctgcagatgaacgactgctccctgagcatcggagacgccaggaggaaggaccaggggcccaatatctcctccctggggaccatggagtccggccgcccgggaaacctgacctgctctgtgtcctgggccttgctcaccctcatcccaaagccccaggaccatggcaccaacctcacctgtcaggtgaccctgcctgaggctggtgtgaccttgaccaggactgtccaattcaatgcgtccttcctggagggccagtctctgcgcctggtctgtgctgtcgacagcaatccccctgccaggctgagctggacccaagggagcctgaccctgagcccctcacagtcctcgaaccatgggctgctgaagctgcctcgagtgcacgcgagggatgaaggggaattcacctgccgagctcagaaccctcggggctcccagcacatttccctgagcctctccctgcagaatgagggcacaggagtgatgctgggggtggtcgggggagctggagccacagccctggtcttcctgtccttctgcgtcatcttcatcgtgtgagcattgaccctggggagggagggagacccctgagggagggcaggccaggaacagaatccctgaagccagagctggagggacctgcatgg

SEQ ID NO: 478507 - DNA, 603 bp, Homo sapiens
cgcggactggggctgggagcctgggtgtgactctccctgggctaccatgattttgcgtgtgactttaaggatcctaataagcctcccaagaggaactcctggtgacctgcagctggagggcagggcctgggctgacttggtcccaagtgccaggccacagacctctacgtggcggctccaaacccacaacccacactgctgcccatccctcccagccttcgggtccacccagagggaacagctgggccagacacgccacccagacttgccaacagccagcctccctgccgtcccctgggacatgtgtggctgtgtcttcaaagggaaagataattgcaggggctctgaggtaggccctcttcccgctgagggaagattcaggactgcccccggatgcccctccgagctgtgtgaactgggaaagtatcagtacacctaccagactaatctccctgatcatggccacaaacccgtctgcaaggaggaactgaccccacattacagcgagaaccacaggtgaacaataaaatgggaaaatgaatctcctcacacaaaagaagcctccctctactcccaccctcagtcgtattggcaagtggaagc

SEQ ID NO: 478508 - DNA, 998 bp, Homo sapiens
tttgggtgtagcacaacacacagcataacttaagtgatgtctttatttggtttacatacactgtcccgtttgaaaatgcaagcgctcttaagtttgcaattgaccttaagttggcactggagttacgctgttctgtgttacttggcagatggagtccggtgtgcttggtgtgcacatcctgctggacatgatgggacccacaggacccttccccagtatttgtctcccgctgattctaggtttatctttcccgagggtcagaggggtggtgttcagcctgccctttccatgaatgactgcttgctaggcttccttgctggagacatcccctctgccagtccccacccacatgaagttactacccctcagggcccaggattagaccctcctggtcccaagcctgagaactgcaagcaacttacaagagagctgggagagccggggctgccgggtgaggtcggcatgcgggggccccaaggaccacctggactccccggacctcctggacgtgtcggagctcctgtaagtgaaggcacttgtctgggcaggggttctaccccttctccaggaatcaaaaaccaggttctagcaagttcctccacctgcatctagacagtaatgctgttttgccttactgatgccaatgaagtgttggtatctcctttcttagaccagaaattattagatgttacagtccataagaatcacccagagaacaagtttaaatgcatattcctgggacccctttctcacatcaagaagcagggtagatcccaggaatctgcatttttaaccagcaccacaggatttttgacacttgatctaaagaattcattttccccagcctgtcctgtactgtactcttgtaagaagggtggagtctactgaattcttagcccctggaacagtgccagactgtccagtatggtgttcagtatgtccagtgaataaagagatgaacaaacagatatggtgtatgaggaacaaagtagcttctc

SEQ ID NO: 478509 - DNA, 740 bp, Homo sapiens
tcattgttccgatggagacggttcctgctgtggacgctcagtgagtgttttctccctgtgatgtttcctggctcaggccgtctgcacgctgagttcgatcttggttcctgcatcgtctctcgcatgggcccggtgctcacccatgtgtcaacagaggactggccacgggccatgctgcaggtaccagctcacgcagggaagacccagagcccagccctgctgcggggcagttcctcaaaccccactctccgctacacggggattgaaataagacccctgctccctccagcaccagagctgcacagcaactcacgctcctgtgtgcccagagcctcagttactccaaatgccacttttatgtcctcaccatgtgagggaaggagcagagggcccacagagagagctgaccagcaaacaaatctacagaaacatgtgaaagctctcggaagaggtaacgcacatatggcggaatccaatcggagaacccttccactgttacctggcagcagtcatgaaggagcctccacctaggcctcctcagacatgttggttgcatggcaatctacatttaagagcccgagtgtgggccagttcacaacgtttggtgactgtggctcaaatgcaggtcaccaatgccactcttgtcaccactcattcttccatttgtttgagagccagggtaactgaggaccagagaagttatgtaacttgccaagtaagatacgagtcctctgaggcag

SEQ ID NO: 478510 - DNA, 2140 bp, Homo sapiens
gaaaggacaggagggccggttctggcgccagtgccagcacacccagctgggatgaaaaggtcaggaggggacactgaatctgagccccgaagggtgcaggggaggcagcggagggaataggaggcagggaaggcagaagccggaacaaagtggctgtgtctgaggagcctgatgaaggaagccgcagctgctggggtgcagggagagcgaggcctggatggattccctgggaagcctggggacacaggacagcaggccctcatatccctaaggaaggggtcctttgttttctcagaatgtgttatccatgctgcagaaccagcgcaactgcagatgagaaagcatggagatagggagcttaggttagttgaggaagaactttctagcaataagcacagtccagaaagtcagggcaggcccggcccttctggtgtggcaggaccccagggagaaaagaatcagaatcctgaaaatgccctagaaggtggcaccagtaactatgctgaaatgtttgtcgtttctgtgcagggtgacgtgggacctgcggggccacctggtgtaccaggctcagtggtcacagcagaaacagaaaagccacaaccatgatctcaggctgaactcagatggagcctttcagacttcagttgcctttctgccagaaatgcaaatacccactcccatacctctactccctatcgagaacttggaaagtaaactttgagtcaggagagggccatgggtgatggtgggcctgatcatatgggggaaaagtcatgactaaacatctgtttggcttgtgttaccagggagctccaggacccagaggtcaccaaggcgcccccggtcctccaggagctcgggtaagttgtccctctcctgcgcagggtttgctctgcacgcttctcttaccaatgggtttggaagatcagagtcattcccggcgctgagcatggcattatctcaagcgccttcacatcacctgagtgggttgtgctgttgtggtcacgtctcacgtaggaaaaactgagcctggaagaggtgggataactctctccacgtcaggcagctgccatgtgtggaatgggattgaagtgtgggcaccctgccttcagagcccccagtccccagcgggccatgatgggggtttctggggattcagtttgatgttttattttccattcagataaagtagaataaaaacattggacacttacatgccgactgaatcacttccaacgcactcacttttcccatgtttctggtcagttctgactttgcagtggcctgggacgtttcagcctctggtttctccccctgctaagaatttaatgatatgtaaatcaccagttgggaagcggccatccaaagggcccttgtgattatcttatgatgtgagttcagatatcgagaataattagtaagaatacagtaccctccacagggtccctgctttaaagttgcttcttctggcaatgtgctgctgttgctttcaagttactgtattttattgaaaggaataaaataactgacttataaatgaacatagatcagatttattttaagctattgaggcccactctttatgaggatatatttatatgtttttgctggggtaaaactagaagaaacttaagggatgtttaattctaggaaaattagaacaattttatatcaaagattttggatcagaaaatctaacttatgtctctgtgacctctccaggttcggtttccagagctgcccacaattgtaactgttgagagatttaaactagataatgcagagaatgcagtgtgttccaatatttacctttctatgcatacatacatgtatatttcagatctattattggcaagtattgaaggtctatactatatatgttttcttgtgcaaatatatgcatattaagtctgcaagggtgaagatgttatttttcatcttttaccaatgaaaacattagtgcagagacattgagtggtttgcacaaagtcacatagctcttgagaagcagaactgaacttgaacctagatctgactgtgcagcctctcctgttttcaccacggagtatacaatccttcctctgagctccgtaaaggggaattactttacttcatggtccccattacagaagaagaagct

SEQ ID NO: 478511 - DNA, 1918 bp, Homo sapiens
ttccaacagctgctcctcactgggcctgcctgggagcccagagctgtggggactctccatgcttctgtccccaggcgatgctgagactgcagcctctggggcattgaggtcctgttcaggtgggctgggggctttgtcaacagcagtgcaggggagagatgagggacagggagtgctcccagcatgcatttggtgaatgtctcccaatgtctgggtgactggcctcgtccaacttgggatctctcggggactccccaggactccctctccggtaggaaaattaaaagctgccaaactgttacccacgtaaagtccagatgcaaggcaaacatacggctgcaggaaggaaagcctgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgaccccaggttccaggccaccggggagaagccttgggagctaagtgccctcagtgttctccacacctgcatgaaccagtttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagaaagccagaccgtgagttattcatttagcacctgctatttccatgacagcatattcctttttctccctgtacttctatttgttataacaattatcacattagattgaaaatgtctccttatcgttacttccataaaatcataagttctggatagcagagattggatctttccatgtctgtattttcagctactaatacatagcctggcacagagaaagccaataaataagagctgagttgatatataagtcaatcaggcaattggttgaagctgctgtattccagaaacttttaggggttgggcttttaagattcattaaactgcatgaccctttaaacacatgatttccaaattcactaattgcaccaagccagcctttgcctctctttatgtgtcactgtctctctctgtctttatctctcactctctgtatctcttttcatctctctctttccttccactctgttctcccccctatttctcctcctgcatttcttagtttgaataatgtattcagtgcatcattagtgaaacctgctgagggccaggccctgagatgagaaatcaaaagccgaaatggtgaaatgactcgcctgagcgatgctttcttcctgtccacctttgctgggcattcttcccttcctatgcgtccctccttgcttcctctcttgccttgtctgtttctcctctcctctgccttttctctttctcttttctctctctcctgactgtagatatttccttggcatccctccctccctcatctcacacccttccctgctttgcccccactgtgct

SEQ ID NO: 478512 - DNA, 668 bp, Homo sapiens
acacttctctgcggtctgtaaaactctctgctacggtttgaatgtgtctcctccaaaatttaggtgttgccaacgtaatagtattaaaaggtggagacgttcaggggtgattatgccatgagggctcctcccttgtggatgcgattaggtgcctttagaaaagggcttgatggaggagccaaaaaatttattgccagtggtagttctggcaaggcctgcatccaaatagcaggtaaaggcacttggctgaccatcaatgttttccacattgtattcattgccagtcacctacacttggccttcatagatgttgtctgtgccaaacctattgagaagcctgcgggccagcagcaggccagtacaatactctgcagcataatttgtcaggccaaccttcacaccatattttggcagttcgtgtgcgtatgctgcgcagactatcatatccccctctatacgggcataagcaatctgactaatgatatctctgttgataattccaacattggattcttcttggtatccgcatctattgactttctcatttaagttgcaattttcttggttcctttataatgtgatgttttgttgtacccagtgtatttagatatgatattatgagatgacatttaatcttgaagggtagcaaaaggtcctgatgggtatat

SEQ ID NO: 478513 - DNA, 632 bp, Homo sapiens
aggcacctggaaatccagacttctaagacccctgtggccattttcagaaatgaagcaggtcccccaggcatgaaaggtacctggagattcaagagtatgactgcccctgggcctctagctaaagtgctcactgcacatactcctgggagaagtaacaggacagtcagctctgacgtgactgacacaggcagaagtgatttgtggaagcaggcttggacgggggagcaattctggatatttcatggggaaaacaaagagctggaagaaggaggtagtgcagaggccctcagaaggggaaggacctgggacccacacaaagacaggctttgcttctttcatgttttacttggggccaaacttactttctcctgtgtagctgattctctgggttacatgatggaaaatcgaatctcaggcttaaagtgtgacacagatgtgtttgccacttttgaaggtgacgatgttgttatgcttcagtggctgtactaatttaccttcccaccaacagtgcctaaaacaatttttatgtttaagtatttgcatatggaagcacatcaaagcatagataaggtgatgtgttgtgctatgacatcatgatggcaaagatatcgctaggtgatgggaaatttttc

SEQ ID NO: 478514 - DNA, 663 bp, Homo sapiens
cgctatttgaggaaagaatatgatgtcattcacagtccagtggggtggtcaaatctgaaagctccaaaatgatctcctttgactctttgtctcacgtccagatcacactgatgcaagaggtgggttcccatggtcttgggcagctctgctcccctggctttgcagggtacagccccctaccccagctactttcacaagctggcagtgagtgcagcttttccaggtgcatggtgcaagctgtcagtggatctgacattatagggtctggaggacacagctctactaggcagtaccccgatggggactctccctccaaactgttccaacctctacctattacccagtttcaaagtcactggatatgtttacaacagcacaacaccctactgggaccaatttactctattagtccgtttcatgccgctgataaagacatacccaaggctaggtattgggtaaatggagattgcccaagagaacaagtgaatccagttgaaagatagcagcagggacagtgctgtggcccctccttgcctgagatgcatcctggactgcttgagttgctcgcctggaataaagaggagaggcagaccctaaaatactcactttggctggtggactgcaaatattgattttttaaaattgttaatcattttctaagtt

SEQ ID NO: 478515 - DNA, 674 bp, Homo sapiens
catctggcttcttattatcagtatgataccaaaagcaaagataagctggacttcattaaaattaaaaacttctgtgcttccaaggatgtcgtcatcaagaaagttaaagaaaatcatcaagaaagtgaaaagacaatctacagaatgggagaagatatttgcaaatcatatctctcatcatggaatgatatctggaatatataaagaactcatccaactcactaataaaaagatcaataacaaaattttaaacatggataaagaatctgaacagacctttctccagagaaggagcatattcacactagccaaaaagtggaagcaacccaatgtccatcagttgatgaatgggttaataaaatgtggtataggtatacaaaggaatactatttggaatataaaaagaaatgaaattccaatacatgctgtgacacacttgaatctggaaaactaaatgtaaaattagattgtggtgatggctgcacaacacattgaagacactaaaagccatcatatggcataccttaaatgaaacaattttacacaatgtggatgatatatcaataaagctgttgttttaaaaaaaattagttggggtggttaattttacttcaccatgggctcttgaatttccacttgctgctactgatgaggcactgcctgcatctcatcat

SEQ ID NO: 478516 - DNA, 591 bp, Homo sapiens
tcagttaactaaatgggcacctgaattttctgtcccaccgggaaaagccatatgcatttccagtgatgcagataagcccggctgccacttcctgagtgctcttctacacatgtgcttgacttgcagcagatcacctagacatgaactcgagtctctctctccaaagctcctggtctctgcactgaagatctggatagagttctggccagaaaggaaggctcttgggtaccccaggcactccatcttctgcaccaagattcatcgtggtgaattaagtacacacactgatcttttcccgaagaccagtaagcaagttggggacagcaagcaatgtctcagcccaggccaggctcagagtggccactccgaaaaggtccaaatgaccaaggtgatgcacagacaccccagcctcttactgcagctgcggtggagccttttcctgggtctctacacaggattagaaaatggctattcaaggctgggcgcggtggctcatgcctgtaatcctgtaatcccagcactttgggaggccaaggcgaatggatcacttgaggtcgggagttcaagaccagcctggccaacatggtgaaa

SEQ ID NO: 478517 - DNA, 559 bp, Homo sapiens
ttaagtcatctttatttgacttcatatgtccccaaaacacaagagtcgtgatgctggcaattgggatatgccaaagagaagccataaagtgtttcctttaggtaaaaaagtgaaagttctcgacttcataagaaaagaaaagcaatcatatgctgcggttgctaagatctacagaaagaaggagtcttctacctgtgaaattgtgaagaaggaaaaagaaatttgtgctagttttgctgtcacacctcaaattgtaaaagataaacccatccgtccattcctaaggccatcaaaggcaagaagcattggggtgactgtgattggagaacaggtgtcctgggaagtccgggtggggaacaggggatccttcctactccccgagacagacgtggagctgagtggaagttccgcatctcgtttgtcatttcccttctcacgctgatgaggccaatgctttctaagagtgggttttggttgggtgacacttgtttctgcatgttaatagatttctgggttttgaaatatttaatcctttgaagagagtttgcatgcttcgtgc

SEQ ID NO: 478518 - DNA, 1650 bp, Homo sapiens
gtggacgcccctgaagaagcatcgttaaagtctctcttcttcctgctgtcatgtctaagtcagagtctcctaaagagcccgaacagctgaggaggctcttcattggaggattccaacaccaagcgttccggcgggagttttgggtttgtcactatgctgctgcggaggaggtggatgcagccacgaatgcaaggccgcacaaggtggatggaagagctgtggaaccaaagagagctgtctcaagagaggattctcaaagatcagttgcccacttagctgtgaaaaagatatttgttggtggcattaaagaagacacagaagaacatcacctaagggattattttgaacaatttgggaaaattgaagtgactgaaatcacgacgggccgaggcagtggcaagaaaaggggctttgcctttgtaaccttggacgaccatgactctgtggataagcttgtcattcagaaataccctactgtgaatggccacagctgtgaagttaggaaagtcctgtcaaagcaagagatggcgagtgcttcatccagccaaagaggtcgaagtggttctggaaactttggtggtggtggtggaggtgattttggttggaatgacaactttggtcatggagaaaacttcagtggctatggtggctttggtggcagccatggtggtggtggatatggtggcagtggggatggctataatggatttggtaatgatggaagccattttggaggctacaatgattttggcaattagaacaacgagtcttcaaattttggccccatgaagggaggaaactttggaggcagaagctctggctcctatggtggtggaggccaatacttcgcaaaaccatgaaaccaaggtggctatggtggttccagtagcagcggtagctatggcagtggcagaagattttaattaggaaacaaagcttagcaggagaggagagccatagacgtgacagggaagctacgggttacaacagatttgtgaactcggtcaagcactgtggtggcagggcctagctgctacaaagaagacatgttttaggcagatactcatgtgtatgggcaaaaaaactcgaggactgtatttgtgactaattgtataacaggttattttagtttctgttctgtggaaagtgtaaagctttccaacaaagggttttaatgcagattttttttttttttgctcccatgctgttgattgctaaatgtaatagtctgatcgtgatgctgaataaatgtctttttttttttttaatgtgttgtgtaaagttagtctactctgaagccatcttggtaaatttccccaacagtgtgaagttagaattccttcagggtgatgccaggttctatgtggaatttatgtacaacctgcttgggtggagacgccattgtcttcagaaaccttggtgtagttgaactgacagttactgttgtcacctgaagttcaccgttaaaagggatggcccaagaaaagtcatggaattaattggttataaaaatgattgttggcacatcctatgaaatatatgtaaattgaataatggtaccagataaaactatagatgggaatgaagcttgtgtatcatccattatcatgtgtaatcaataaatgatttaattctcttgaaaaaaaaaaa

SEQ ID NO: 478519 - DNA, 624 bp, Homo sapiens
agccagtaacctatcagcaacatctcagttcccagaagtgtagcccccagaatactccttcttcttaaggcctatatctgttgggaatgttcttatattaatggattccacaaaaatgaaagatcaagatttcggggaacttaaaacccgcactgctacagtcagaaaatcacaaatactggtccatcggcatttgatcatatatgctattgttattgaaaagctaatatttgagggacttaacgcttcacccaatggtgaaagccttgaactaactgaagggaacagtgcctggggtaataccttgataagccatctgaggaaaggcgtgccctgccccaagactgtggcaaagaaagaaaaggcaggtggtatgctgaaagaaggcattgttgtcataggagaggacagctccatgcgtgttattgcccctgaaaaccttccagtaggacaagatgtggaggtggaagacagtgacattgatgatcctgacccagtgtagtcctaggctaatgtgtgtgcttgtgttttagtttttaacaaaaaagcctaaaaagtaaaaattaaaataaaaaattttaaaaatagcatatggattctatacatgttttgttagatttataa

SEQ ID NO: 478520 - DNA, 440 bp, Homo sapiens
cccacaggaatctacctttttaacaacatgtggctacctgcagaagaagctgacatcctgcgcttccacacacactcctgcacagaacttgaaggtgaacgaggggagactcagctgggaggtcaaggtctgatctcagttctgcagggtgtctgctcagagctcctggggcaccagtatcagccagtgcccccctcagaggagaaagaaaaagaggataatgggacgcagaaaaacaaaaatgacaagaaacgttctgtcagcagcatgcgattaaaaaaccccatacagatctggcagagcatggttatttctgaaaatgacactcactttgaaggctgttcttttagtcagacctctgttaggctaaggacctctcccactgctgacatgatagatcaaaggaagcaccttgcactgtctgaggtgcatgactagca

SEQ ID NO: 478521 - DNA, 904 bp, Homo sapiens
cggtctgaggacctgaggtcgtatgtggatctttctcacggagcaaagagcaggaggacgggggattgatctcccaagggaggtcccccgatccgaagctgtaacactcactgtgaaggtctgcggcttcactcctaaagtcagcaagaccatgaacccaccggaaggaagaagctctggacacatctggacatctgaaggaacaaactccagacacaccatctttaagaactgtaacactcacagcgaggggcaatccaacttttcccccaagtggagcccctcatcctgtgccacagccacagtatccaggatgccaacccttggttccccaccctctttcacaccccctcctgcccctggaatgcctcctgtgaatcccttggctcctgacatggttggaccaggagtgatagtggacaagaagattcagaagaaaatgaagaaatttcctaaaaagtacctgggactacagatgtgtgccactgatggcagcagtgggccatctggtgcagccactgccatcacaccagcagctgccgggaaggcacgggaaggaggtggacagcccaccatcctggagaccactatgatggggccagccaccactgagtgctggggccacaggaggagcttgtggcaacatcgcccctgccctgaatgccagcgcagacccagcgagggcctggagcccctgtcccaggaaacaagggagcatgactgggtgccaggctccatggagccagtgggaattggggacaagtgggaactctgccccttccaagttggcagagcaggagctccccaggtgcagctgcagattcccaagccatggctgaaactcaggcacccctgttctcttgggagctgggagtaggcagggtacatgtgcacaatgtgcagg

SEQ ID NO: 478522 - DNA, 597 bp, Homo sapiens
gtcatagagtggcgttggcgggccgcagaaactcaggagaacgttgaggcaggcagaggggtgaagtaggagactgcagggaatgctgggagcctcccaacaatgtctttcccatcccagaagcccccagggctgtcccaggagggctgtaaagaaccagactttggagaagagtgcctgtgtctctcacggaaggcccccacaagtgaaaacaaactgcagggtggtgggggtgggccacagaaacttcaaggtgtgtcctggatgggctataactccccaggcattggagcatgatgactatgtctcacagaaggccccaaaagcaaaaacagggcagcagaatggtgtggttaggccacagggacccatggggactttgaggcaggcagaggggagatgcggccagaccaccaggaatgctgggagccccccaaggaggcctctcccatcccagaagcccccagggctgtcctgggcaggctgtaaacccccagactttggagaaggttgactgtctctcccgaggaaggccccccaagcaaaaacgaggccacatggctgtatgggccggctcaaggtactatgggcatcgct

SEQ ID NO: 478523 - DNA, 5097 bp, Homo sapiens
ggatgcctctcccttccaagaagtccctggggtgacccttcgggttggagctagagccctgaacttcaattcagggtgcctggggctctcacagagggcccccatgggtggcatctgggctgcaggcaggcctgtgcggttgggcagaaactcagcgtgatgctgaggcaggcagagtggagaagcggcaaggtctgagcgggtgatgtttcctcccagggaggcttctcccttccaagaagaccccagggcccccccatcatgggggctagagccttgggttccatccccggatgcctgtttctctcgaagcaggacaccaagggcagcggcaaggctgcagaatcccgtggagcacatcctgggttggatctacagcctgggatctggcccagggtgactgtttgggggagggcccccatgggcggtggtggggccacagacatgcctatgcgggatggcagaaactcaggggcctttgaggcagacaggggtgagaagtaccaaggcctgagcggggtgaatgagtctctcacacagggcccccacgggccatggtggggccacaaacggggctgtgtgggcagagggcccccacgggtgacagtgtggccgcagtgtggcctgtatgggtggggagaaactcaggggtatgttgaggcaggcagaggggagaagaggtgatgcctgagccagtgctgggtcatcccaggatgcctctccattcccagaagcccccagtgtgccccaactgtgggttagagctccgggctctggaccagggattagtgaagggatatttcaaatcccactgaggtctaaagtgaaaaaccgaatatcctggaataaaacctagaaagagctatctttgaaattgctttgtgatctttgcattcagctcacagaggtaaacttttcctttgattcagcaggttggaaacactatttttgtagaatatacagaggaacattttggagcccactgaggcctatggtgaaaattcaaatatcccatgataaaaactagaaagaagctaactgtgaaactcctttgtgttgtgttaattcagctcacagagttaaacctttattttgattcaacaagttggaaacactctttttatagaatctgcgaagggacgtttcaaagcccactgaggcctatagtgtaaaacagactatcccacagtaacacaacaaagaagttgtctgagaaactgctttgtgatatgtggattccattcacagaggtaaacctttctttaaaatcagtagattagaaacattctttttgtagaatctgtgaagagacttttaggagcccacttgggcccatagtgatgaatcaaataccccaagataaaaagtagaaagaaggtatctgtgaaacttttgtgatgtttgcattcagcccacagaaataagcctttcctttgattcagcaggttggaaacactctttttgtagaatctgtgaagggacatttcagagcccactgaggcatatagtaaaaaataaaatatctcacaataaaaactataaagcagctatctgttaaaatatttgtgatattcgcattcagctcacaaagttcaatttttttttttgattcaacaggctggaaaccctctttttgtagaatctgcaaagagaaatttcagggcacactggggccttggtataaaaccagacattccttgataaaaactacaaagaatctgtctgagaaacttctttgtgatgtttgcattcagctcacagagttaaaactttgtattaattcagtaggttggtagaacattttttgtagaatctgtgaaagacattttggcagccactgagggctatagtaaaaaatcaaatattctgcaataaaaaggagaaagccatctgtgaactgctttgtgatgtgaggattcagctaaaagactttaatgtttctattgattaagcaggttggaaacactctttttttagtatgtgcaaagtgacatttcagagcctgtgggggcccatagtgaaaaactgaatatcctatgataaaaactagaaagaagctatctatgagactgatttgtgatgtgtgcattcagcacacagagttaaactttacttttgattcagctgtttggaaacactctttttttcagtatctgcaaagggacatttcagagcactttgaagcctacagtaaaaaacagaacatcctctggtaaaaactagaaagaagccatctgaaaaactgcttgtgatgtgttgattcagctcacagagttaaacatttcttttaattcagcagtttggaaacattatttttgtagaatctctgaagagatgttttggaacgcagtgaggtctatagtgaaaaactgaatatcctgtggtaaaaactagtaagaagctatctggacacctgctttgtgatgtatagattcagctcacagagttaaacttttttttttttattcagtagtttgaaaacactcctttgtagatctgcaaagggacacttcagagtgtaatgaggcctatggtgaaaagttgaatatcccgagataaacactagacagaagctgtctgtgaaactgctttgcaatgagtggattcagctcacagagttaaacctttgtttggatacaactggttgtaaaaactcttgtagaatctgtgaagggacgttttggagtgcactgaggcctatagtgaagaacaaaatatcctgcgataaaaactagagaggagctatttttgaaactgctttgtgatacatggattcagctcagagagctaaaccatagttttgattcagcagtttggaaacattctttttgtagaatcattgaaggggaattttggagcattttgaggcatataatgacaaaccgaatatgctatgatgaaaactagaaagaagctgtctgtgacactgctttgtgatgtatagattcagcttcacagagtcaaatctttcttttgattaagcaggttagaaactttttttgtagaatctgccaatagacattttgaaatgctgtgaagcttatagtgtaaaaacagaatgtcccatgataaaaactagagagaaggtatgagtgaaactgcttactgatctgtggattcagctcacagagttaaaccttacattatttcacctgttgagaaacactctttttgtagaatctgcaaggggacattttggagtgctttgaggcatataggaaaaaattgtatatcccatgttaaaaactagaaagaggctctctgggaaactgctttgtgatgtgtacattcagttcacagagttaaaacgtaggttttattaagatgtttggaaacactctttttgtaaagtctgtaaaggaacattccagagtacactggggtctccatagtgaaaaaatgaatatcccacgattaaaaactacaaagaagctatctgtaaaactgctttgtgatgtgtacattcagcttacagagataagcctatgttttgattctgcaggttgaaaacacattctttgtagaatctgtgaagggacatttcaaagtgcagtgaggcctgtagtgaaatacagactatcctgtgataaaaactagaaagaagctttctgtgaaactgctttttgatgtgtgtattcagctcagagttaaaggtttctcttgattcaggaggtaggaaacactctttttgtagaatccacaaagggacatttcagaactcactgaggcctatagtgaaaaatcaaatatctggcaataaaaattaaaaagatgctatctgttaaactggtttgtaatgtgtacattcagttcacagaggtaaatttatattttaattcaccaggttgaaaacactcactttgtataatctgcaaagggactattcagagcccactgaggcctaaaccaaaaaacgatatccagcaaaagctactagaaagaagatatctgtgaaactgctttataatatgtggattcaactcatagagtttaatctttcttttgattccaccgtttggaaacagaattttagtagaacttacaaagggggattacaaagtcctttgaggcctacagtgaaaaaccgaatatcacgtagtaaaaactagaatgaagctatctgtgaaactgctttgcaatgtgtgcattcagttcagagagttaaatcttacttttgattcagctgtttggaaacactctttttgtagaatctgcgaaggtacatttcagagcgctttgagacttatagtataaaactgaatgtctccttgtaaaaactagaaagaagctatcttggaaactgctttgtgatgtgtggattcagccccacagagttaaacctttactttttgattcagcagtttggaaaccctctttttgtagtttctacaaggggcatttcagagctcaatgacacctatagtgaaaaacttaatatcgcatgataaaaactagaaagaagctatttgtgaaactgctttgtgacgtgtgcattcagttcagagaattaaaccttattatgattcagctgtttggaaacactctttttgtagaatatacatagggacatttcagagtgctttgagacctatagtaaaaagccgaatatcatgtggtaaaaactagaaagaagctatccatgaaactactctaggatgtgtatattcaactcacagagttcaagatttctcttgattcagcagtttggaatcaatctttttggagaaccttcaaagggacactttggaatgctgtgagatctagagtgaaaaatcaaatatcctgtgataaaaactagaaaaaagctaattgtgaaactactttgtgatgtgtgcattcatctcagagaggtaaacctcacttttgattcagcagtttggaaacacatttttggagaatctgtgtagggacttttcagaaggcactgaggcctatagtaaaaaaaacaaatatcctgccttaaaaactagaaagaagttatctgtgaaactgcttcatgttgtttggattcagctcacagagttaaacttttcttatgattcagcagttgggaacactctttttgtagaatctgtgtagggacatttcagagcacag

SEQ ID NO: 478524 - DNA, 669 bp, Homo sapiens
agcgaataagtctcacgagatctgatggttttataagtggaattcccctaaacaagctctctctctttgcctgctgccatccacgtaatgaatggtttgctccttcttgccttccgccatgattatgaggcctacaccgccacgtggaactaccctaaagtccattacatcattcttatgcctttgcatcctcgaagcttagctcccatttataaaaaggaaagaggtttaatggactcacaatcctacatggctggggaggcctcacaagccatgggcagaaggcaaaggaggagcaaaatcacgtcttacatggcatcagccacagacatttgcattttcaccatttgttacatttgccaaatgtatcatcatcatcttattcactttattcaccatcaccaaattcatcatcaccttattcagtccaatgatgcaatcatcatcacagtcagccttcaacatttcttgagtgctttccgctttcagggcactccactcacaggaacaccagatgtctacaagaaacttcttgggagcaaacatataaaagactggataaatatgaatagcatattttataatacatgaatgaacagttacttaagtaaagaaaagcatcgaaggacagaaattctgaaaaaaaaaagaagtggaaatatagaaagc

SEQ ID NO: 478525 - DNA, 429 bp, Homo sapiens
tagtaccacagctcatgctctctggaaagtgccacctcctggcaggaggccaaccggcacaaaaacagagcattaaaccaccaaagctaggaaccttcacagagtccattgtacccaccccaccacctccactggaacaggcactggtatccatggctgagacccatagacagttcacatcacaggactctgtgcagacaaccctcagtatcagcccaaagctgggtagactcgctgggtggctagacctagaagaggccacatccacagggaaagggggagagtactacatcaagggaataccccatgggacaaaagaatctgaacaacagccttcagccctagaccttccctctgacagagcctacccaaatgagaaggaaacagaaaaccagccctggtaatatgaaaaaacaaggctcatcaata

SEQ ID NO: 478526 - DNA, 1328 bp, Homo sapiens
ctaatgcagagagaatctggcgtggcatcattggggtgatacctgaggtttattgtcccacgggcatggaaaactaggacgcagatacaccaggatgagattcagagaggaagtctaataggtgaaagaaagaaaagctctctctgctgcagagaggggggtcccagcgaaaatgggttgccgcttccacagtgaacagattcggaagctcaaggacatgacccagaaggttggtggccaaagagacttcttgtctccagatctcggcaagatgtttgatggtgtccacacacagcattcctctcactggctccatcacagccacacaaaagggaatgaccggacttggatagaagtttctgaaaaagtgcccataagaataaaatcaaccagcatgaaatcagtattcacatgtgggagtgaatgtgggctggagctgcctgaggtttatgggctgaccatcattggtactgagcacacacatagaactctgcttctctttaacctgcaagctgttgggggcaaagagcacaggaaattcaattccaagcttcagttgttgctgatcagacttgacatgtatgcctggacaataagatttgtgacctaagcagaataaatgaatattccaggagtgtttgaagaacatacaagaagccaatgtgacaggactgagcagatgaaatcagagatgttaccgagggctagattatgtagtaagacaggatgcctttgagaattcgagtgggggaatgagacaaacttttctatataattttaatttttaaaaaaagttgggttaattttaaagttagggaaaagttgcaaagatagcacaatgttcccataatttgcttagtttcccctaatgttgacatcttatatgaccatgatacatttgccaaaaccaagatattaacattgttacgttactgtaacccaaattgcaaactttatctggacttcacccatgtttccacggtttatctgttcgaagataacatgctgcgtgtatttatcgtgtctccttagtctttttgggtctttcttcaatattttcttttacttcaagactgagatttttgaagagtactggttatgatgtagaatatacctcaatttgggtttgtctaatgttttctcatgattagtctgggtttatgattttggagaagaatgtcacagaggtcagatacatttcttgctgataatggataatctatttccttacagtaagcagcagttggaaaacagcatattcagaaagcatgttaatggatgtttggataggcatttcaatgatgattgctttagtaaagcaataataa

SEQ ID NO: 478527 - DNA, 639 bp, Homo sapiens
ggaaaggggattacgcaacatgccacccttaagagctgtaacactcactgcgagggtctgcggcttcattcctggagtcggtaagaccacaaacccactggaaggaacaaagtctggacacaccatctttaagagctgtaacactcaccgtgaagaagaagaagtttcccaaggactgaactatgagagaagaggagttcaagaaactgtgaagctggaatacgaagagaatcatctaaatggatatttaatgtcccgtgatgtcatactgaaagaacacaggtggagatcagcttactcacaagagctggctgctgggtgtcgctgtaacctctgtcccactcctcatggaagccaaatgtcagaggtgggttctgaggtcagtctagtagggggaacttgcttcttcaaactcagtgcttgggaaaaatcccactttatgtcagataattttctagaagtgtctatatgtcttttcaatcaaattggaggaaaagatcgactggtatgatggaaggtttatttactcaaatcaatatagagtaattattatatccagatcaagtttgagagctagctgaagtgtattgaccagtcagtcttgctctttgaataagtgatgggtgctgggaagaagcc

SEQ ID NO: 478528 - DNA, 548 bp, Homo sapiens
ggtgatacccaggtaaacagggtctggagtggacccccagcaaattctagcagacctgcaaaagagaggcctgactcaaagaccaaaggtagataaatccataaagatgaggaaaaaccagcacaaaaaggctgaaaattccaaaatccagtatgcctcttttcctccaaaggatcacaactcctcaccagcaagggaaaaaacctggatggagaatgagtttgatgaattgacagaagtaggcttcagaaggtgggtaataacaaactcctccgagctaaaggagcatgttctaacccaatgcagggaaactaagaaccttgataaaaggttagaggaattgccaaccagaataaccagtttagagaagaacataaatgacctgatggagctgaaaaacacaacacaagaacttcacaaagcatacacaagtatcaatagccaaatcgatcaaggagaagaaaggatatcagaaattggagatgaatttaatgaaataaagcatgaagacaatattagagaaaaaagaatgagaagtaattaacaaa

SEQ ID NO: 478529 - DNA, 1315 bp, Homo sapiens
gaacagctgaggtgtttgctaaaggcagaggtaacaaagaatggttaaaaaagacaacaatctaatctcttatcacttctaccctaatgctttaacggcactttggcagaccatttcaacctgccattcaggacagcgggttctatatggtgtgctggtgcatgatcacctatctcagctttcaaaagagtttgagcattactccccaaccacaaaagaccccagaactaagaaggaatggatccgtgctccatctgtgaataagccaggtgaatcgattttgtctgtcctagaaaaggatcaactgtttgagatagcacatgacagtggccttaaaatgaccacaaccaaaatgagattacagagtacactggacataagcaagacacttcggtgttactgtctcccatcaccaccaaatgggactgtcttgttgcaggaaaagaagctcagggctcccactgtttctacattatggtgatttgttaaattatttgattatgtattacaatttaataataatagacataaggtgcacaagaaatataatgctcttgaatcatcctgaaaccaccccccaccaactctggtctgtggaaaaattgtcttccaccaaatgggtacctgctatcaaaaaggtcagggaccacgtttctttgcagtcatttatctgctttatatattcgtacataacttcaggcaaaatttgctttgtcctatttttttccctgcagttttcagagtcactttcactctcaaatagtgcacaccattcagaaatggggattgaacgtgcttgagcgacagtgaagcactcattcctagggagtacagacatagcagaaactttctcaggttacttccattaaaaaaaagaaaaagaaaagaaaagtaaagggacttgaacaactactgtattttatgatatatttaaacttaaggtctttttgctgcattttagcatgtgtgttcaagtcttggcttaggagaaaattgcaaacatctggtttcagagtaagaggatttgatagttgttaagggttgttagtaaaaagagaaattcttcagctaggcatcaatatattttcaaagacagtattgaatgtattgttgtaacttgtcttaaaggcttaactggaaaattaaaaacataatagttctctattatggattgtgtaactaattatttaattaattcttttaagcaaatttcagaacaaaagaatttcctaaaggagtagcaataaaagggaagatcaaggtggacaatagaggaagaaaagcaagagattgagaggtgggacgaaacactggc

SEQ ID NO: 478530 - DNA, 684 bp, Homo sapiens
actcgatctacactgcagttaaaggaacatgcacacacagaaagcagaaagaaccaatgcaagaaccctagtaactcaaatggccagtgtcaaaaatccaccgaatgatggcaccaaagtatgggattatatgaagaggcaatgtctacgaatctttggcatccctgaaagggaggggaagaaagtgaacaatgtggaaaacatatttcagaatataattcataaaaacttctccaaccttgctagagaggccaacattcaaattcaggaaatacagacaacacttacaagattctacacaagaagatcatttccaagacacataatcatcagattttccaaggtcaaaatgaaagaaagaatgttaaggaagatagaaagggcaggttatctacaaaaggatccccatcagactaacagtggacctctcaactgaaaccctgcaagccagaagagattgggggcctatatttaacattcttagaagaaaacgttttcaaccaagaacttcatgtgcagccaaactaagcttcctaagatgacttcggctatctattacacaaaatacttatctaaaataagtattttgtgcttccaaataaaattcaggatatttttatttctataaagattgtcattgctattttaatagggattgtattaaatctgtagattgtttggggt

SEQ ID NO: 478531 - DNA, 1018 bp, Homo sapiens
tggagagtttcaggggtgggcaagaggagcatgttgtttaatttcgatgtgttgcatggttttgaggaatttgcttagtcttgagttctatttttattgtgctgcaatccaacagtatgtttggtataatttcagttatttggatttgatgaaaatcattttatgtctgattatgtggtcagctttagaaagcagtgcagagaggctttcagttgcccctggagtctctgttttggaagttgcagaactgctaccaactcaattgccccagcagggggtgcctgtcttcaagctcactaattctttcacctgcttgatcaattctgctggagaagagcctcacctcatagacatcatagtcccacacccacagataggccccaaggactctttagtttcctgcccaaactgggttgtttccttcaagtcctcgggttactttctggccaaaggtgtgtctagaagtttcattcaggagctagcctggaatggggacctcaggactctgccaacagcccttggatactgaactggctttcataatctgtatgtcttggcacaaatgtattctcttctttctctccatttcataaatatgtacaaaatcattataaattatgtaataaatcgttattatatttatgaaagcagatctcacagaatagattttttaaaatatgacttatttttttcttccatttgtccccatcaacggtagccttattgaagatctaatcaaattgacttcgttaataatatcttaataatgttttcatattgacattaattcatcactacaattaattaaagggttattgtgagaattaattaaaataatagatgtgggtgcttagcatatactatatactcataacattggagacgatgtgtaccaagagcaatactgacagcaataatcattttttgaaaatctgattctcttaaatatatcaaggcattcgatgcttttatcaaaagcaaataagtaattcagtacaatttcagtggttgtagaaat

SEQ ID NO: 478532 - DNA, 570 bp, Homo sapiens
aacaggatacgggccaaaactatgaaaacagataatgacataaagatgacaccctatggcaccttgaaaaaagacaggatctctctctgttaccgaggctggaagtacagcagcgtgatcacagctcgctacaaccttgccctcctgggatcaaagaagccaattacgcacagtgaaggatttcctcagtaccagaaatgcaattattatcaaatactagataacatcattagaatccagggttcaaacgctcctgcggccactaactgctatggtgatagatggcttcaagctggtctgactgttccagaccccagctcagagaaggttggtcgtctgaagccttcttctctcaaatcgtcaaagtcattctccgtccagctttgttccgttgctggaccctcagctgcaggtctgttggagtttactggaggtccactccagaccctgtttgtctgggtatcagcagcagaggctgcataacagcgaatattgctgaacagcaaatgttgctgcttgattgttcctctggaagttttgtctcagaggggtacctggccgtgtgaggtg

SEQ ID NO: 478533 - DNA, 486 bp, Homo sapiens
gcagccatacggactgtttggaatgatgccggagacataccagaaactgagaaaatggcaatcatataccgatttggtgcagctgctgttctcaccccatatgtggggcactgaagtgattaccgttatggtagccctcagggaggcagaagaccatccgcaggaccggagagtccacgccataaagaaggggaaagtgcatcctctgcaggtgaccaccccacaagataaaaaggggccccagcaggtgacctgcatgcagaggtcgattgatttaattgcaggtggggttgcacaagagaaaattggcagtccaccaatggaatgctgttggctctatggcagcaactgtcccagagcaacaattccggaaaatgcccaagaggggacaaaacaatgttgcttaacccagccccgcctggatgctgcagctcaactttttgcagacaggcgaagagactgggcccttcctgtttgatttgggaa

SEQ ID NO: 478534 - DNA, 831 bp, Homo sapiens
cgtatgataccattagttgctaaactttgttgccctcatccttaaccaagacacattatagttataagcaactgctctgaatttggagcaaagtcacggccaaacccaggtgttatcatgacctcgctatgtgtgcatatgctcagggtggcactgacaccagccccctgctgtgtctgccccctccaaactttggatgccaatgatcatgagaaggaggccaaaggggagctgagggcagcttggtgtaggccttcagacactccttggcatgaacagcctggaaactgtagacaggatgttgatgacagcaggaggcagacaggctcctgggccaaaaggggcagccaagagctgagcagatgtcaaaatgacctgcctgcagagaagagctatccactgagtatctcctctcagctgagatctgagcagaagtcaggacaacctgcctacagtgaggagctacccactgtgggtctcctctctgctgaaagctgtatcctcattgggatgacctgtctgcagcaaccctgccataaaaagccacaagggctggcaaaactcaatcttgatttttggacctctgctttcccacgttaaaagcggataactaaagctatcagagaaaatgagattttgtacaaaaataggcgtagattgctctactctggggtaccaaaaactctatgcatgtattttagaatacctatacattacagattctttatgctataactctttaaaattccttttctttctttttttctattccccagtccatacaagttcaataatttctgtactaataatatttaaagcacattatttaag

SEQ ID NO: 478535 - DNA, 583 bp, Homo sapiens
ctgagcagtatgagtctgggaaaacctaacacaatgctggatttagaggggatgctcattaaattcaatttaattgacaccaacacagaagaaaggcagttctacaaccaatatagaatattattccttaaaaaagtcaaaaagcacaagcattcccttttgggcgctgcagcgggcagggaagtggtcatgggcgaggctgtgctactgcgtgcgcacgcgcaggaagctatggcctctttgcaatcttccagtaacaatagaagatggagaccaggccagaagacctggaagatttcattattcagaggcaactcttggagcccttctgagaccataggaacaatccagcctagtcccggagatgatgagagacccttggagcctgaagtagccaccccaggtgaggcccccttgagcaaccaaccctgagctgatctggaagccaactagatagaggcacatgaatgagcatatgccaggccagccaaagaaccacccagcgaagttacagaatttcagcattatttcctttttttttttgctgactttgtgtttattttagttctttcagttgtaaaat

SEQ ID NO: 478536 - DNA, 948 bp, Homo sapiens
caccattagttgaactacttctgctttctgctccgtgggggttgagtccttttcatgatgtatgctaaattctggtgcctcctgcttgctttctgtcctcacagcatcacaatgaggacaaaagcccaagggagaaagattggtgactgtggcagtgagaatccatgggtcaactgtgagggaagacctgaaaagttgcatggcagaggtactgaatacatgctgaatacagatttgggaccaagaatccaatcaaccaaattctttgatgctgtgaggagtttccttgttgatacagagttcgatagtagttgtcagattgtgccatgtgattggtctacacataactcagatggaggtaatagcggaagaggactaggcgtaaactgctgtgaatgtgaaaaggtacttcctgcccatgctaaggccttggtaaaagctagctgcaagtgtcacactctggagatagtaactgtactttctgttctttttgctgcctttctaggatggaatgccgttgaatgattcccaaaaccaacttcgcagtactcatggtatctgaaatgtattagagaggtctttcactgaaggtctggagatagtaactgtattttctgttctttttgatgcctatctaggagggaattccactgaatgattcccaaaaccaactttgcaatactcatggtatctcaaatttattagagaagtatttcaccgaaggtctccaaacaaagttaaattttatttgtgtcaatttagaggaaaattatgtttcatgtggcaccatggaagggaaataaagaggcaaaggaaacagcatcatatctcctaagggttgaaagtcattgtaaataggtgctttaattaaggttagttagtgacaagattaggacttatatatccccttttatttattaacagtttaggcagcatatattttaagga

SEQ ID NO: 478537 - DNA, 697 bp, Homo sapiens
tgacaagttaatgggtgcagcacagcagcatggcacatggctctggtgacgtggaagcattgggctgcggccctggaatgagaataaaggtgagaccagatccagagctctcccttgcatttcaaacaaatacttttagtgccttctggatgattccatgtggatgcctaatgaatacctcaaatacaaccaacacaacatgtcctctgactctgcagacacacacctcagtcaagagatgttctgacttttcagttgctcttgcccaagaccttggagtcactcctgaaatgttttatcatgacccatatctgacacatcagcaaaacatatctggaaccactgttgtgacactggtgttagaaacaaatgcttgttgcgttggcaccaaaaagaagaaataccacttgaacataaatttaattttctcggcaagtcaatctttacttctatagcagggggcgacttgcagatggagtaaaggtaaagcaactaaaactcagaaataaagaattaatttgtatatatgaatatttatttggttttaaaaataatttttaaaatatcccaaatgtaatgttttatttacaattatttaaaaatttatttaaaattaataattgtaaaaataagttactttttttcagtggttgaaaatgttttcaggtataaagtagttttatgcaatcaaagttgt

SEQ ID NO: 478538 - DNA, 872 bp, Homo sapiens
gataggaaaagaatttggacgatgcggatgtaatgtctccaggtgagggagcacagctgctcagtggctgcgcatccctaacagagccagtggctgcctgctgctgtggaaccgcagtgtctgtcaggctgccctccagcaccgtcacagaagtacagtcagattcattttatggcaaggatatgtgcatatctctctcaggagtcctgccactgaaaaaagactttcagaagtcacttcctcctgggctccggttttccagtaggcagtgtgaggaacatctgggtgcaaaagaaactatccacagagtaaacagaaaacccacagaacaagagaaaatatttgcaaactgtacattcaaagatgatctaatatccagagtctataacaaacttaaacaaaccaacaggcagaaaaccaccccatttaaaagtgggcaaaggacatgaacagacacttctcaaaaaaagacatagaggcaatgcaaattctaggcaaaagcctcaagaatccttgcagtggcttttagacttctctggattaatccttttgagaagtctttcatcacctaagagaaactaaatcttatcttagagggaaaatagccagcgataattgaatagatttgtacatgggaatgagagagagtctgaaggtagggataaatgacaggtagctattccagtagtgagaacatcaaggtaatcaaccagggaagaaaatgaaagatataaaaagagaaatgtagccaaaaatataaatttttcctagtaagagggtcttcagtgcagcaaaattcatgtattctctgttagggatattgcaatggggaattttggaaaaagagggaagaaagtttttggaactacttt

SEQ ID NO: 478539 - DNA, 564 bp, Homo sapiens
gaaaacaaaagtaaagtaagcacctgattgattggctatagccagacatttgcctcaaaggcagaatgatgacccaccaaagatgtcaaatttctcatccctgtcatctgtgggtaaagggaattgatgatatgaatgatattaaggctgatgatcatctgattttgatatgggtggattattttggactacctggcaagaagcagcataagaaagaattgactggcattgctggcctcgaaggtggaggaacaggacatgagccaacgaatgctctggtgtctcatacctcgttgatctattcaggccctctaatcggtaatgacttcaccaagaccgagccctgggattgtgtactacccttgtgttacaaaggtaacatgaataagaagggatatgacaggggtccttacaatgtcattgccttctttttgcgtttgaagcaggccctagttggaaaagaaaacatgaactcccgcagctgccacctactcattttatagctatttaaggaaatatgataatcccaaatattactgtcagagcagtattttcaaatcaaag

SEQ ID NO: 478540 - DNA, 831 bp, Homo sapiens
ttataaggctttgtcacttgctctgggcgcatgatttaagcaaatactgaagactcatgaatgtttgagaaactgaagcttacatatttgaaattactcacctatggtgacctagtatatcagctggtgcaggctttttataccacatgtgtaactctaccctacctcaggtgtcagagacgaggaagagaacaggagccagggttcctggaagctgctgcagctctgagtgaccagcttactggctgttgcgatgttagcttgttaattggagatctttctaacctcttgatgaatgtgtttagcactataagttttcctcttaaaacttcttggctgtatcccataggttttggcgatgaaataaacagagacttgcaacaaataggagagcagcaattgaagaaccgtggttacactgcaaaggatatcaatgctcacagcatctcagatcattacttattacataccatgtttgctaaatattgacataatattatactgatatgttattgagcagcactgcaaattacagataaacatgagaaaatcaatgttaatattggcaaatgttggtggaatcattaataaatttggagattttagtgtaagttaggtttatataacataatgggcttttcctttaatttataacatgtaaatttgtgcacatgtagcatccattgtatttatcattataatatttggtggttatgtctcatagattgtatttcattctttcagggttaaatttatgttcctagaaatttctttatgatattttaattttattctttttactatttgtttttgtagcaggaatcgagtcag

SEQ ID NO: 478541 - DNA, 624 bp, Homo sapiens
gaaatatacatgaatactacatgaccatgaatgaacattataaagattctctaaaagtggtgagtgctaatactcacgcatttgaggaaataagtagacacagtgtgtggtgctaccttgctcctgaagacagcagacttactctggcagtcagtgtctcagcaggagccagaaacagggcttttctgcctgtctcctctccagttagagatccagcagagaagaggacaccaattgtttcaggaagatgcgcctctgtgcccctttccttgtcctcagctggcttagttctgcatgcaacaggtctggctgtaccccatggtgctctctttcattctccgcatgacagctctctctctggagagaagcagaatgggaaggagagagaagaattattaaagttggagaggcaatgcaattttaacgcttcaactgatggattattttacatgtttcctatttgaagtttaagttattaatatattttactgtacatatcttacgttcttaaaaatgtttgagggcactgccaatcttagagtttgaagtgatattaatagtcattcggttcaaaactttttcccaaagacaaaacatgtgaattgcaatgaagccaaagcattt

SEQ ID NO: 478542 - DNA, 2682 bp, Homo sapiens
cctgctcatgcagaccaactttgatatgatacatgaatggtaaatgagcactgatttcaatgtaaagtcagcaactgcattagtccctaacaagaaagtcatcatctccttccaagttttaaagtcaggcattgacttctccttcttagccatggatgttctatttggcatcttctttcaacagaaggccgttttgtttacaccgaaaatctgtttgaaaccaaaatgtctcattgtcaaagttgatgaccactgcccctgttctatgccaatgttctttaagttcaaaggcattgtcaaatatttcttaaatgttgcacaatggtctcagggcttccatacacgatatggatattcagaaagtattagaacagaaaatgggagcaggaaaagaaagaagagagtggaagatgaaagagagggatccgagatcaaggctttttctatgtaaatacacaaattttttgtacagcatgttaaatgcagtcaattatatgtagcacaaaatgcaactcatacaagcactccttctgaggcaatgtatattattacatgcattgaatataaactttaagtaatagttctaagaaggcaatagctaaaacaaagactttttgatttttttcatttttctttattctcttttctgttcttcatattatgtaatatttattgacatgatttcaaactcactgtttctttattatttcaaatcttgtctttatcatgtttagtctagtttgctgtttttatagctttaagctggaagtttatgttaccaatgtaagatgtttctagttttcagtacatatgtttacagcaataaactgctttctaaatactgttttagctgaatttcataagttttaatatgacatttttctttaaatttatctcaaattgttttctaatttcccttgcgatttcctcttcttttttttttttttttttttgttatttaggggtgtgttaattatgacatatttgtaaattttttctacttttatttcattgtggttagagaagatatagtttgtatcattttagtttttttacatgtagtgatacttgttttacggctgaacatatagttcttattggaaaatattctatgtacacttgagaagaatgtgacttctgctgttgttaagtgcttggtggattcatttaaatacattggttaaatttacttcatatgttatgtttcaggtcttttagttctttcttgatctgctgcatcattttctatcattattgaaagaaatattgaagtcaccaaatgttattgcttaatttcatatttctctctttaattatgtcagtttttactttctgtatttggggttgtgttggtagttgcatgtaagttttcatcagttatatcttgattgattgacattataatcacaataaaattatcctcatctctagtaacaatttatattgtaaagtatatttttcttaaattagtacagcccttccagctctcttctgtttactgtttgcatgttatgtattttccctcaacttatttacaatctacttgtgattttgaacatgaatatgactcttttaaacacctaatatttgggtgaggctttttattcattcctccaatttctatctttttaattggagtgtttaagttatttattgataatgaaatagtgataaaataagattcatgtctgtcattttattacttgttttctggtcttaggacattttttattattacattcttctattactgcctcattttgtatgccagcgaaattttatcagaagtgacaccaacaaaatgctagagcagatagctccaagattctgttcttccacaaaggggctttgaaaaacttgcagctacttttagagctaactttgtcagaatctggaacacagtcagatgtttagagcaaccaaacaaatgttgcatcaagaaaatgacatttcagaaatttaggtaaaactttgtggcatttttacttgcccttcttctacatcctttccagctcagtggcattgctgaagattccaacctatcctctcagtgtgaaaatccttgtccctgattaaggagaaagcaaagtccaacttatttacaaggtattatatatatatataataaatatatatatatataatatttatatatataaaaataaatatatatataattaatatatttatatatatataaataaatattatatatatatattttctaacttgcataggagctaccagaaggactgatgtaaagtgaacatgtccattttgcctaagtcatggatcacacagttcagcaacatgttagacattgcttaaaaatattgtaaggtgaacaaatacccccaaaatgcatgacacaaatgattatagttgaggaaggatacagtttctaaggcccagggagaaaagctggacagagtttatttgggaaattagggaatacataaacacttagaaaattatatacatgccaaggttatgatgtgtaatcataaaagaccaaagaagaccctatgctttcaactccagttaatgattaagttcagtgcaagcttggctaagtcagcacagaatcgatcttcaaagagtgtgagaagtggcttactttgttttgctttgctttttattagtttaaactctttcagctcttggcattcaaagataactgtc

SEQ ID NO: 478543 - DNA, 1580 bp, Homo sapiens
gtactaaagggctctgatgctgtcttggtgatctctacactgggtgttacttctgctggctgtgtgaccttggaggggttgcttaacctctctgagccacaagtaggccgatgacatcttctcacctgctgcccaccctcctcctctgttttgtccacagggtttctcaatggactgattgccagaggttggggtgtcaagaatttggggtgtcaaggaaatggacaaagctctatgaccagaacaagcactttggggaatttaaatttgctttccctgacacgactccactgtcatcactacccctgaacttaaggggcatccaaacctcagtctcagcaggtgtgagctaccgcgcccagccaaaagtttatgtttttaagagaaatgtgctgaagcactgggctcgagtgacagtatggtggtttattctgaaagggctcagctgtgtgtgcaagagtgtatgtgagtgtgtgtgtatgtcagcatatgtgtgtgagtatgtatgtgtctgtgtgaacgtgtacgtgtgtgtatgtgtatgtgtgtgaggatggtgtgtatgtgtatgtgctgaagtaaatatgactgaacaataagaatcgtcgatctggttgtttggtacatgagtattcatcttatttctttttcactttttctgtgcatttgaaagctttcataggaagtcagaaaatgtatctggttgttaaaacaatattgtaacgtacacacacagtccatttccagtcccagaattgagacagttagtgcagaggccactggctcagctgtggaaaccagactgcacggtccatctgcacccatgctgtctgtgagccctgggaatgtcgcttcctgtctctgggcctcagtttccttctctataaaatgggctgatgctgttcctgccacagaggctggtgggattcaggccacataccccggcacatcagcgttccgttgttacacatttggatactcccaagccagttggtaaacagttgactctccgggaccccttgcacgtctccacgactcagcaatcaacgtggagctgaactggctgtgaagcgttttgagcactgcccgtgtttgtctcacagccctcacgggaatcccggttaatatactcaatgagcggggccctgaaaaccccgcctgccacctcgtaagtgttctataagcgtttgccattttagtaagtccttgtatttttatccaatctttgttttatgttaaaaagatagatggaaggttaacgttgaagtaattaacttcttaatggaagtgtagaattacaaagtaattgaaaagaagaatagatgagatctgtgagagtttcttgtctttctgcctcatgctaaaatgtaagctcttgttgtaaacgaaagcctgcgtgcaaatggtttgcaggctgattagcgaatctggggcacggagctatccaggagctctcactgtcgatttaacatccacgcattttatgtagcttcttgatgctgatgttggtaagagacgctaaattgtcatgggcattatgtggaaaacccgtagatgatttctggagcacaaaagccaaa

SEQ ID NO: 478544 - DNA, 1042 bp, Homo sapiens
ccagctcctggattcatttttttgaaggcgttttcttttgttcccttgctggcgaggagttgtgatcctttggagaagaagaggcgttatggcttttggaattttcagcctttttgcgccagtttcttccatcttcatggatttctctacctttgttctgctggttttcgtgtcacttgacactgtttttaggcacaggcacattgagcattgtcatgcctttgtggagaactggcctctttatcattatgtcatgtccttctgtgtcctggaggagatttcttgtctgaagggtgccctgtctggtgttaatgcagtgactgcagcttgctttggattagtgttagcatggtttacactgctctatgagctgcactgtgcccctggggagactgcagagcaatactcagagtatccaggcaaggagtgcatagaaagaaggtgcagagacatgaggcagcaggatttctcactgagaggggtgagactagctggtcacaggcaagagaaagaagggcaggtgcaactgatcaaggaggtggaaggcagggagcaactgctcagagtggtgacgtgtggtccacctccccggactggtccaccttctctaactggtcacttccccagactggtctacctcctggactggtccaccttctctaactggtcacttccccagactggtctacctcctggactggtccacctcccgggactagtccacctcctcggactggtcacctccccggactggtccaccttctccaactggtcacttccccagactggtctacctcccggactggtcccctccctggactggtcgcctccccggaccggtccacctcctagaccggtcacctccctggatggactggcttgcactgcttcctggcagttgcaggctcactggggactggaacccacttgtcctcctggagtttcatcaccaagtccacatcccaccctgtctcactggagccaggatccataaggtcccgtgagctaatgtgcgtctcttttcaatgcaactcaaaagagc

SEQ ID NO: 478545 - DNA, 3773 bp, Homo sapiens
tctgtttcctcttttggtgtcccctgaactgtgagcctgtgagatgtacacatcagtatttcctgtgggggttccccaatcaaaggagcttccaggcctgcgggtgtggcacttcgttgagccgcagccgctgcagctcgtcgaacttcatgctgacgtcctcaatggagagctgcagcatgtcccagtagccggccaggtcctgcgacgtgtggctcccttgattcagtggggatttaaaagagtcagaggaggttctggtgggtcaacattcaactggatttgcttatggtttcagcagtgcacactcagcatgctcagtgaagagcatgctgaacggacagctctgcgattcctcacccagagccaggacctggggcccccagctgccctccgcgcggctgagcccggccgggcacggctgtgcctgatggtgtgggggaagcggaatggcttctcctccctcgcccgcagctgggtggtcctggtcacatctcctgggggatgaaggaggaacatggccggccactgtggcagaggctgcctgagagcaggcatcgccttccccaaactcatgcagggcctctttccttgtgaaattgccgtcttttaaattcacacagctctgtggctctggcatccggcgtccattggataggaacttcggtgccccgtgtggcctggggcagctctctgcctgtctcaggcaccacccctccctgtaccactcttccgccccaaacgtgtcaaagtgtttttctactaatcctgaatagaagttgaaagaaaaggatgtagccaagccagctattttaaaattcaaaaggcataacaaatattaggatgaacaattttaagccaaatattagctatttctggcagagcagaaaggaacatttagcaggtctgaatatgcaccttgggctgtgtgtgggaagctttggatgagcattcctaaagacagtgcctgcctaggctcacgcgagtttgcataatgttacacagagttcgtcagtggcccgaatcaattcctttaaaggtaataatcaaatagatactatggaggaggcaagaacgttcacaggtgacatggcagctgaatgtttacacagttacaggcttctttcgaggcactcaaaacctttctatttccctcttttaaatgatgattataactttgtcagagtgatgtgttggtgactctttaaaatcgccgtgaacttcagtggggttgattggaaagtattagagaaggcatactttttaatgatcctaaggaaaagacatgagatggcaactctggcttgcttgtgcatcctttgatgtgtaagaatattcttatgtctccttgcacgtgaaaaagccaaggaaaacatcatcaaaacacctggcaccattgctacgcgaggcctagagaagacctatttgcatttgactgaaaatgtttggtctgaaaagaaatcgatgtatgtattataaaacaacttattaagtagcataactattatttactatttctcaaaatagtgaatactttagtcagccaaggaaaagtatacatgtatgtgtgtaggcaaatatatagtatatataaaatatattaacatgtatatgtaaacttagatatacagtatatatagaatgtatatgtatgcatgtgtgtaggcaaatgtatatataaaatatattaccatgtaaacttacatgttttatatatactgtatatttgcctacacacatactatatattttatatatactatatatttgtatttataaaatatgtagttaatatgttatatatttgttatatgttaatgtttagcatgtatatataaggatacataagtaaaatttcatatacatgttaatatatatgtttatatataaatacacctatatatgtttatatataggtgtatatataaacatatagatgcatatgattataatcttgtatacatctaatatatatgagatgtatatatgagcttttctgctctgccagaaatagcaaatatatatttatatattaatatgtgtatatatatttatatataagcatatgtaagtatatattaacatgtatatatgtaagtatatgtaaatatatatgtggtttttctttttgtttgcttgtcaggaataaccaagtttaacgtcaactgtattaatcatctagttcatggtatattcgtttcactaccgactataaaatacaaaggctaaattatttgcaaaatctcttcttaatctcttcattgtagttgtttatgtatttttaattccaggcaccttagatcattttcttcatttgtgacattagccgtaatagaaatttcccttgtttctcctcttctaagatgctctggtggggcatccagttgcaaagacacagtgtcacgccgcgctgctgcagcccgcctcttcctgttctccactcccccttgcagcctccctgcctcggtactgcttaaaccagggccatatccacctccctgcctcggttcttccacaacagctcttcccccaaacattccttaacagtcagtcctagagacagttactggtgagattcattgcacacgatccagaaactggcatcctgctgcccaagccagggtgctgcagtgtctcctccttagcccgactttcgggaaaaagaaccgcatttcatgggcacaaagggtcttaatgttcatgtaataaaatgctatgagccagttgaaaatgacgttgcagagataaccttgatttgaaagggcttatggcacgccgtgacccagaagtcaactacacagcagtgtgtgcggtgcctccctcattttttagaacatgaaggtctggcaatctgtaccatgtgttcttcaaagtgattttctcctgggtaggataatggacttaaaaacctatttttctgtcttgtcttatttttctaaaatgaagattgttttgctccccaaagttttattatgaaacctttcacacatgcagaaaatgggaaagaagagtataacccacagctccctccccattccgtggagacggcagtaagtgttgtcctgtgttctctcttcctgaggcctttacctgcgaccaccttgtagacccagggccactgtcacccccacgaaggtgacaatagttcctgaatatcacctaattctccattgcttctagggtatgaaaaagatgaaaaaagcataacttttaataaaagcaagtaactcggataacactttggcattgtttctgtcttgaaaagaaggatggaaggttgtctgtcgggcatcttaacaccggggccttgtgccgttcacaaatccacttcaagacaggctgctcttccttggatctgatttaccagccagcctgggaacagagaagggaggggaggactggagaaggaagccaggagcccctggccacatggcacgggatggagctggcagggctctgagttggggtgagtctgggggtgaggggagtggaggggccgctgcagtcggtcgagaagcagctggaggcggtggggtttgagtggtttcttgacaggggtgacagtgaaagctcctcatccttcctgtgcattccactgcccccaaaatgaacgtgttctgcagccctggactcgctgatgacgaggggaggaatcatctttgcttttgaaatgttgaatttctatttcttttgtattctaaaacctgggtaattaatgaagatatttaaagggactattttaagtaagtcgttgctgcagaaatatatagaag

SEQ ID NO: 478546 - DNA, 1221 bp, Homo sapiens
ccggctgtcaagagacctgttcaatctactagatgctaaatcttgccgccgctgtgttccgggcacacgtgtggtctggcgccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacaaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccagctgtttcagatgccacccgtgagagggaccatgtggcctctgtctgtgtgcgccgggctcatcctgctttgcagtttcttccagctcacctgtgttgtggagaatggcagatctccttctttcaaagactgagtagtgtcccctgtgtatgtaccgcatcttctttatccatcatttgccgggagactcgaggattgacggcacgctatggctttgt

SEQ ID NO: 478547 - DNA, 718 bp, Homo sapiens
agcagaaaagggaatgaataagatattggttctcgggtatgaaatgagaggcagttttcatggttgtcggcatggtgctgatttcatgtggttctgctaacaatcccaggaagtcgtcagtcactacccatgactggcagatgacaacattactgctccaagaaggtgactttcccaagttcagatggcttgtaggtgcccaagttccagccagaaccacggtgccctggcttctgtctcttccactccatcaaccaacagttctcctgaatactcagggtgcctccacctgccctaggtgcttgtcctgctacaccgagttgactgtcacaaacggtttaattcctttaatggagaaactggggctaatgctactcatgtgtcatgacttttacattatagccgacacactagactctcaggtgagcctcggagaggatggcaacgtgtctgccacgcaagggatgtcagagcagtgcttgtggtgcttgtgctggctgaccaccaacaccatccatccacagcaccgtccatgccctagtcatccaggcttgggccctgagagccggcacagggcagcccactgtctgccttcaatgccctgcaagtctctggcacacatcgatgctcaacaatgtgtcctaagtggagatatgtgagaattctgctcagagctcacctcctcttgcaacaccagggccgttgcaccaaggtggac

SEQ ID NO: 478548 - DNA, 1576 bp, Homo sapiens
tgatcatgttgtcaaggctctgataagacttggagcctaatgtttctctttccaattcctaaacagattttggggttcacctttgctcatgtgacctactgtcttacactaaacagcccttacatctatggaagatggtcatctactgattgtcctacactagacagaccttacgtccatggaagatggtcatctattgattgtcttacactagacagcacttacgtccatggaagatggtcatctattgattgtcctacactagacagcccttacgtccatggaagatggtcatctactgattgtcctacactagacagaccttacgtccatggaagatggtcatctattgactgtcttacactagacagcacttacgtccatggaagatggtcatctattgactgtcttacactagacagcacttacgcccatggaagatggtcatttattgattgtcctacagtagacagcccttacgtccatggaagatggtcatctactgattgtcctacactagacagcccttacgtccatggaagatggtcatttactgattgtcctacactagacagcccttacgtccatggaagatggtcatttactgattgtcctacactagacagcccttacgtccatggtagatggtcatctactgattgtcctacactagacagcccttacgtccatggaagatggtcatttattgactgtcttacactagacagcacttacgtccatggaagatggtcatttattgattgtcctacactagacagcccttacatccatggacgatggtcacccactagggaaatttattttcggttccacagtgtggtgaaaatgacgatgctttttcctcacctgcagaatgagaatgcgcgtcctgtgaccttcatgtttgctgtggcgttaagcatattgaccaaggcaccagaacgcagggagcccacgcagagtgacaggtgggaggcagttcctttccttgtccctccttcgtcgtgttcaacccttggacctgccacaaaactggaccttcccatccttgacagcactttcacggagtggcccaggcatcacaaactgatgacgtttctcagctcttcagaggatgcaacaatacgttcgtcacgcactgcagagttcctctggaagcctgacatctggggcaacgaggctggcaaggtcccgacagcggaccttcacttcctatgagcctggaagccacacttcacagccacaggctgacctccaaacacatcagcaagttatcgctgttgtccagggaaagccagcctgtttctatttaattttccatctaaatcacaaatacctcccagggacaaattccgactccttttcgaatgcccatttgcacgggagcgtgcttgtaatttacaggcagttaaaggggcaaatccttacaaaaaactcttcagaatctaaaattacagaagtctgtgttttcagttactgcaatatgcaaataaattagttgtcatggaaatcatgttcgggaaacacatgaagttaacgtggacatctgtctggagtattacaccgactcctctcc

SEQ ID NO: 478549 - DNA, 2143 bp, Homo sapiens
tgtctccctgtgctgaaactaaaaatgaagagccagcagcccacggtagtggaggagactgtgagagaggatgcctcctccccaggagcatatggcttcctattaactgaagaactgcaggttgcaggggacgtaactccagggagccttcccagaggaggcaatcagagctgggcatggaaggatgaccggcagcaaggaggagacggtgaacagccgacttcaagtcagaggagcgaggaggaagaaaattgtcaggggaacaaggctttccgggggcagatcacgaaggatctgcactgggatcaggcaaacccctgcaaccagcgcgtggagggtctcaaacagaaagctgagacctctggttcagatgctgaatgggtcagtgcgtctcactttctgcatggctgtaagaatttccgcaaatgcacggtcatgcagccaccaccaaaaccgagacatgcagccctccctctcactgcagttctaagttcctgctgccctcttctttcagagccatgcttaaagaacttcctttcttaggaagccgaggagggtgggccatttcaggttttatctgtatccttcacttctggtagtttgactgtggtgtgtacatgtgtgtggggcttgtctgtatccttcacttctggtagtttgactgtggtgtgtacatgtgtgtgggggtttgtctgtatccttcacttctggtagtttgactgtggtgtgtacatgtgtggggttttatctgtatccttcacttctggtagtttgactgtggtgtgtatgtgtgcggggttttgtctgtatccttcacttctggtagtttgactgtggtgtgtagacgtgtgtggggttttttctgtatccttcacttctggtagtttgactgtggtgtgtacatgtgtgtggggattgtctgtatccttcacttctggtagtttgactgtggtgtgtagatgtgtggtgttttgtctgtatccttcacttctggtagtttgactatggtgtgtatatatgtgtgggggtttgtctgtatccttcacttctggtagtttgactgtggtgtgtagacgtgtgtgggggtttgtctgtatcgttcacttgtggtagtttgactgtggtgtgtgtatgtgtgtggggttttatctgtatccttcacttctggtagtttgactgcggtgtgtatatgtgtggagttttgtctgtatctttctggttgactgtggtgtgtagatgtgtgtggtgttttgtctgtatccttcacttctggtagtttgactgtggtgtgtgtatatgtgtggggttttgtctgtatctttctggtagtttgactgtggtgtgtagatgtgtgtggagttttgtctgtatccttcacttctggtagtttgactgtggtgtatatatgtgtggagttttgtctgtatccttcacttctggtagtttgactgtggtgtgtatatgtgtgtggggttttttctgtatccttcacttctggtagtttgactgtggtgtgtgtatatgtgtggagttttgtctgtatccttctcttctggtagtttgactgtgttgtgtcgatgtgtgtggggttttgtctgtatccttctcttctggtagtttgactgtggtgcatatatgtgcggggttttgtctgtatccttcacttctggtagtttgactgtgttgtgtagatgtgtgtggggttttgtctgtatccttctcttctggtagtttgactgtggtgtgtagatgtgtggtgttttgtctgtatccttcacttctggtagtttgactgtggtgtgtagatgtgtgtggggttttgtctgtatccttcacttctggtagtttgactgtggtgtgtgtgtatatgtgtggggttttgtctgtatccttcacttctggtagtttgtggtgtgtgtagatgtgtgcagggttttgtctgtatacttcacttctggtagtttactgtggtgtatagatgtgtggggttttgtctgtatccttcacttctggtagttcgactatggtgtgtagatgtgtggggttttgtctgtatccttcacttctggtagtttactgtggtgtgtagatgtgtggggttttgtctgtatccttcacttctggtagtttgactgtggtatgt

SEQ ID NO: 478550 - DNA, 3150 bp, Homo sapiens
agttcacccctctctcctctccatctcatcagacgcccccacagttcaccctctctcctctccatctcatcagacacccccacagtccaccctctctcctctccatcccagaagatgcccctccagttcaccctctctcctctccatcccatcagtcgcccccacagttcaccctctcctctccataccagcagacgcccccacagttcaccctctctcctctccatctcatcagacgcccccacagttcaccctctctcctctccatcccagaagatgcccccacagttcacccttctctcctctccatctcatcagacgccccacagttcacctctctcgtctctattccagcagatgcccccacagttcacccctctctcctctccatctcatcagacaacccacagttcaccctctctcctctccatcccagaagacgcccccacagttcactcctttctcctctccatctcatcagatgcccccacagttcacctctctcctctctattccagcagatgcccccatagttcaccccctctcctctccatctcatcagatgcccccacagttcaccctctctcctctccatctcatcagacacccccacagttcaccctctctcctctccatcccagaagatgcccctccagttcaccctctctcctctccatctcatcagacgcccccacagttcaccctctctcctctccatctcatcagacatccccacagttcaccctctctcctctccgtctcatcagacgcccccacagttcaccctctctcctctccatctcatcagacgcccccacagttcaccctctctcctctccatcccagcagacgcccccacagtttaccctctctcctctccatctcattagacgcccccacagttcaccctgtctcctctccatcccagcagacgcccccacagtttaccctctctcctctccatctcatcagacgccccatagttcaccccgtctcctctccatcccagaagacgcccccacagttcaccctctctcctctccatctcatcagacgcccccacagttcaccctctctcctctccatcccagaagatgcccccacagttcacccttctctctctccatctcatcagatgcccccatagttcaccccctctctcctctccgtcccagaagatgcccctccagttcacccctctcccctctccatctcatcagacaccccacagttcactcctctctcctctccatcccagaagacaaccctccagttcacccctttctcctctccatctcatcagacaccccacagttcacccctctctcctctccatctcatcagacaccccacaattcaccctctctcctctccatctcatcagatgcccccacagttcacccctctctcctctccatctcatcagatgcccccacagttcaccctctctcctccccatctcatcagatgcccgcacagttcacctctctcctctccatcccagaagacacccctccagttcacccctctctcttctccatctcatcagacacccccagagttcaccctctcccctctccatctcatcagatgcccccacagttcaccctctctcctctccatcccagaagatgcccccacagttcacccctttctcctctccatctcatcagatgtccccacagttcaccctctctcctccccatctcatcagatgcccccacagttcacctctctcctctccatcccagaagatgcccctccagttcaccgctctctcttctccatctcatcagacgccccacagttcacccctctctcctctccatctcatcagacacccccacagttcaccctctctcctctccatcccagaagacgcccctccagttcacccctctctcttctccatctcatcagacatccccacagttcaccctctctcctctccatctcatcagacatccccacagttcaccctctctcctctccatctcatcagacacccccgcagttcacccctctcctctccatcccagaagatgtccctccagtttacccctctctcctctccatctcatcagacacccccacagttcacccctccctccatcccagcagatgtgtcctctcttcatccttctctcctctccatcccagcagacgcctccacagccagcctcttgggcattacagcgtctgcacctacactgtggtgaacatgtgaaatccaactgagccttctcaaagcttaggtgggaatggtcaactcagaaatcaattttaaaactaagacaaatgaggaattggattaggagaacatgtttgggatatgaatattcacctgctacacgttaaaaatgctgatatttaaatgtgcctagattgaaagagcccccaggagtgaacattatgaaagggctgtgcgtaatggaacaggatgcagagacgacatcatggtgccagccacagtcatagggggtgctgggcagcagtgccatggggtgaagatctacctgccctccacagagcagtgccatggggtgaagatctatcctgccctccgcagaacagtgccacaggtggacaatggcatgggggccataggcagagtggatttgtgtctgctgagtgggcagtggcatgggggccacgggcagagtggatttgtgtctgtggacaatggcatcggggccacgggcagagtggatttgtgtgtgctgagtggacagtggcatgggggccacgggcagagtggatttgtgtctgctgagtggacagtggcatggaggccacaggcaaagacggatttgtgtctgctgagtggacagtggcacgggggccatgggcagagtggatttgtgtctactgagtggacagtggcatgggggccacaggcagagacagatttgtgtctgctgagtggacagtggcatgggggccacgggcagagtggatttgtgtctgctgaatggacagtggcatgggggccacaggcagagacggatttgtgtctgctgagtgggcagtggcatgggggccatgggcagagtggatttgtgtttgctgagtggacagtggcatgggggtccacgggcagagtggatttgtgtttagaacaggagtaacgtaggcagcacatctcaccca

SEQ ID NO: 478551 - DNA, 666 bp, Homo sapiens
tgcctgagattggcttctgttccttctccacaggcgccttttcaaccccgcacccccgagtgactgctgttccctcacacagataatggcaccactgcgatctagaaagacacccacagaacaacagtccctcgctcatccactccgccagtcaccggtgccatccacgcatggtgcctcttgcaggagactcacagacagtgaggaagacatgctgccctcagagctgacggtcccattttttccacgaactccaactccacgcatcagaagcacactagtcgcattctcgagcagctcaaacttcagcatggaatgttgtttcccaggcttttacagtccacagccactccttttctggcatcaaaatctgagcttggaaaagagacctgccaagctcaccaagactgagtacgagtggattccagtggcctccatggaagagccaccccgctgcgtcctcctgctgggggtggaggactgtgtggaggacagtgtggggaggactgtgtggaagaaggactcccagcctcccacctggctgttcaacggaggctctgccctgagtgggcttgtcaagaaatcctgaagaatatgccacagcttgaaactgctgaggaactcaacacctctgccctcctcaacgaagactctcagcgatgatgg

SEQ ID NO: 478552 - DNA, 639 bp, Homo sapiens
agtctccaggcgccacgtggagatgagcacacctgctgttggcttgacggacccagaagctgaactgctggacacttcaaaagaaaaagggaaattggaaaccttctggcttaggcctgcgactggacggctctgccccagagcggtgcccgccgacccagggtcctccatggtctgtgatgttttgatcacgacggctgaggcctttggtgagagcccagaacagccatccagacactcgaaggaggttcacgctgattcagagtcatcaggaaccacccttggcacaaacagcatgatgaccatcctacagataaggaaaccaaggctttcattacttgccccagatcataagagccagagcctggacttgagcaagtcaagcctgcatattacggcagatggaaagctgtgcagtctgcgtgttcaaagagcatttgcaaaaggcagccaagacaggctgtctgctgagcacattccaatcaaagggggaatttctcggtttccttaggaacagttcagcatcagcggagatgcggcggcggctcctgagccttgcagagagccacaacactaacagaactgcatttgtctcctcttgctcttccaactctaaataatatcttagcgtttcatgcc

SEQ ID NO: 478553 - DNA, 2741 bp, Homo sapiens
gtccacacctcttccagctctgagtgcccttagcggggtccctcatcgacacttcttccagctctgagtaccctcagcagggccccttgtcaactcccgtgttatcattccaagcttcgccactttctctgacctctcctctctgcagatcctctggcttccccgggatgctgcagccaccctccccactgactgggaggaagccacgtcgccttcccatcctcctcctccagagtcccctccccactgactgggaggaagccacgtcgccttccaatcctcctcctccagagtaccgctcctcccattatggcatttcccataaagaggtccacgtgcctcccgtcatgaagaggccctgcacttccacacccttagtctgtgggaccagagccctccccacctgcagcctctgctctcacagccctgacacctgaaccagagcctcctcatccacggcctctgctctcacagccctgacacctgaaccagcgcctcctcatccacggcctctgctctcacagccctgacacctgaaccagcgcctcctcatccacggcctctgcctctcacagccctgacacttgaaccagcgcttcctcatccacggcatctgcctctcacagccctgacacttgaaccagcgcctccccatccacggcctctgctctcacagccctgacacctgaaccagcgcctcctcatccacggcctctgcctctcacagccctgacacttgaaccagcgcctcctcatccacggcatctgcctctcacagccctgacacctgaaccagcgcctcctcatccacggcctctgcctcttacagccctgacacctgaaccagcgcctcctcttccacggcgtctgcctctcacagccctgacacctgaaccagagcctccccatccacggcctctgctctcacagccctgacacctgaaccagtgcctccccacccactgcctctgcctctcaaagccctgacacctgaaccagcgcctcctcatccacggcctctgcctctcacagccctgacacttgaaccagcgcttcctcatccacggcatctgcctctcacagccctgacacttgaaccagcgcctccccatccacggcctctgctctcacagccctgacacctgaaccagcgcctcctcatccatggcctctgcctctcacagccctgacacttgaaccagcacctcctcatccacggcatctgcctctcacagccctgacacctgaaccagcgcctcctcatccacggcctctgcctcttacagccctgacacctgaaccagcgcctcctcatccacggtctctgcctctcacagccctgacacctgaaccagtgcctccccacccactgcctctgcctctcacagccctgacacctgaaccagagcctccccatccacggcctctgctctcacagccctgacgctgtgagacgctgacactagccccagcccgcacgcactggctgcatccacgtctggccagtgagtctccagcagctctgcgcccaccgtgtttgctcacgcgctggggacctccacgccttgatcgctaacccacccgtaaccctaactgtggggctccagacccccaggtgaacctactcacaggacatctcggcttccagcgccatcaaatccacaggctcttagactgacatcactggcctcctggacaatttcatgccttttcctggttccgattgtggcacagtggtgcagttcagtggcgtcagatacactcactgccgtgcaaccacgaccaccgtccttctccagaacctcctcagttctgcaaactgcccctcagcccccgtgcaccagactgccaatcttaatgctgtgatgtgtgtctccaggggccgggcacaggccggggtaactgtgcaccaagttctcaggggccgggcacaggccggggtaactgtgcaccaagttctcaggggccgggcacaggccgcggtaactgtgcaccaagttctcaggggccgggcacaggccggggtaactgtgcaccaagttctcaggggccgggcacaggccggggtaactgagcaccaagttctcaggggccgggcacaggccggggtaactgtgcaccaagttctcaggggccgggcacaggccggggtaactgtgcaccaagttctcaggggccgggcataggccacggcagaggagagtgcagcgactgtgcagtcacaattcttgctttttccaggaaagaaattaaattctgaaaatggcatccaaggccacttcatcccttaacttttatgaatcctttggtcacagtaactttcactttaaaaaatacagacctggcctagtaacctaatgaattctgacctaattcttctattaattgatgcctaaataagtgtatactgtttcccaacgtctgaatgagccagtgaataacgaaaacccctttcttgttggggtcacatattttatcactaagtacagacaccaaaaccccagacatgcatttgtgggtctccttcatgaatgtaacacatcggagaagagaatgggagtgaaatgaccttcctgtcagagtccaccgccaaagacatctgccgctctctcacccatgaagagtgaagagattcattagtttactctgctggaaagtgctcgctgggagctgctggtggtcatctgaccaggagtttaattcatgcttcttgttaatgtcaagttaatataggctctgac

SEQ ID NO: 478554 - DNA, 2500 bp, Homo sapiens
ggttcattcacagaataaacaggtcctgtctttacagtaatggagtaatgcctgcaaatgtcgtactcggggccctgtcgtgggtccatgtattcggggccctgtcgtgggtccgtgtactcggggccctgtcgtgggtctttgtactcggggcgctgtcgtgggtccgtgtactcggggccctgtcgtggggcctgtgccgtgtagaatctgtagctgcacacttcgcccagtctcccctcgagctacgtgcccaggcattgtgggtggctggcgggtctgtgcagacaacagccttcagggtgccacctgcattgccctcacacctcgcacatggccgggacacagctgtgaatcctccagagaggtctagtgtcactttctctgagcagctgctctccagattaggtggccatgtgggtaaaagaagaaataaaaacatccccgactacttcatgctcttgtggcgtggaaaggccgcgcgggtcctgagtgtgcgtggaaaggccgtgcgggtcctgagtgtgcgtggaaaggccgtgcgggtcctgagcatgtgtggaacggccgtgcgggtcctgagcgtgcgtggaaaggccgtgcgggtcctgagcgtgcgtggaaaggccgtgcgggtcctgacagtgtgtggaaaggccgcgtgggtcctgactgtgcgtggaaaggccgcgcgggtcctgactgtgcgtggaaaggccgcgcgggtcctgagtgtgcgtggaaaggccgtgcgggtcctgactgtgcgtggaaaggccgcgcgggtcctgactgtgcgtggaaaggccgtgcgggtcctgacagtgcgtggaaaggccgtgcgggtcctgagtgtgcgtggaaaggccgcgcgggtcctgactgtgcgtggaaaggccgcgcgggtcctgactgtgcgtggaaaggccgtgcgggtcctgactgtgcgtggaaaggccgtgcgggtcctgagtgtgcgtggaaaggccgtgcgggtcctgagtgtgcgtggaaaggccgtgcgggtcctgagtgtgtgtggaaaggccgcgcgggtcctgagcgtgcgtggaaaggccgtgcgggtcctgagtgtgcgtggaaaggccatgcgggtcctgagtgtgcgtggaaaggccgtgcgggtcctgacagtgtgtggaaaggccgcgcgggtcctgactgtgcgtggaaaggccgtgcgggtcctgactgtgtgtggaaaggccgtgcgggtcctgagtgtgtgtggaaaggccgtgcgggtcctgagtgtgcgtggaaaggccgtgcgggtcctgactgtgtgtggaacggccgtgcgggtcctgactgtgtgtggaaaggccgtgcagatcctgagtgtgtgtggaaacaccgtgcgggtcctgactgtgtgtggaaaggccgtgcagatcctgagtgtgtgtggaaacaccgtgcgggtcctgactgtgtgtggaaaggccgtgcagatcctgagtgtgtgtggaaacaccgtgcgggtcctgactgtgtgtggaaaggccgtgcgggtcctgactgtgtgtggaacggccgtgcgggtcctgactgtgtgtggaaaggccgtgcgggtcctgagtgtgtgtggaaaggccgtgcgggtcctgagtgtggaacggccgacgtgcgcgtcctgcgtgtggcgtggaaaggccgtgcgggtcctgagtgtgcgtggaaaggccgtgcgggtcctgactgtgtgtggaacggccgtgtgggtcctgactgtgcgtggaaaggccatgcgggtcctgagtgtgtgtggaaaggccgtgcgggtcctgactatgtgtggaaaggccgtgcgggtcctgactgtgtgtggaaaggacgtgcgcgtcctgcgtgtggcgtggaaaggccatgcgggtcctgagtgtgcgtggaaaggccgtgcaggtcctgactgtgtttggaaaggccgtgcgggtcctgactgtggaaaggccgtgcgcgtcctgactgtgtgtggaaaggccgtgcgggtcctgagtgtgtgtggaaacgccgtgcgggtcctgactgtgtgtggaaaggccgtgcggatcctgactgtgtgtggaaaggccgtgcgggtcctgagtgtgtgtggaacggccgtgcgggtcctgactgtgtgtggaaaggccgtgcgggtcctgagtgtgtgtggaacggccgtgcgggtcctgactgtgtgtggaaaggccgctgtgcgggtcctgactgtgtgtggaaaggccgtgcgggtcctgactgtgtttggaaaggccgtgtgggtcctgatcgtgtgtggaaaggacgtgcgggtcctgagcgtgtgtgtggaaaggccgtgcgggtcctgagtgtgtgtggaaaggctgtgctcctcctgtccccagcgactccccctggggcttcctcatggggccatctcttcctctccccagcgactctccctgtacctgcccttccctccccttcctggggtcaccgctgggtctcagctctt

SEQ ID NO: 478555 - DNA, 1051 bp, Homo sapiens
gtgtggcctgcactttatcccttggccagcagatgggctaatggggaacatctgctgtttccattttctggctaagcaatgctgctgtggacacttgtgtgtgagtttctgtgtagacatacgtcttcatttctctgggatgaatgcttaggaatacacacactgggtcataagaaaccactgcctaaccattttttggggggatgaattaatgcatgaatcaatgaggaacccaagcatgccatcttcctcctcctcttcatcaccaccaccattatgatcatcatcatcatcatcactatcatcagcatcaccatcatcatcctcatcaccactatcatccccatccccatcatcctcaccattctcaccatcatcaccatcatcatcatcaccatcaccatcatcctcaccatcaccatcatcaccatcatcctcaccatcaccatcatcatcactgtcatcctcacccccatcatcctcactattaccatcatcaccatcattctcaccatcacatcatcctcatcatcaccatcgccaccaccaccatcatcctcatcatcaccaccatcatcaccatcattctcaccaccaccatcatcctcatcatcatcaccatcatcaccatcattctcaccaccaccatcatcatcatcaccaccatcatcaccatcattctcaccaccattatcatcctcatcatcatcattatctatttcttcttcacctcctcctcctctctatcttctcatcatgtcacacactgtcattactggttactatgtactgatcaccaatgactattctagagactcattgcctctgctcctcactcccatatggtcaataatatcttcattttagggtgggataacttgtacttagaaaatatgaattgctcaatgtcattttgctagtgaaaagcatgtttttctgattccagaatcaataccttttaactactccttaaattcctttgcagtaaacattaggaaaaatgtgtgtatgtattaaatgaacaacagctcttaagtagtttattaaaaga

SEQ ID NO: 478556 - DNA, 2003 bp, Homo sapiens
aagaagcagctctccttccacattgaatgtggcctatcttggcgaatgttctgtgcgagcttgggaagaatctgtgttctgctgctgttggatgaagtagcctacagatgtcagattcagttgattgatggtatcactcagttcaaccctgtcattgctgaatttctgaatttctgcctgctggatctgtcaattactgagagcagatactcaaaatctccagcattaatggtggactcatctattcctcctggcagctccacaatgtcatctgtaccatatttaactgtagacactttcctctacctgctcaaatctgctgctgaacctctagagcgttctgtcctgaggcacttcttccacacgtaccctggcttgcaacgagcccagggaccacttgaggtgaaagctgcaggtcttcctaggccttttctgaacacgcacattgacctggtgtatgcacagctttgctaaatgttcttctttcacccgtctaggccccattttgcttatacatccatttacgtgtctattgcacacgtgggctgcttccatctttggctactgtaactaatactgcttgagcatgagtatacaattatctgagccctgcttccacttcttttgggtgtatggccagaagtgaaatttctggggcataggaaaattccatgtttattttttgaagactcaccatatcattttccatgatgggaacatctttctatattctcaccaaaaatgcacaaggtttctaacttctccacatccttgccaacacctgttcttttcttttcattgttgttgttttacaatgaccactctaatgtgtgttggcatttccttgtggtttagctttgtattcccttaataattaatgatgttgctgtgcttattggtcatttgtgaatcttcttggagaaatatccaagtcctttgcccatttttgaatcagattattttgctgttgtagttatttaaatagtgtaggtatcagtccattttcagattgatatatgatttgaattttgatatatgatatctactcccattccatccctttcattcagctgaaagtgtcccttaatgcacacaagctttaattctgatgaagtctaaattatgtatctattcttttgttgcttgtacttttggtatccaagatcactgtcaagtccaatgtcataaagcttatcctctctgttttcttctgagagtcttacaggtttagctcttatgtttaggtcttttatctgttgagtattgtttatatgtggtataaggtatgagttcagcttcattatttatatgttgatatccagtttctctaacataaattattgaaaacactgttccttctccattgaatggtcttggcacccttatcagaaatcatttgacaatatacaccagggtttatttctggactctctattctgttccattagtctagatgtctgtgattatgccagcacttaaccacactattttgcttatcatagctctgtagtaagttttgaaatcaggaagtgtgagactccaacttagttcttatttttcaagattgttttgagtatttggggtcccttgtaattccatataaattttagggtggatttttctatttctcaaaaacccaccattagtagttctgacatcttaacaacagtaagcctttcaatccatgaacacagatgtctttccgttcattagtgtctttaatgtcttataacaacattttatagttttcagtgtacagcctctctcctccttggttaagcttatttctaagaattttgggtttttttgacacgattataaatgcaattatttacttcctttttaaattgttcattctgatagtatttggaaacactagtgatttttgtgtgttaattttgtatgcagacactttgctgaatccttttttatacccttgtgtaggtgtgtgtgggtgggggggaatcttcacagttttctacatataagattatgtcatctgc

SEQ ID NO: 478557 - DNA, 800 bp, Homo sapiens
acccgaggctgcctgaccctggctttggacggtgggttcgaagggagttcctggggagcatgggtggtccctggacacactacatagccatgctgggtagccacagtcccgtgacagcagcaccttctcccaacctgaacaccgcccttctccctcctcctggtcaccgaatcagcgactgcacccagtcctgtgacagcagcaccttctcccaacccaaatgccgcccttctccctcctcctggccacgaaatcagcgactgcacccagcccacgtgacagcagcaccttctcccaacccaaatgccacccttctccctcctcctggccaccgaatcagcgactgcacccagtcctgtgacagcagcaccttctcccaacccaaatgccgcccttctccctcctcctggccacgtaatcagcgactgcacccagcccacgtgacagcagcaccttctcccaacccaaatgccgcccttctctctcctcctggccactgaatcagcgactgtgcccagcccacgtgagagctgctgattttggtttatggaggcagaaacccacgccaggctttccaaactcaggtctgtccaaatggtacccttgtgtttatgctctggagagagtcctttctgatccctaccgacccaaagacttgtgtggaaattatactgaataaaacccactggccacccagatgagtagggctggtctccaggtttgtatattgcagtctttacccataaagtatcttctctgattagtaaaaaccattctttactcttgattccaacccaaag

SEQ ID NO: 478558 - DNA, 1751 bp, Homo sapiens
aaccacttcttgagttctattttggcattggtatggtttggctgcgtacccatccaaatttcatcttgaattgtagttcccataatccccacatgctgtgggagggacccagtgagagcaaagagactggtggaattttgccctgccctagagatctgtggaattttgaacttgagagagataatttagggtatctggcagaagaaatttctaagtgggaaatcattcaagaggaagcagaacataaaagtttggaaaacttgcaacctgatgaggcaatagaaaagaaaagcccagtttttagggagaaattcaagcccactgcagaaacttgcataaaggatgtatggaaatgcctggatgtccaggtagaagtatgtgctgaggtggagccctcatggagcatctctgctagatcaatacagataggaaaagtggggtcagaggccccacactgggtccccactgaggcactgtgtaatgaagccatgagaagagggccaccatgctccaggcctcagaatggtagatccaccaacagtttgcactgtgcacctgtaaaagccacagactcaatgccagcctgtgacaccagccaggagaggattggacccacttggtaattcagcataatctgccaatctcaagtttagcccattagaaacatttattgcatgtgcagtcttaattttcttttgccatgtaaggtaacataatttacaggttctgggaattagagtgtggatacctttggagggtcattatttctgcctaccatctcctatatctgcctaccgattaggtttagctgtgaataatagagactaaaaataataatgatttaaataaaacaagtttattttcctatcacataaatgtcctaatacaatgattagcatttttatattatagatgttgaaacgaatactaataatttcaatgaatcatatgaactatggatattattaaaagatgactttgttttcattttaacaccagtgcaaatttctaaagtaggtttattctatgtgtatataaagttattacaaccagtcatttttattaagtttgtaaaaaaaaatccagtaacaacaaaaaactgagttctaaagggagacaggaagagcaaaagcaaagatcacttttgaatcatttgcattaacatcacatagcaacttgtaataataccaatgacaaaaacatgtttattaggaagttttaaaaaggtaatgagatttcttggctatttaaaatgcttatgagaaactgaagccctgaaaataccttagtggacaggaataataaactaattattggaaggtgacatttaatagggataatgtgattttaaaaatatgaagagacagtataaggacatagtattttaatggaaacatctatttaattttcttaagctgataggaggatttggtggtagtgtaatagccagatgctaattacaacctaatttgaatgaatagcatcatatagagaatattccttaaaaaatgtgcggagtgtggcactctgggctgttccttccatacctgaatataaagtacaattctggacacagtaacaagaagggcacatttaagctgaaacatttccagaagagaataaacctgaggatgaaaagtctgacactgtgccagttctgaaatcagaactgtgtgtcttgtggagataaacatatagggaatgtgatagccgtcttaaaatatctacagaatatcagataaagaacattt

SEQ ID NO: 478559 - DNA, 686 bp, Homo sapiens
ctctcatctgatgttttggctataccatcagctgtagcaagcagggatcctatgcagattttcaggtacttctcccatccaatgggttcactgcagtattgctgtattgaatttccacatgaggagccagcaatctacactgaaggagaatgtacctgtctactggcacaacgcagcaagagccctatgtatggaacaccttcaggccacaccctgaggaacagacaaagttatatgcagttcagaggaattccagaagaaggcattgttattacaggagatgatggctccgtgtgtgttgttgcccctgaagaccttccagtgggtcaagatatggaggtggaagatggtgatgttgatgagcctgaccctgtaatgtactcccatcatcaagggacacttgactgcatctgtatagcaactgaggttgtaacacggacaacatgtcccataattcaccttctttgggaaacattacctctcattgaaaaatcattatggctattatttagttttgcaactccttaacaactaggaagctaataagactgggtacaagaatttcaaatagaaatactaaagcaaatagttaagtttcacaggaaatatatcagacttaacgtggtaataagcattataaaaaataaaatctcacacagagcaaccatcaaaataataaaaccttt

SEQ ID NO: 478560 - DNA, 531 bp, Homo sapiens
cccccgccgccgctccagcgccgcgcagccaccgccgccgccaccgccgcctctgcttagtcgccgccatgacgaccgcgtccgcctcgcaggtgcgccagaactcccaccaggactcagaggccgccataaaccgccagatcaacctggagctctacgcctcctacgtttacctgtccatgtcttactactttgaccgcgatgatgatatcaagaaaccagactgtgatgactgggagagcaggctgaatgcgacggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgatcaagtgaccaacttgcgcaagatgggagcacccgaatctggcttggcagaatatctttttgacaagcacatcctgggagacagtgataatgaaagctaagcctcaggctaatttccccatagcc

SEQ ID NO: 478561 - DNA, 1889 bp, Homo sapiens
acggcagaataggaatagctccagtctacagcacccagcatgagcgatgcagaagatgggtgatttctgcatttccaactgaggtactgggttcatcttactagggagtgccagacagtgggtgtgggacagtgggtgcagcgcaccatgcgcgagccaaagcagggcaaggcattgcctcatgcgggaagcgcaaggggtcagggagttccctttcctattcaaagaaaggggtgacagacagcacctggaaaatcgggtcactcccaccctaatactgcacttttccaacgggcttaaaaaatggcacactaggagattatatcccgcacctggctcagaaggtcctaagcccatggagcctcgctcattgctagcacagcagtctgagatcaaactgaaaggcagcagcaaggctgggggagaggcacctgccattgcccaggcttgattaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctccaagcatgcagctggagatctaagaatgggcagactgcctcctcaaatgggtccctgagccccaagtagtctaactgggaggcaccccccagtaggggcagactgacacctcacacggccgggtactcctctgagacacaacttcaaaaggaacgatcaggcagcagcatttgcggttcaccaatatccgctgttctacagccactgctgttctgcagccactgctgctgatacccaggaaaacagggtcagcagtgcacatctagcaaactccaaatgacctgcagctgagggtcctgtctgttagaaggaaaactaaaaaacagaaaggtcatccacaccaaaaacccatcgtatgtcaccatcatcaaagaccaaaagtaggtaaaaccacaaagatggggaaaaaacagaatagaaaaactggaaactctaaaaagcagagcacctctcctcctccaaaggaacgcagctcctcaccagcaacagaacaaagctggatggagaatgcctttgacgagttgagagaagaaggcttcagacaatcaaactactatgagctacaggaggaaattcaaaccaatggcaaagaagttaaaaactttgaaaaaaaattagatgaatggatacctagaataaccaatacagagaagtccttaaaggacctgacagagctgaaagccaaggctcaagaactacgtgaagaacccagaagcctcaggagccaatgtgatcaactggaagaaaggattcaggaaatacagagaccaccacaaagatactcctcgagaagagcaactccaagacacataattgacagattcaccaaagttgaaatgaaggaaaaaatgttaagggcagccagagagaaaggtcaggttacccacaaaggaaagcccatcagactaacagcggatctctcagcagaaactctacaagccagaagagagtgggggctaatattcaacattcttaaagaaaagaattttcaacccagaatttcatatccagccaatctaagcttcataagtgaaggagatataaaatactttacagacaagcgaatgctgagagattttttcaccaccagacctgccctaaaagagctcctgaaggaagcactaaacatggaaaggaacaactggtaccagccactgcaaaaacatgccaaattgtaaagaccatcaaggctaggaagaaactgcatcaagtaacgagcaaaataaccagctaatatcataatgacaggaccaaatt

SEQ ID NO: 478562 - DNA, 1419 bp, Homo sapiens
tgtggtgtttggttttgcaacagtattcgagctctgctaagggtcagactgcctcctcaagtgggtccctgacccccatgtatactgactgggagacacctcccagtaggttccgacagacatttcatacaggaaaactctggttggcatctgtagtggacctccagaaaactccagcagacctgcagcagaggggcctgactgttagaaggaaaactaacaaaaaagggaacagcaccaacgtcaacaaaaaggacgtccactcagagaccccatccaaaggtcaccacatcaaagaccagagtttggctttcaaatggcaaacagtggaacctagattctcagttaaaattcctggcatccaatgtgggaggtgtgtcttgggtggtcctgtctgcctggtttccaatggatggagcaataggccatggaagtgtgccagaacttatctgttcacactaccagacaggatgacaactactcatgatattttgcttctctgcatggcctctgctgcttgtagtgctcagctggtgcaagggaaagcagcatctgaggagctgacggcctccaagactgggtattgattaatgaatattcttaatgaaacttcaaaaaggttttatttttaattatattacctgtttctttttgaacactttcagatttatatctaaaaagttcaacttttactctgtcttccttctttcagttttttctttccttgataattctctccaactttttgtaagcttcctctggatctaactattgttgtggcctgatgatgaaaagttttaccttgaagatctagaaaaacaatgttttttccccctgaataacttgattctatacttttggcttttctttacatgactaattttttcaatttatttaggacaattctcatacagttactaagaattatatattcccctgctatactcataaccttgaacacagtcttcctaggtttgatgaaacacaagtactttttttcatcagctttggtttccaagttatctaaatgagctttccataggagaagcaatcacactgcaagtgttttttttttttttctttttttttaataactggcctaagaaacaaagattttacattttatcaagataattcctgtgttgtcttctcaggtttttgatttcttaggaaaactgaactttaaaagagttaaggttttatattcgtgtaactttctgtattgatttttaaaagttttttattactattggttacatgaataactatatttcattggcctctgattccattttgatcacttattttggagcttttaacatctttgacaaacctcctcaaaataaaataaatattgctcattctttatattttttccagagacaggaaaatcttttttcttttaactatttatagctt

SEQ ID NO: 478563 - DNA, 632 bp, Homo sapiens
ctctgggtgactattttgggaatcaaaagttccatatagatgctttctcagtattactgctgtgagggcttcacctcaggtatcacagatgaaattggagggggttatcagacacttcccaaggcttatcatcagaggtggaggatgagaaagactgactgtatgcagagttcaaagtcagagaggtggagactgcatgtatatcctaccagacaggaaggatggggcagctctgtagctggcagagctcagagcagcatggagttttggggcctggaggctgtgctacaagaatactcaactgatgtggtgcccaggatgagtttggagtgggggcggggtctcctaatgtgtcaaggaggagcaggacaccaggtccggcctactttctgcaggcttggagcagcaggagagagaagtcaggatacaggcaggatgcaggtgagagggctcagagagaaaggctggcgatgacacctggagggggttcactctgggggttgtctggggaccctcttgcaggtgaagaggggtgggctcacctgcactcattctttttcatatttcccttaagctgggtaaaactttaaaattacttatgtaaaacacagtcctataaatacacaggaaac

SEQ ID NO: 478564 - DNA, 2908 bp, Homo sapiens
gtatgggaaaagaagcaaatagagttcagcagaagaggtaagaaaagaactgtcctccttctcccgggatctcagagaaaattcacctgagttcagtgtccaggtgacccaagctctgaatgcagtaacgtgcacggggagatgaggatgtcaccatgagcaagcctcccagacagcaaccgggagcaaccccaagacagggcagggggggctctgatgcagcccgcggcgaggagggctgcccgtgctgcctaaatgggttcagaatgaaggccgccctcccatcttcaacccggggtcggccacggagcctcccgccacctctaccccgtgtcgcaggcacccccgcgcccccggcacccccggacccccgcgcccgcgtcacttactcctttgccgtcgccacctgtctgggtgccggtctcctccctgcccggccgcggcgcgtcctccccgtcctcgcagtcctcgggctgtgcgcttcccccctccagcaacagccgcagcctcttctcttcgggagggacgtcgtcctcctccctcctgggccagccatccctacctcagggcttgccagtggcttcggagctgccggaagggctggccatgactccgggggctctgcctgcacttggggaagaagaaggacccagcgcgagcgtcctctcggcggagctggggagtctgagcgcgggctcgttgggtccgcgcggcgcggagctgggcatccgggcggcgcgggctcttccgcgggccgctcctggctctctggcgccctctgctggcctctcccgcacaccgccgccacgccgggctcgggcctgcgccgctctcacctgtcctggcccaggaagtcgctgtcccttgcccgtggccaggcccgctctggccaggccctgcacctcctccccgccccagccaggttgcaccccgatagtctccctgccgaaggaggagagaagagaagggacgcccggagagggtggacatcggccacagccaccttgtctttgctcttaccctgtttcttccatgatttggaggtggtgggaaaaccgaggctgctcaaaactctgcctaccaggaaaggactttctggagaagctcagattaatcactccttatgagaggtgacagtgtgctggcagccctcacagccctcattcgctcttggtgcctcctctgcctgtgctcccactttggcggaacttgaggagcccttcagcccgtggctgcatggtgggagcccctgtctgggctggccaaggtcggagctggctccctcagcttgcagggaggtgtggagggagaggcatgagccagaactggggctacacatgctgcttgtctgccggctgaagttccagcctcccccctctgtgggctcctgtgcagcccgagcctccccaacaagcaccttcccctgctccacggtgcccagtcccatcgaccacccaagggctgaggagtgtgggcgcacagagagggactggcaggcagctccacctgtggctcctgtgtgggatccactgggtgaagccagctgtgctcctgagtctgatggagacttctcagggattgtaaacgcaccagtcagcaccctgtcgaaacagaccactcaggctctctgtaaaatggaccaatcagcaggatgtgggtggggccagaaggaagtaactgcgaacacatcggaacatcagaaggaacaaactccagacacgccacctttaagaactgtaacactcaccaggagggtccgcggcttcattcttgaagtcagtgagaccaagaacccaccaattccggacacacttacacacttggcactgggagaattaaaagatggaaacctgcagaatctctgaatcactgttggacaagggcccccaaggagaacccctgccctgcaccagactatactatgggtgccaacccactgagagttcagggtttattcgtctcagcagcagtctattgttacactgactaacatcctaaggtttgagagatctagcatattgttaactgaagctagatttcaattacactgagaaccttatctatttaaaaataaaaactctcctaaaaaaaacaaataatccacattccttttaaccacatgtggaaaatttgcaaaaaaaaaaaaaaaactggccacatattaggccataaagaagtctcagcaaaatccactatacaattgacattgtccagaccacattttcctgaccataatgcaataaaattagaagtcaacagcaagaagatagataaacacaagcacacatttggaaaattaaaaatatcctttcatgagttaaatgaaaaatcacaatagaaattactagacatttacaacagaacgaaaatacaactttatatatatatacatatttacatatatatatacatatttacatatatatatatatatatatatatatatatatatatgtatttttctttatttgttagggtggataatccaggggcctgctcccccatgatagaagccaaagacgtccctgcaggcgcctcccgctgcatccttttctgcactgcccacatggacacaactcagccgattagacttgttctcagaactttagtcttgagcaaagagattaaagggtgaagtgactgaagaagtgaggacgtgaaatatttgtcattctgtgcctggcttatttcatttaatataaagacctggaatctcatccattttgtctgcagcggagagaagtttcttcctttttaggctgactaatacttcattgggtgtatataccacagtttcttcattgaaactaatttctgaagagcaaatattttaaaaatgtctcggaatgtgaaacttcagggatactgtgcccattttattcttttctatttcccatcttatgtatac

SEQ ID NO: 478565 - DNA, 685 bp, Homo sapiens
gatattgggagtaatgtcgtcctccccaaacctggatgttagcaacgagatcacagaggggctgtacacaccctgcgacattggaagtaatatgatcctgtccccacctggatactgggaaagataccacagcgcggaggatccagaactgcagtcggtcctcgctttgctgtccctgtccctgtccctgaatctggtcacggtgctgaggaacctgctcagcatcctggctgtcagctctgactcccccctccacacccccatgtacttcttcctctccaacctgtgctgggctgacatcggtctcacctcggccacggttcccaaggtgattctggatatgcagtcgcatagcagagtcatctctcatgtgggctgcctgacacagatgtctttcttggtcctttttgcatgtatagaaggcatgctcctgactgtgatggcctatggctgctttgtagccatctgtcgccctctgcactacccagtcatagtgaatcctcacctctgtgtcttcttcgttttggtgtcctttttccttaacctgttggattcccagctgcacagttggattgtgttacaattcaccatcatcaagaatggatccttttgtcttactataaaattgtcccctccattctaaggatgtcatcgtcagatgggaagtataaagccttctccacct

SEQ ID NO: 478566 - DNA, 2280 bp, Homo sapiens
tggaatcaacatcaaacggaatcaagcggagttatcgaatggaatcgaagagaatcaccgaatggtctcgaatggaatcatctaatggaatggaatggaataatccacggactcgaatgcaatcatcatcatatagaatagaatggaatcatcgaatggactcgaatggaataatcattgaacggaatcgaatggaatcatcatcgaatggaaacgaatggaatcatcatcgaatggaaatgaaatggaatcgaatggaattatcatcgaatggaatcaacatcaaacggaaaaaaacggaattatcgaatggaatcaaagagaatcttcgattggacccgaatggaatcatatggaatcaccgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggagtcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattaacattgaatggactcgaatggaatcaacatcaaacggaatcaagcggaattatcgaatggaatcgaacagaatcatcgaatggactcgaatggagtcatctaatggaatggaatggaataatccacggactcgaatgaaatcatcatcgtatagaatcgaatggaatcatcgaatggactcaaatggaataatcattgaacggaatcgaatggaatcttcatcgaatggaaacgaatggaatcatcatcgaatggaaatgaaagggatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggaatggaatggaacagtcaatgaactcgaatggaatcatcattgaatggaatcgaatggaatcatcgagtggaatcgaatggaattatgatcaaatggaatcgaattgtgatcatcatcgaatggacccgaatggaatcatcatccaacggaagctaatggaatcaacatcgaatgaatcgaatggaaacaccatcgaattgaaacgaagaatcatcgaatggacccgaatggaatcatctaaaggaatgaaatggaataatccatggactcgaatacaatcatcatcgaatggaatcgaatggaatcatcgaatggactcgaatggaataatcattgagcggaatcgaatggaatcatcatcggatggaaatgaatggaatcatcatcgaatggaaatgaaaggacaacatcaaacggaaaaaaacggaattatcgaatggaatcgaagagaatcatcgaatggacccgaatggaatcatctaatggaatggaatggaataatctatggactcgaatgcaatcatcatcgaatggaatcgaatggaatcatcgaatggaatcgaatggaatcaacatcaaacggaaaaaaacggaattatcgaatggaatcgaagagaatcatcgaatggacccgaatgcaatcatctaatggaatggtatggaataatccgtggactcgaatgcaatcatcatcgaatggaatcgaatggaatcatcgaatggactcgaatggaataatcatcgcacggaatcgaatggaatcatcatgggatgaaaatgaatggaatcatcatcgaatggaatcgaatagatttatggaatgaaatccagtgtgatcatcatcgaatggacccgaatggaatcatcatccaacggaagctaatggaatcaacatcgaatgaatcgaatggaaacaccatcgaattgaaacgaatggaattatcttgaaattgaaatggatggactcgtcatcgaatggattcgaatggaatcatcgaataaaattgattgaaatcatcatcaaatggaatc

SEQ ID NO: 478567 - DNA, 2699 bp, Homo sapiens
tggaatcaacatcaaacggaaaaaaacggaattatctgtgatcatcatcgaatggacccgaatggaatcatcatccaacggaagctaatggaataaacatcgaatgaatcgaatggaaacaccatcgaattgaaaagaaaggaattatcatgaaattgaaatggatggactcatcatcgattggattcgaatggaatcatcgaataaaattgattgaaatcatcatcaaatggaatcgaattgtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatgggatcaccgaataaaatcgaatggaacaatcatcgaatggactcaaatggaattatcctcaaatggaatggaatggaattatcgaatgcaatcgaatggaattatcgaatgcaatcgaatggaattatcgaatgcaatcgaatagaatcatcgaatggactcgaatggaatcatcgaatggaatggaatggaacagaatggaatcatcgcttagaatcgaatggaattaacattgaatggactcgaatggaatcaacatcaaacggaatcaagcggaattatcgaatggaatcgaagagaatcatcgaatggactcgaatggaatcatctaatggaatggaatggaataatccacggacccgaatgcaatcatcatcgtgtagaatcgaatggaatcatcgaatggactcgaatggaataatcattgaacggaatcgaatggaatcatcatcggatggaaacgaatggaatcatcatggaatggaaatgaaagggatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaattcaatggtatcaacaccaaacggaaaaaaacggaattatcgaatggaatcgaagagaatcttcgaacggacccgaatggaatcatctaatggaatggaatggaataatccatggactcgaatgcaattatcatcgaatggaatcgaatggaatcatcgaatggactcgaatggaataatcattgagcggaatcgaatggaatcatcatcggatggaaatgaatggaatcatcatcgaatggaaatgaaaggatcatcatcgaatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggacacgaaagggatcattattgaatggaattgaatggaatcatcgaatggtctcgattgtaatcattatcaaatggaatcgaatggaatcaccgaataaaatcgaatggaacaatcatcatatggactcaaatggaattatcctcaaatggaatcgaatggaattatcgaatgcaatcgaatggaattatcgaatgcaatcgaatagaatcatcgaatggactcgaatggaatcattgaatggaatggaatggaacaaatcgaatggaattaacatcgaatggactcgaatggaatcaacatcaaacggaatgaagcggaattatcaaatggaatcgaagagaatcatcgaatggacccgaatggaatcatctaatggaatgttatggaataatccccggcccgaatgcaatcatcatcgaatagaatcgaatggaatcatcgaatggactcgaatggaaaaatcattgaacggaatcgaatggaatcatcatcggatggaaatgaatggtatcatcatcgaatggaatggaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcagatggaatcatcgaatggattggaatgaaatcattgaatggactc

SEQ ID NO: 478568 - DNA, 929 bp, Homo sapiens
gaatggactcgaatggaatcaacatcaaacggaatcaaacggaattatcgaatggaatcgaagagaatcatcgaatggactcgaatggagtcatctaatggaatggaatggaagaatccatggactcgaatgcaatcatcatcgaatggaatcgaatggaatcatcgaatggactcgaatggaataatcattgaacggaatcgaatggaatcatcatcggatggaaacgaatggaatcatcaaatggaatcagatggaatcatcatcaaatggaatcgaatagaattatggaatgaaatccattgtgatcatcatcgaatggactcgaatggaatcatcatccaatggaaactaatggaatcaacatcgaatggaatcgaatggaaacaccatcgaattgaaacgaatggaattatcatgcaattgaaatggatggactcatcatcgaatggattcgaatggaatcatcgaatgaaattgattgaaatcatcatcaaatggaatcgaatggaatcattgaatggaatcgaatggaatcatcatcagatggaaatgaatggaatcatcatagaatggaatcgcatggattcattgaatggaatcagatggaatcattgaatggactcgaatggaatcattattgaatggaattgaatggaatcatcgaatggtctcgaatggaatcattatcaaatggaatcgaatggaatcaccgaatagaatcgaatggaacaatcatcgaatggactcaaatggaattatcctcaaatggaatcgaatggaattatcgaatgcaatcgaatggaataatcgaatgcaatcgaatagaatcatcgaatggacttgaaaggaatcatcgattgaaacggaatggaatagtcaatgaaatcgaatggaaacgtcattgaatggaatcgtcgagtggaatc

SEQ ID NO: 478569 - DNA, 651 bp, Homo sapiens
tggattaatccatggactcgaattcaatcaccatcgaatacaatcgaatggagtcatcgaatcgactcaacgaatggtctcgaatggaaccacctccaaatggaatggaatggaatcatcgcatagaatcgaatggaattatcatcgaatggactcgaatggaatcaacatcaaacggaatcaaacggaattatcgaatggaatcgaagagaatcatcgaatggactcgaatggaatcatctaatggaatggaatggaagaatccatggactcgaatgcaatcatcagcgaatggaatcgaatggaatcatcgaatggactcgaatggaataatcattgaacggaatcgaatggaatcatcatcggatggaaacgaatggaatcatcaaatggaatcagatggaatcatcatcaaatggaatcgaatagaattatggaatgaaatccattgtgatcatcatcgaatggactcgaatggaatcatcatccaatggaaactaatggaatcaacatcgaatggaatcgaatggaaacaccatcgaattgaaacgaatggaattatcatgaaatagaaatggatggactcatcatcgaatggattcgaatggaatcatcgaatgaaattgattgaaatcatcatcaaatggaatc

SEQ ID NO: 478570 - DNA, 2289 bp, Homo sapiens
tactctgcaaagccagaggaacagagctgccagaggccatgagagcctatctcttcaatcagcatgacctggctgatggaccctaatcttgatgctctcagacacacacagaaggaaaaagctcatgtgaagaaagagacagaaattggaataatagagctacaggccaggaagccaaaggattgtgggaaaccatcagcagctagtgagaaacccacagcagaaggtgcaaaaggaaaaatactccgtgactactctgagaacagagagttacatgagtggattctgtgggctctttttggaaacaagacgttccctgctatcatgactaattattgcatccagcacaagctcagtccctaccttaaacagctgttcagcccacctggaagtccagagaacaaaatcaccttattgcccttcaaaatccttctgcttctcttgaatgctttttctcccacaaaagaactcatagccctttcactactttctgcctacaaacagccatcgcctcccgctcctccactcctggatgcacaggtacacagggtcctgcattgcaatccattccactctgccctggctttgtgttccatcactcatgctccaagttctgaggcagcaaaaaatcagaggctgggagtgtcagtctatgctaaaaagaactgtctgtgagtaaagttcaggaagaaggaggagcagaaacaggaagaggggaaggaggaggaagggaaaaaagagtctcatttaaacaatagagaagtgttttcatgtttctttagaagtttggtgatgttttgtaaccagaaatatgccataggaacttatcctgtttatataaattagtctatggtaacgttggtatccttagatgtcattctgcttattcatagtttccaagaacgtattgagaatgttcacttctatttctccacttagtaagattttttttcaattttccatttcaatagatatttgcatttatttcatctcatcatgtatcatttgtctgagttatggatttcttttcattacctctgtgcgtggaatcattttaagctctcagcctttttaacaaaaatgatgataatattaataatatgttttgcactaaaaccatgattcttgaatatcagaagatcacttatttttaaaaccaaggtatatttcagtctcaaaactagaaatatgacccgtttagaagatggttctttggaaacctaatgctgctgccaggattgtgaagaaaaaattctggatacaatgaaaggcaggaaaaataaacttctattatatatcaacctgttttccagctacttacattctaagtacttatggaatgcctataatctcataaagagtttaagcttttagggtagaggcagtatctgccttgaccacttctgatatggtgcctagaatatagcaagtggtcaataatatacaattatttgtaaattgtcagtcaatatccaaataagatcattaattagtcattaattaatttatgatctagtggttgacatatttagttgttaattatctactgttttacattcattctttttcagtgggacttaatatctgattatcatttcctgaaatcatttgcacagggcatctgtatagcatgctttattctagttacttgtgtatgtgatctcatttctgacaagaactctattacaccactgataggaaaagatcactctatgtattctcaaagaacccagatcaaatctgttagtattagccaatttacatttaatgatgttttatgcacttcccttccacaaagtaagcctctgcatggcacaaaaactataaaatttatcaattttatctaaagctcagctccatcctgatatttgtggtgttgcgaataatgaataaatatttcttgaagggaaataaacattagtttttcctgtttcaataccatctatgtattacatacatagtaattaaattaatgtgtgttatatatcaatttttatatataaaccaatgtattatattcatcaatttatatgtaaaaaaaattatttttatatgtcaactatattacataatataacatcaactatatcttacaatttattacattatatgatataactgatatattaatacattattttataatatatttattgataaccagttcaattaaatataatgtacattaaaccctactgttttattagcacttgatgttaaaatactagagcataccaccaagctacagtgaagttattgtcctcacattagtatgatcagtacatcaaa

SEQ ID NO: 478571 - DNA, 704 bp, Homo sapiens
ccttatcccaccaccagagttgttgttgttgttggggtcttgccatgttgctcagggcggccttgagctcctgggctcaaaccatccccccatgtcagcctcccgagttgctgggtgagccaggctgttggtggccccacccttatggctttgctaggtgcatcccataccacagcttacttgggttggagttgcttgtctgtggctctcccatactggaattgcaagcaccctccattgttgggggtgggctttggttccatccaactgtccacccagcctccatcacccagacagggagcactgatggagccgatcacacccggggtctgctgaacagtgcccacagcttccggtgttcagtgggccttcaacacagcacagcctccttctatttccaaatcagcagtctccgctatggtcgttttgagcattgcccattttccctcagtctccttcaacactgtgaccacattcccccttggttccttacctctcagacctcggacagcgcccctcatcctcctaagcttgcatctaaaaccttcgcaagggtcctactcctcactcgtcctcttcggtcacagatgaagcaacaaagaggtgctgtggcaggccagctgtcactaacacaggcctccgtaacaactgtttcagcactgactgagtggttaagttaaatattaaaagctgagagagccagc

SEQ ID NO: 478572 - DNA, 570 bp, Homo sapiens
ccagcatccttctactttcctgtcttcctgctgctcctcccttgctgggagaaagagccagaggcctggtaagcatgggtcctgccgtaggacctgttgacccaaatgaagtaaatcctgtatcaaaagaagaaaattcatttccgaaagatggaaatacactgaatgtggagaaaaacgaccccatccctcggcgtctgcttcttcagggaccccttcaattcccaaaaaagagcttggagccagtctgctcgggaggaatcctggttctgacacttagtcacacagacttaggcaagtcgcctaatctcctgcacctgatttcttcttcttctgtaaataatatcagcagttgcacttctggctacccccaaagaagtgaaagcaggggctggaagggatgcttgcccacctgtgttcacagcagcactattcagaataggcaaaacgtggaagcaactcaagtgcccgtcaaaggatgaacggataaacaatggcggctgaatgtacaagggaatattatctagctttaaaaagaaatgaaatttggacacatgctacacacaacac

SEQ ID NO: 478573 - DNA, 1039 bp, Homo sapiens
ggacatctgaaacttgtagatttactaacgtggggatgagggtatgcttgtgtttttgcaggagatgaacaagccatgtgggtgccctcaagatgtttgcaaccatggagactggagggacccatggattccaaatataggccttgttaccccagtacgagccatgagccagttgaatctgaatgtgaagacagaacgaggacagactggagtcatgttgacatcaacccccataacatggggacagatcaagaaaaccacacaggaagctgagcaactgctggaatgccaggctgtggcatactttatcaatgaaataggcatagaatcgccatttctattccaaaagggagaaaaaggaaaaaagaaaggaggtaacaggcaccaagagtttgaagaaagtttattccaaccctcaaggataactgagaaatttaagacttcagtggaggaagtaaatgcatatgtggtagacataccaaaacaactggaattaaaagtggaccctaaagatgtgactgaattgctgcaatttcatgataaaaatttaatggatgaggagttgcttcttgtggatgagtaaaaaatgtgaagtggtttttttttttttgagaagaaatctattcctggtgaagatgtgaatattgttgaaatgataacaaagcctttcaaatattagataaacttagtagataaagcaacagcagggtttgagagaattgactctaattttgaagttttttgaataaaatgctatcaaaaagcactgcatgctacagagaaatctctcatgaaaggaagaattcattcatgtggcaaactgtattgttgtcttattttaagaatttgccactgccaccccaacctttagcaaccactactctgatcagtcagccgccatccacataaaggacaactagtaaatccccccacatacacatgcacattttgagttgcaccgcggatggaatgttgttctgtggttttccacagtcttacacataactacactgaaagagagtttcagctttgaaacagt

SEQ ID NO: 478574 - DNA, 824 bp, Homo sapiens
agcaactcctcgctctctctctttcctcgcgttccagcaatgagacatgcttgcttccccttcaccttccactatgcttttcactttaaaaactatgcaaagacccacactctagtttttaggctttatgactattttgcttttaaaggaagtcagtccgagtcccaaaacctcacaagtagggaagatgacagtgtagtcttaagtctgtggctgaaggctggagagcccctggcaaaccgctggtacagttgtgatggcatcggcggcccttctggagtggctgctgcaaaaacgccgctgaggaccagcaggaagtgggaagaggtggaagccccaccccctatggagttggcagggtgggagcccatgcttctggatgcagctgcagcccctcagctgtggttccagatccaggcatccctgtgttctcagggtttcaggaagcctctgcccctgcaagcttcgaagtgcctgctcctgctacctgacctctccctgatcccagtgcccccagagcaaagctgtggccgagctcaagcagtgtcgcaaacagccaggtgtgtgcgcactcaagacagtgctgacacaccagtcccctgccgcctcagcttcctccagactttgagcactgaagaggagtggagggtggggggttgggggtagacaggttcctgggtggaaaggggcaggttcctggtgaaacccccctttcaagccagggatgtcctaaagcctgggggaacggctgccagttatgggtggagtccatgtcccagaataagaacttatggtgctttttctgggcctgcccatggctgccc

SEQ ID NO: 478575 - DNA, 669 bp, Homo sapiens
gctgcttccatttcagaggctctgatccagcaggaggtaggcgctcactgtggagaataagcacagtggagtggaggacagagatgcagctcagggccacctgcatgtgctgggccagctccctgcccccacactcccacctccctcggagggtgccacatgtggagccaagggaggtcccctcccacgggggcagttgggagcctgcactctcaatcggcccatgtttattgacttataaatctactctgtttagcggctcagtagaaaggtgcagctctccccctgtgggctcccctcattctctcctggcaggcttcagagccccttgccaaagctccaggtttggggaaacagccgcccaagggtctgcaggagttggagccagcaaggggaggacagcacacagcagcccccagtgggaccctgtaaacaaacccagcctcattagttgtcttagtgcctcacccacctgttgggtttcatgtcttctaccttgccctgggtgaacatagagtctgcttaataaacaattcaaaaggagactgtgctgttaacttggtgactgtcaggctttctgaggtggaaagttgtccatggattcagaaacttctagggtctaaagattcataagatcttctggttgggttagagtgtgcactagagctg

SEQ ID NO: 478576 - DNA, 597 bp, Homo sapiens
agctgataaatatttggcttgtgtctccttctaaaataatcctcatgcacaatgatggctcaaaacctcatcaagacaactaaagtcaagggaatagttgataacaagaaacaaacaaacacaaagaataaaggaggagcttctagcttgtcccgtttgctggctgtctgtgccacattcatgccacttgtggctgtgtggagaacacgtgaggttctctgtgaggttgtccaggcccgtctgcctgtgccctcccctcctcccttccctcctgcttccagcacagggttctgtgttgacagaagttggggggattttgaggggagtcttgctgggccctttggctctatcacagagttggaagaatccaagggaagaaatcacaagaaagtccacctgactgcacctgagctcaagggcagccagtgctggaaaaatgatggtggagagccagggctgttttctgaccttctcttctccacggggaccatttctcctatgcggctgacttatccacattttgtgtccctttaaaccagagattcaagtgtcagtttaattgtcctgtggcaccagtactgtcattagcactcagtc

SEQ ID NO: 478577 - DNA, 484 bp, Homo sapiens
tatcatcaccatcatgaggaattacccattatcacactatgttggcactgttctacgaggagggacttctcagagtctacataacatgcagaatttcctacttgttcatttgatcatgaggtccttcctgtggccctgttcatctctgtgcacactctcagtggtgggttggagacagctggcgccagcttgtccaaaagatcacaggatccttctaagagatttccctggggaagatgggcacagcctggctgatggccttgccggcgataatgaagatgaggggagattggagacctcttatatcttttctgggcatatgcaaaacccagcacttggcactgtagatccccaagaatatgtcagcacttttcaaagaatactgtggacatctcatttcctaaatattccttttaagttttcggccaggctcttgttttccccaacttgtattgcaccctaaagcagctgcaaatgctgaaca

SEQ ID NO: 478578 - DNA, 678 bp, Homo sapiens
agtacagctcctgagaaagacttgagcacaaagacacacttaatgtccatgaaaatgaggtacaccactacaccacttccttcaggcctggaggcctgtgcccacggacctaggcgagggcaggcatttttgttttcgtacccaaatgttgcatttcccaaaaccaccctggcctgccacgcccccatcctgttcctataaaaccccccaagattccagcaggcagacatacaagcggctggacgtcgtgagaagtagatcagtggaagaagacacaagaacctggacattgagaggacatcgagagcagcacgccggtggaagaacacatcaacaggcacagcggcaggccattaacacagcggaacgacatggagtgcctcagcggagaagtttgggaaaccctggtttcacagtcgatgggaagacaccaacggcttttcaagcagagacactacatgagaaggaaagaaggatacccccagaagcagggaggccagcagaaaacacctgcaatagctcaggaggggagttagtacacctgaaacagactgacgacattgggaagaaaaggaagggaagtacttaaggacaatttaggaggtagaatggcttggttgaagaaatgaaggaaattggagacaaataatgactccctggctttaggcttgtgtaaac

SEQ ID NO: 478579 - DNA, 612 bp, Homo sapiens
tttctccaggggtgctgaagagtttggaatgtgacctgctcacgtgggcattcttgatgtcaccatgaaccttgcagtgcacatggatgttattttgagagtggcctctggggacagtcagggagaacctgggaccttaaacaaaggctcagttagtaggcagtggagaaatctcaatgaagaagcactttctctgactcgatatggatggatttggatagcagatctcatcgtggcctttggtcccaccgccaaagaagtgggctctgctctcttctttctggcctgttatttaggaacagagcaaggcgaagtggctgcagcaattggaacagttcaagttgaaaatgacttcccagatcagaaagctctatttccttgggcctacaggatctgcctggtgttcaaggcatccctgcaccccaccccaccttgctggcttcagtggctcccttctccttcccctctgtatccctcaacatcctgcagccattcacttctcactgctgctttctttcctctgaaacttctccataagctatagaagagtccatccaataagcacaggcttgggtagctcctattccatgaatacttctgctccctctgatc

SEQ ID NO: 478580 - DNA, 480 bp, Homo sapiens
gtttatacaaagccttctaaggcgttcctccttcctgagggcgatggagagctataatgttgacatgggtaattggaggcttaagtatatccttcatataaatctacatgacccatgccagggcttacctctgctaaaggatttgtcctcaaagcaggcagcaaatctgttcccttggcagaggatggaagccgtggcttgtgacattctcctgataatgcagccaggccacgggcagccagcatttctgcagggggacaggaaactgaggcacagaagggccaaagggctatatggccaaacttctggaatgcatggggggaggtcactggaacatggggccttggagcctcttttgccctcctcagatactgaggtgcttcctccaggtgggcacctctgtgattcctcaggaaatctcaagtacagattggagaaatctgacatcttctaattagggagacagatgactgtcatgtt

SEQ ID NO: 478581 - DNA, 557 bp, Homo sapiens
gcaggggcagagaaagactagagaatggcatgagggatttttgctgcctcaatctggaagcaatgaagacttacatttcactgatgtctgtccttccatttgacaaccacctccctggaacaggcaggaagagagtagatgagcaaattgaaattggcaccagcatggctgacccatctgatgagctcctttgtggacttcagtatggaaagcattcctttgggaacagcaaaatgatggcagtagaaaagcaatgggtatatcggcagatgattggttgtttctcccttcagcaatgtgggagtggacacctgccagtctcttgcatgattactcagttgccagtaggtgggaccacagctacagaagctggtgcttccttggaggaaatgagggtaactcaggcagaacgattaggagcacacagggtagaaatttcagtggttgaaaatgaatagattcctgtgcaaaagatgtactctctaaggtattttgtgttcacttagggaaaagcttagagtatcatgggttcatgggttataagtaaggtgatagga

SEQ ID NO: 478582 - DNA, 1010 bp, Homo sapiens
gtccacgctgtgggagaaagtttcctgtgagaaggcgcatggcataaatccctcctaagcatgctgccctccaagacgcacacacaggctccacattggctgtgggagggcaagtcccctgcctccgagagcccctcgtcctgtgtcgacgctgctgcaggacgtcagctccggtctggccgcctggccttcccgtgtcccctggtgataggtggggatgcacccggggaacagtccagtgaaggcgaagcacagggggacccagcagagcagcccagccccgtcatgagtcagtcagctctgcacaaagccaaagaggcagccattcaactcgcacctcacgtctggtgcaaatcctgtttcgggacacggctccaggcccccttcctgcagacgtcttcccgagcttctcccatgcgaagatcccggagcgtccaagggccaatatcccaggacatggaggtccagagaagctgtgacccaggagagctggctgctccggcctcggtggcagtgcccacagctggggttctgagctggcaactgccgggctggcagcccagggggaccatgctgaaggcagagagacagacggaggagaggacccggggaagggaggtgcttccagaaggcagcctgccctggagccttccagactctagccctggccatggggaggccctgagtgacggatggggaaccgaggccaccctccctgctgtgctgttcttgagcaggcctgggcgaggctatcaatagagctgttgggtccatctgatcaccagctccatgctgtccatacccttcagctgatcttggctgtcacctttgaccagcacatgtgtcgtccccacaccggggcttctgtccacttgcccagtcacccatctctgactcccatctgcatcaggaccttattcctgttgagctcttgtcaccatccctgcagacaggcagcagacggccaccatgattccatatccagtccctgccgggggccagtgccttgc

SEQ ID NO: 478583 - DNA, 1612 bp, Homo sapiens
ctccccgtccacccacccctgaggaagccagcctctgtaggacttggcgttatctgccccacctctgctcacaacctctggaacctccatcatgaaacatggagcatttgtgaggctccaagtgttctccatgcagagggaagaccccataaccactactgccatcatcacagtcatctccattgccaccaccgccaacatcaccacagttacatggtcctcatcaccatcagcacccccatcattacctcatcaccatctccttcaccaccgtcaccatcagcacccccatcgttacatcatcaccatctccatcaccattgtcactcatcgttacatcatcatcaccaccaccacctccatcaccaccgtcaccatcagcacccccattgttacctcatcatcatctccatcaccaccatcactcatcgttacatcatcaccaccaccaccacctccgtcaccaccatcaccatcagcacccccatcattacgtcatcaccaccaccatcaccaccatcaccatcagcaccccaatcattacatcatctccaacacctccatcaccaccggcaccatcagcacccccatcattacgtcattatcaccatcacctccatcaccaccgtcaccatcagcacccccatcgttacatcattatcaccaccacctccatcatcaccgtcaccatcagcacccccatcgttacatcatcaccagcacctccatcaccaccatcaccatcagcacccccatcattacatcattatcaccaccacctccatcaccaccatcaccatcagtacccccatcattacgtcatcaccaccaccatcaccaccatcaccatcagcacccccatcgttacatcatcaccaacacctccatcaccaccggcaccatcagcacccccatcattacgtcattatcaccatcacctccatcaccaccgtcaccatcagcacccccatcgttacatcattatcaccaccacctccatcatcaccgtcaccatcagcaccccaatcattacatcatctccaacacctccatcaccaccatcaccatcagcacccccatcattacgtcatcaccaccaccatcaccaccatcaccatcagcacccccatcgttacatcatcaccaacacctccatcaccaccggcaccatcagcacccccatcattacgtcattatcaccatcacctccatcaccaccgtcaccatcagcacccccatcgttacatcattatcaccaccacctccatcatcaccgtcaccatcagcacccccatcgttacatcatcaccagcacctccatcaccaccatcaccatcagcacccccatcattacatcattatcaccatcaccttcatcatcaccatcaccatcagcaccccatcattacatcatcaccatcacctccatcaccaccgtcaccatcagcacccccatcgttacatcattatcaccaccaccattactgtcgtcacccctccaccatcaccaccacaaatgtcatcactatcatcatcatcaatggctgtcccaagtgacctatgtttctacaaaaacgggagctaagaagcctccccccagggctgctgagga

SEQ ID NO: 478584 - DNA, 1211 bp, Homo sapiens
tctttgtggtgatgggaatgttctttagggtctttgtggtgatggagatgttctgtggggtcttcatggtgatggggatgttctgtggggtctttgtggtgatggagatgtcctgtggggtcttcgtggtgatggggatgttctgtggggtcttcatggtgatggagatgctctgtggggtcttcacggtgatggagatgttttgtggggtcttcatgtccggcaatggggaggagcacactgccggctgggagcccctgcgagcacgcctgtcccagggccacagaaaaagcacggtggagcaggggcaggacacacgcatgtggagtccctttctggccggactcgagtttgccatcacgcagctctggagcgaggtgtattgtgcccattgcctagaggaaccgagggtgtcagcctgggtcctaggcatctggattctggaatcagttgttaatgctgctgggtacctgctcatccaaccccagtgcagcctggagactgccaccgtgccccccggagggcgatggagcctccgctctgctcaggagcagcctggcttccgggagggcagcctgactcccacggcactgccggtctgcagagcctgccctggagagaaccccttctccggctctgggggagcactcacgctgccacctgtgtccctgtggcggccccttgcctgcctgcatttggctggcctggcccgacaccttcctgcccctggcccatgtgcctgctccgagtccctcctgccacatgggacccgggcaggcctgggcagccccgagggccagctgtgccaagcgaggatgccaccctggttccagggagcagcagtgccatcagagaaggccctgcaggctgtcggccccccgggtcacagcagcttgttctggcagcccctcctcccccggggcccttgttctcctccctggctcttggcctatcctcaggccatgccaagagccggcggagacgggcctggggctgggagcctgcgccagttgccatttaaaccttggcagtcggagagcccctcgatgccaaaggcccgcggtgaaggaggcggtagtgaggatgcctgagaattcttgaggtggggaaagaaaacacaaagaggaccggggctggggggtgtccctggccacgccccccactgccatttgctgatggagctccttcagtccaggcctctgtagctagtt

SEQ ID NO: 478585 - DNA, 962 bp, Homo sapiens
caggggggccactttgacccactatggtacgtgtgggcccccctggccactgtctctcatcagtgctggtatgcctgcagagtgaggcattgtggtgggaggcaggaaaggaaggccgcctgcaggaagtcttccaggattgctccagcgcacgctcaggtgaagccagcctcctgggtcatgcgcccacacttagagtttccgacgtaccaccttccagctgtctgatcttggacaatagctccactgtgactcctgcagggtatggaccacagtggtgtctcccccaaagagggaacctgagagtcaagaacatggttcttggcaagctctgccaatggtgtctggcacagtccaagctgcagcaacgtggttggcatcatcaggcccagcccgcaactgggcacgacacaagagcatcctggattcctgccccacgatggcttctccaggccacgcccctccaagggcactgttctccctgaaaactcaatgcagctcctgctccaggggcgacgactgcctcgctttcttccccctccccctcttcccctctccctcttccttcttccccttcctcgcctcctcctttctctcctcctccttctcctctttcttgtttttactacctttgaaattggtttttaaattgtcctttaaaataatattaattttcactttgtaagtattaaaaaactcataaagaatataaaaataaaaataaaatcttccaaatacaagctgttaaattcagatgttttaactactattttatttcccaagcatagatattttttaactagtggttatatttaaaatttggttcctacctttctcagtgattattataagaaaatattgatgttcataccattttcataagcatcactctaaagagttagaaatactccaggatatggagaacagtgccttgcaggagcccagcgggggtggaaaatggg

SEQ ID NO: 478586 - DNA, 1058 bp, Homo sapiens
cgcccctgagcggcggttgtgcatctgctccccaagctgcccccacagtgcacaggccaggagccgcctcaaggaagccgcactgcatggtttgatgctggacacccggagcgcaggatctgccagcctgactccaccagggcccctccggcatgaatcggaggatggtttagagagcaggaagaaaggggaccaagtgtatggaggcagcggccatggagcgtcggctgtggatcccaccctgcagaggctgccccgaggcccggagctggcttggaaaggccaaaagcctccaggacatcatctggaaaatgagagtgagcaggatcgattggcagcactggaggcagccacagaggcccggaggggagagtggaagacggctgtagtggcccatgatagccgcaagggcgctccacccagggcccagggatctgtggtcaaagggtccgtctatctatccaagcaggaagactgtcataagctgagcggcatccccggaactcctagggtgaagttctaacccctagtattttagaatgagactatgtgtggggatagggcttcctaaaatgtaattaagttacaataaggccagaaggcgggccctcatccaacctgctggggtcattattatcggaggttgggacacagacatgcacaaagggacgacttcatgaggacacagggagcacacggccatctacacgccaagaagagaggcctcaggagggagcagccctgccgacgccttgctgtggggctctgcactccaggacaggaggaattcgtctctgttgcttcaaccgcctgggggtgagggagatggaggctcagccatggctggcagtgccctgcagaccaatctaccccaacacacctccacccccactgaagccttcctcatgacacccccaggcctcccaccctcaggtctagccatccaccctaggcaccccctcctccttaggcctccccctcctcacctcctcctcaggcctcctcctcctccctaggcctccccctcctcctccccttgtccttaggctggcccctcc

SEQ ID NO: 478587 - DNA, 660 bp, Homo sapiens
gtacaggtattccgtggcgagacttacccgacggttcggtgattttagagtcgtacatacccgttttagccgttgggctaaaacaggcgtgtggcagagagtttttgaagtgctatcacatgacagtgataatgaatatgccatgctggactcaaccattgtgcgcgctcatcaacacagtgccggaaaaaaaagaacaggcgatcggacgcagtaaaggtggcttaagtaccaaaattcatgcccgtactgatgctttaggcaacccaacaggattttatctcactgccgggcaggcccatgacttgaacggtgccgatgtgttactggacttatcgttaagccaaacatggcttatggataaagcctacaattccagggatcgagtgattgatccgattcataagatcaatggtcaagtcgtgatgccatccaaaagtaacgcgattgatcagcgtgattatgaccaacatctttataaggcaagacatctgatcgagaatttcttcgccaagctcaagcagtatccaggtattgctacgcgctatgataaattggctcaaaacttcctgtcagcgatctaccttgcctcaatcatgatatggcttaattgatgacacgccctagccacaaataaaatttcatagcgtattatcttac

SEQ ID NO: 478588 - DNA, 1766 bp, Homo sapiens
gcgaaatgagcagatgtttatcgttgttttccatacaagtaccgtggtgcatgtgcgagatgtatcacatcatcacattgatagcaccagtagataaaattgatagctactcacagacagctattaatatttggtcaagcaataagttcaatatcattgttttggactttcttcaacttgcggcactttatgggggaggtccgatgacattaaataaaagcacacgtgatgaccttaaaaaactaaaagtcatgacgacaaagacaacaattaatgcgattgatatgtctccattaattggtgagtggcaaggtgttggtgatccagttgtaatgttgtttggccgaaagggaacgccttgtttcattgacttctatgcgaatactgatggtaactacaacttatatgtttgtggggtatcgggagccggtaaatcagttttgctacttgagatccttgcagcgtacagagcagtaggcgctaaacttttcatcttagacgttggccgttcatttaaaaactttgttgatcttgcgaaaggtacaacgtttgactttaacagtggacgcagtttatgcatgaatccttggtcatggattcaagttgcggaagaggaagaagaaggcggtttaaatacattccaacaagagctaagaatgctgttgccaatttactcaaaaatggcatcacctaaaaactcgttgaatcaattccaagaagcgctccttgaagaagcattaagtgctacatggagagaatacggcaatgagaacaacgttgataatgttcaagcctatttattgcaaatcaaagaccaaggtggccaacaagtagaccgagttgcttttgaatttgcaaacagctacaagcattcacaactaatggcatgtatggctcgtattttaactgatgcaccggcattgcgctcagtagtgatgttctgtgtgactagccgaatcatgaaagaaatgtacctcacacgtgatcgtaaaaaattatgtttcattgatgaagcttggcagttacttggtgatgatgctgaaacagctaagtttattgaagaagggtatcgaagagcacgtaaatataacggtatttttggaattggtactcagggtattgatgatgcttttaaaaatgaagcttcacgtgctgcatatacgaatgccgattggaaaattttcttgcgccaagatgaaaagaacttccaagaattgattgattctaaaaagaaaattgatgaaattatcaatgaagataatcaaaagaaagaaaaagtagagccggaattaaagactgaaaaagtttcaagtcaaaaggtttctaaaattgataagtggataaacggtttaaagtttgtgattgcaacagcgcttatttctttgttagtcactttccctggtttatacctggtcaaaaagtctcaagtaaaagtcggtgtggttgatgtgcaagctttacttgttgaacatgaaaagaaagtcactcaacagctatatgcgaaccaagggctttatcaaaacagtgatgctgcaagcctaaatagcggagctgtagaagagcaaacaaaacagtttttactaaagctagaaggctcaattgacgacattaacaataattgtggatgtgtcttaatcaataaggcagcgcttttaactcaaagtggaaatgttgttgattacacacaaaaggttagagaagcacttgaaaaatgaaactcaataaaaccaatacaataaatgccatattttattcttcatagcgtt

SEQ ID NO: 478589 - DNA, 1189 bp, Homo sapiens
tagaggaagagttagtgatgaatcatgaatacttagcaagacagacatacaagctgctggatgttgagcacatagatggaggaacgcatgggtggctggatgtcaagaggaatgtaccaacagtcaccaacagaacaatgaggagttttgctggggcagtcagaggagagcccaggctgctgagcagtccgactccaggggaaaaccttcccactatatccccttctgacttcccccaagttacctccactcaggaaacagagcataaaagttcagaaaatttgcagcctgacaatgtgatagagaagaaaagcccattttctggggagaaatgtaagctggctgcagaaatttgcataagtagcaaggagcctaatgttaatacccaagaccatggggaaaatgtctccaggtcatgtcagagaccttcacggcagcgacccccatcacaagcccagaagcccaggaggaaaaaatggtttcctgggccaggaccagggtccccgtgctgtgtgcagcctagggacttggtgccctatgtcctagcccccccagccatggctgaaaggggccaacatacagcttgggctggtgcttcagagggtggaagccccaagccttggcagcttccaagtggtgttgagcctgtgggtgcacagaagttaagaattgaggtttgggaacctctgcctagatttcagaagatgcatggcaacgaccagatgcccaggcaaaagtttgctgcaggggcgggaccctcatggagaacctctgctagggcagtgtggaagggaaatgtggggttggagcccccacacagagtccctactggggcactgcctagtggagctgtgagaagagggccaccgtcctccagaccccagaatggtagatccactgacagcttccactgtgtgcctagaaaagccacagacactcaacaccagcctgtgaaagcagccaggagggaggctgtaccctgcagagccacaggggcagagctgcccaagaccatgggaacccaccttgtgcatcagtgtgacctggatggaataacaaaattccgttttaatggcaagtagatctttagtcaagggttgtatgattagcaaaaagaagaaggaggaggagaaggaagaggaggaggaggaagaaggaggaggagggggagggggagggaaggaaggag

SEQ ID NO: 478590 - DNA, 1681 bp, Homo sapiens
ccgccgggcggctgatgtaccggcacagccgttcgagcttcttgcgttcatcggccctggccgccacgccggcgtgcaggctggacccggctaccttgccaatcccgtcaccgaacggatcaccactggtcggcagagtttgcaaagtgaacacctttcgccccgcctgtgaaccgacagcgatacggtaagtgatcgagtgccccagcaggggtgtcatcgggtcgtcatccaccgcatccgaggccagatagctgttttcgacatcccgttccagcaggccttgccgttccagatagcgacccacccggtgggcgatggtgtgcgtcagcggcactgttgcaaataaccacgaatggtaagctgaagactgttttagctaaaggtgcagcatatgaatcctttccatggtcggcattttcagggcgaaatcattctttgggctgtgcgctggtattgtaaatatggcattagctatcgtgaactgcaggaaatgctggccgaacggggtgtgaatgttgatcacacgactatttaccgttgggttcaacgttatgctcctgaaatagaaaaacgtttacgctggtattggcgtaatcctacagatctgagctcgtggcatattgatgaaacctatgtaaaagtgaatggacgatggtcttatctgtatcgtgcagtcgatcaacgtggcgataccattgatttttatctttcttctagacgtaataccaaatcagcatattgttttcttggaaaaattttaaataatgtgaagaagtggcaaattccacaagtgatcaacacggataaagcacccacatatggacgtgctttatcacggttaaaacgggaaggtaaatgtccaccagaccttgagcacaggcagattaagtataaaaataacgtgattgaatgtgatcatggcaagctaaagcggatcatcagggccacattaggattcaaatctatgaagacggcttatgccacaattaaaggtattgaagtcatgcgtgcactacgtaaaggacaagcatcgtcattttattatggtcagcctcagggtgaagattgtaattctgatcatatgagattttcccatctggacgtttaacgaattctttttcattcgtggtaaacgacatagcagaataattaatttcgacattatgtttatgtcgggtcaaagcaacataagttaaattagcattcatgttctcactcgccacaatataggcattatcaacagtcataccttgtgatgagtgaatagtatttgcataaccatatttaaattggttgtattcatttaaatctactttaatgatctcattatttctatctgactgaaccatcataaatttaatgttattaagattatctttttcaaaaccgattacttttgctgtttcaccattgctaacttttaattttgaatcattctgcttaaatgcaattttttctccgacagtaatttcaatatcaccgaaagcagttttaacatgattaccagtagcagaaagttgaccatttttaattaatacatttcttgccatgcggtttaattcattcacatcattatttgaatgagcaagcattaacttattttcgctagaatcttcactccaagatgtaatagttttggactagtgctagatcaagagattcatattcattaacgagc

SEQ ID NO: 478591 - DNA, 816 bp, Homo sapiens
aaatcggtgaattgttatgtattctgcaattctatatcttttaagtggagcatttaggccatctgcattcaatgttagtattgagatgaaactgatttgggagttctgtttgatgaccgaagagagtctttaccactgtgcctatatttttatgccagaatatgggtgggtgcacatgtacagggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagcactattgctactgccaaagacagcagagactctaccctcattgatcttacatccaaatgtgttaatgtatgtatgcttggatggggaagacagaatataatataagcaaataaataatgacggtaattgtggattgtagtctagtgtggaagaaactttgtcttctggatttcttagtctcttccacctgtgtctgggtctttcctataatcgttctagttttaatgaaatctattggcctgcaattcattttctttacacttaagattctgtaaagactcaacctccaaataaaatagttgtgaagccactctcaaatctgagaactggagtttggaagttttggactctaaagtatatttcattatgatgcttaagcatgttggaggaggggatactttctgaaacatcttaattcacttctgtcttttgcatttaagtatatttgtaccctacac

SEQ ID NO: 478592 - DNA, 486 bp, Homo sapiens
catttccaccactcaaaataacgtctttttatcccactttttaattaaacattttcctatgtcacaaaaattacttcaggaaatcttaatagctcccactcagacaaacagaacagcgtgtggagattcacattgtgaacttttgctccaagaaatactgcaggaacataccaggaaagccaagaaaatccacacactctttggaggaagcagcttccctctgcaggctctgcgagacagccaaaaaactgtgagtgcgcaaagtaaatcaagtgaaatacagggggtagaggaagcagtgggaagagccctgtgggcactcttggtcccacgggaagccatttctgactttgtcttgcaggggctcctggggaggactgccagtaaaattgaggaaagaccacagggaaaaggaaattcccagctgcactttgtaacaattttgactgaacacaaagttcctcggacataatctgggggaggggg

SEQ ID NO: 478593 - DNA, 1546 bp, Homo sapiens
tttctcctcagaaaatgggattttttttctattgcatttctgaggctacgtgcggcaacaatcctgagctaggatattcagaggaccatcctttcatgctactggagaaagtgactttcccaagtttgtcattgctgggtcatgatagccagcttgggcttttgcccacacaactgctcagtgcttatgcttggctgcttgccctcttctccatggctgtgatctgcccagccaacaccctgcttaatttaggccccactgaaagacagtcctggaggctctcagtcctggaggctggaagttcaagatcagggttagatcctccagagggctgtgagggagaattggttccaggacccctcctagcttctggtggttcactggcaagcttttgtgttccttggcttgtggaagcatcatcccaatctttaccttcttctaaggccacagtcatattggattggggcctaccctaacaacctcatctaaacttaactaatatcatctgcaacggtcctgtttccaaatatggtcacgttctgaggtgctagggtataagaattcagcatatgattttggaaggggatgcacaatttatttatttatgcttaatttttaattttattttatttttccataagttattggggtataggtggtatttggttacacgaatatgcgtgcttccccttcacccttctgccatgattgtaagtttcctgaggcttccccagccatgcctcctgtacagcctgtggaacttcaggacctgggagagaaaaaagctaccagcaacattcagactgagagaggccaaaatactaattcataattagcctggtacatatgaaggatcaaaaagaacaggactgtatgtctgacctctgacaggccctaccaccatagtagagactcagtatgtatacttaatgaaggaataatgaatacatcagcaagagaaataagagtgaccatatgttccttaagagaagcaaagagcagctcctgttcctgctggaatgagtctccattccttgcaacagaagtgtcctaagttatagccagaggacgggggcacattgacaaaacataaagcggatatgataataacaaggtaccattccagcaagaacatctgaagaaagaagcagtgttgtttatctttccttcatctattctgaaactaaaatccttaaccaaatttatttccgaagtttaaccctttaataaactggcctctgactccacctggtggagatacataaatctatgaaaataaaccaatccaaatgaagattttaaagtcatcagctctctttcatgtctcaaagaaaaaacacatatcccgaaattcaaatagatgaccttctcggatgtgttataggcactcagaagccccaaagaaaaaatagtttgagttgatcatttgactgttgctctcagccttcatttctgcctttctaggttgtgtcaggcattttgactgtccaggggccctgcatattctattttcctagttacttgctaaggtttgaatatttgtccc

SEQ ID NO: 478594 - DNA, 563 bp, Homo sapiens
ttaatttttaaatggatattagaaaaaccacttttagtaacttaatcagaaggaagaggaagaaagaggaagaggaggaagaagaggaggaggagcaggaggaaaaaagacaggaagaagaagcagaagcaggagaagaggaaaaagaaggagacaaggaggaagaggaagagcaagagggaaggagaaggggaaggaaagaaggaaaaaagaagaggaggtatacaacttcaagagaacaccatggctttagtcaaaaggaaagaagctgcgtcatgttgtcggtgtttgaagaatccaaaaattatacattttctaattctcgatttggacagtctctgttcccatcattcaaagactaccaggaacacatctgtgatcaacaaaggtattattattatgatgccaatgttactaaagaggctatatgacttgtccatgatcaccagaccaataaaatagcaaagactttctgattataagttacatgtgctttccactgtcacctttttggtacttgactattttgtttgattgactaatttaaggtgacaatgattagt

SEQ ID NO: 478595 - DNA, 1438 bp, Homo sapiens
acctcttcctccaacacttaaaaaaggcagtaggtctgcttctacttaggctgatttctaagctttgaatttttgcgcaataaaagcagaatgtcgaagctccttaactgtttagaacaaaagtccctgctcaacaagttgcagaatgaaaagggtgccgacttctacattactaataagctccaaagtgatgtcgagttgctgatcgttgaaccatcctttgagcagaaaagccatagtaatgtaccagggctgcctcctattgaagtagcctcattgtctaggatacccgaagttcgttgtctcatgaccaaggaaattaagaacgtgaacacacaaggaagggtattggaagataactccttctggctacttcctgctggagagatacgtcatgtggggaacagcagcaaaggctcctcctggggtcaatctaagggtcctgtaaaggtcctgcatggttctatctgcaacaccatttggagttcaatagcttctagccagacaagtaatggaggtgggagtttaagtgactattcctcctccattccatcgactcccagcatcagccaggaggaacttcggatcgatgttcctcccacttccaacacacccacgcccgttcgcaagcagtccaagcgctggtccaacctgtttacctctcagaaagggagcaacccagacaaagagaagaagggcctggagaatcgtgcagacagcatcaggaggggcagagccatccccattaaacagggcatgctattcaagctaagtggcaaagggctgaagaaatggaaaaagaaatatgtcaccccatgtgacaacggcgtgctgacctaccatccaaatttacatgattacatgaagaatattcatggtaaagagattgaccttgggagaaccactgtgaaagtcccagggaagaggccactgctagccacatctgcctgtgcgcgcatctccagctctaaaaccaatggcctaaccaaggacatgagcagtttacacatctcacccaattcagacacagggctggatgactccctatgctccagccccagtatctccagcaccaccagccccaagctccacacgccccactctcctcaggccaacagaaagaagcaccaaaggaagaaaagcacaaacaacttaaaagaccatggcctgtccggcactgctgaaggacaagaagaaaactttatcattgtgcccctcactggccaaatgtggcactttgaagccacgatgtatgaggagcgggatgcctgggttcaagccatggagagccagatcctggccagcctgcagtcatgcgagagcagcaagagcaagtccgggctgaggagccaaagcgaggccatggccctgcagttgatcggaaacatgcgggaactccaactgtgtggactgcgagacccagaatcctaaccacatt

SEQ ID NO: 478596 - DNA, 2014 bp, Homo sapiens
accgaaaaaaggaacaggataaaacctaatggcgattgctcgtttaagtgtcaaagtcggtaaggcaggtaaagcagcaccgcatgccgaatatattgatagggatgaagaaaagaagctgaaacaggaacaggcagaaactgatcttgaacatagtacttatggaaacatgccgaaatgggctgaacataatccgattaccttttggcaggcagccgacctttacgagcgtaaaaatggcagtacctatcgagaatatgaaattgccctgcctagagagatgaatgccgagcaacgcctagaactggttgaggacttcattcagtctgagatcggctcaaaatatccgtatcaatttgcgattcataaccctaaagcaatggacggcaaggatcagcctcacgttcacctcatgtttaatgaacgtctgcaagatggaatcgaacgagatccagagcaatatttcaaacgctataacgccaagaatcctgaacgtggcggagctaaaaaagacaatacgggcaagggttaccaggaacgaaaaactgatattaaagacctacgccaaagatgggctgatttatgcaacagccatttagaaaaacaccaaattgacagtcgtattgatatgcgaagctacaaagagcaaggcatagagaaagaacccgaaaagaaactattaccaagccaagctaaagaccctgaaatcagggaagccttgcaacagtcacgtatagcctataaagagcttgagcaactagatttaggcgaccctaaaaaagacctgaaagacctcaaaaacagcccaatttcagataaagaaattaaacagggtattgagagctttaaggctgattttgacagctttaaacagcttgctttggaacagtacaaacagcagcagaaattagaaagagagcaacagaaaacaatgaatttagaaagaacagagtttaaggaagaagaacttgcgcccattaaaaagcttgatttgaatgatttgaaagttcctatgcctaaaaaccttgatcagttactgatttggacatccgaactggctcaatataattatgctcaattccttaaccaatccgaacagctaaaacttgttgatgaagacaacctggaagaacaggcggaaatcagtcagaagcttaggttctatagaggtaatgcgcttatagaaaaccaaatcaaagatttctatttgaaaaagttacttgatcaaggagaggcaacagtcaaaggttatattaaaagtccgactaagaaaaatacccgatatgctgtaatttcttatcatgactatgattttgtaagctttgctactccagagattcttaataaatttccagccgatctcatcaatttcgtgcaaaaggaaacacctaagacattagcggacatatatcctgaagaagccgtgttcttatcagctatcaaaaaatttataaaaccttttaaggaacagtataaaaaattggctgataagaacagggaaattaaggagcacaatacagttgctcataaaatttatataaaaattaaaaataaggaagcaactctgcaaaagccaacagagtcaaagcctaaagaatctaatccaaagactactgaaaatagtgctgtcccagtagagatgaagcagggaaccattcagaaaaatatggctccacaagaaaagccacttactgtgattaagaagcgaaaatttgctttaaacaagaataagtaacttgtaatgtaaaattctaaacaaaaacccctctaagtcttgcaacttagaggggttttcaagtaaattcagcggtacgcagttatttgatggaactaacatcaagtaacgaagatcataaggtttggcgaccgttatgatttcaccaaaaggcttgtacctgaactctattttcacaataaacagtgtttatatcaagcctcaaaatgataagtcttcgttaattcgtgttttaaaccatcaaataagcatcctagatcgagctttgcccgcttctgc

SEQ ID NO: 478597 - DNA, 876 bp, Homo sapiens
cccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccagggaggtgcgcagagccctgcgaggggtgggcgtggtcctggccaccgcgctaggctgcgccttccagggccttagctgcacttgctccttgtgagatctgagagagactgtctcacagatagagccttcctgcaaggggatattgcttcttaaacttggtaatagagaaaaagctactcattaatgaagactttgtacctgcacttgtttttgaaaggttcctcgtgcttattagaggtttttaggagcttacctaaagacaaaggctctgtctgtgaacctctgcccacgcagctggccctggtgtactcggctccaagggcatgcactgggcggtgtgcagctggatgttggaggtgctttgtgaagcaggcggcactgtgaggcttca

SEQ ID NO: 478598 - DNA, 526 bp, Homo sapiens
tctacggatggcagtgctgacctctaaggatgtaggtgtgcaggatgtgatgcccggggctgccactgtacccaggccaccagcgcaggtgaacgagaagaaccaaggctttagaggcgtgggccatttcctgctccacgtttcagctccagacccggccgcctttatgagcttcgtgcagcttgcacatgtgggtttccacgcgcacgggtgccaaggctggctcctctgcctgatgcttggaccatctgcactggagcccacaggccgggccggaacctccttggcttcctccagctcctctcttggactctgggacgtgccttgcctgctggttccctctctggtgaccagggtggacatgaggctgcgggaggcccatggagggaccacgcccattgcccaccttgttcagagtgacagctgaactgggacagtcttgcagaagggagggccctggccgctttgctgagggaggtgggagtcagatgggacttgaggggtgggttctcattcctggaagggt

SEQ ID NO: 478599 - DNA, 1536 bp, Homo sapiens
ggcctgcagagctgcggtgcctataacatgaggctggctccgtctaacctcaaggaacatcacttgggggacaacggcttttatcactgggggatgcccgttcaagtccactgcgttgtgtctgcctttgtgcgctcagcagaatcccagccacactcacattcccacaaggacattccccccatctcatcccttctgggggcctcaaacaatttctacgagtgtccccaagtccccagaataaaactgttcctcagcaggcacacaaacccttttaccatcaccccaaacatccagaatgttggatccagggtcctgcctgggcctgaaaacctggactccaactctgtcctgtcacgaagtggggtccacatgggggacaaggagaccctgaccccacagccagcagcacaccccggtgtacgcaaacagcagcaaatgcagggcctggggactctgccctgggcgctccatggtcgctgacagttaactatgggaagctggaaaagccagagggcgggtgatggggctctttctgctccaggccaccagggcctcatgttttctgcattggcctcaagtgcctgcccggtgggcacacacggtgggtcgctggctccccgcatgggctgtgatccaccgagggtccctgccctggatcccacagcacacggccttcctgttctgtgggaaccatctttggcaccagatacacaaaaagtatgtgtgtccctctgcagcttagggccgagccagggcctggcgacagcttccaccgccgaacgcggcttttcctgatcagccatttgtcagagccagacgcggactgggggcctagggatgtgcacgggtcccaggggcgggcgtggagaaggctggaaccaaggagattagagactagagaaacagacgtgcctcttgctctcagttttactgaacagattttcaaggcagtaaagtttgatgatggaaggaaaaagagggaaaagcagtccagcttttacaggaaagcacaaattcatacgttgcaggttctcctcccctgcacggtgaggaacagagaaaagggccaaggctcccctatccaaaggcaggcagagccacctgcaggatctgctcccagagagggaccaagcatgtgggtggctaaggggccaggacctgcctgaaagaggggggacggcacaacctggacaccccaaagatcacagaacatggagctttagcaggagagaccacagatgagagtgcagtctgccccttattttacagataaggaaactgaggcacacacaaggaatgacttccacaaggctctgattgtatccagtttcctgattcttagtctagaatttttctctgtaaatcttggccgtctggggagaaagctgactagggagaggacaaagggttgtggaataagagtgcagctctcttgcagccactgaggctgagacaacacgtccttgagtgggaagcacagtgggtccatccttggctcccccgtgctcctggatggacagggtaggaaggctc

SEQ ID NO: 478600 - DNA, 605 bp, Homo sapiens
tgggatctggcaaggtgatgggctgtcccttgcgagatgaagttgctgctcctccccgctgcaaaccgcgtgaattccccgtggctccacctacttcccccagtgcgcatgttgggcaccggtctgctgcaggagctttggcaagactcacatctcaaaaaccgagctccctgagtgagcaattcctgtcccttttaagggcttacaactctaaggggtcacaacttagtggcttggagaagtatctagtgactggctgtcctaggacccctcagatagtgacagttctggaggaccgttgtccaggacagcagagtaagactgagaaggccatgccagtgtccaggagacagttaacctcctggccctcaatggtcaagcatacctggggctctgtgagggtgacggcatgggctgacacttgccccgggcaccctcagtcctgctgctggatcatctgcaaagtggttgccactactgattgaatgcatttgggccatccgcgggttgctgggttaaggatttttgctaggaaggttacaggttgtcagtggtctcagtgctttcaggctacgcccttgtttacaccgacaacaagttggtat

SEQ ID NO: 478601 - DNA, 558 bp, Homo sapiens
caaagacttgggtgcccttggggtctccactgtgccaagtttctgcttttagcagtatgaagccatggtttttagtttctgtctctagtgataagtggaaaagagggacgaggaaggggctttaccagcccaatcagaaacagaaactaagaacccatgactgtgttctctcccttggacaccctggcagggagtggaaattattgaacactaagagctgcatgcccacaggaaaaggagcaccctctcctcactcactccacagtgcgcagagggcagaagttgaggaggcaaatatctcagctgcagctcctagtttctacagaggctcaaacccctcaccagaccaagccgctttctgtttccatcagaggaagccagagagcaggggtaacagttttccttctaacagtcaggaccctcagctgcaggtctgttggaatttgctggtggtccaccccagaccctgtttgcctggctatcaacagcggaggctgcagaacagcaaatattgcagaacagcaaatgttgctgcctgatccttcctccagaagcttc

SEQ ID NO: 478602 - DNA, 577 bp, Homo sapiens
accatatggacgggtttgaaggccatggaaaagtgtgtggtgtgggcagatccagaagcacctgtgcatcggcaggacacaacaaacagggcccagtaccaaagcaaaccaaagacatgtggacctcagactgcatctgagtgtccttgccagagtatacaagcttctgggtggctacctcctaaattttcaatattgcccaagttcaccaagtacttgtatgaacttcatgtcctgactccttggaccagagagactagcagccctctttttggacactctcaagggtggcattggggcagcagtgcagggcctgggacctgtgggttccagttccaggggacatctgagcacttcctggccacacacaaaaacaacgggggaagtgagacagtggggatccagatggctcctcaggaggtagcggcccagagctgccataacagaggtgcaaagagagcccctgcaagctcacttctgctcccaggctggtgagactgaaaacattgagggaggatgacattcaggccttcgttcctttcatagatgcaaaattgttactgttctcttacaaaat

SEQ ID NO: 478603 - DNA, 721 bp, Homo sapiens
ccacacaaaccattcagggcaagtgataatggatagtccatatatcatatctctgcatattttaaagctctggtctcagcccagcccccagcccaaaggagaaccctttgtgctcaggtactcaagttttcatgtccttgcaagtgaatattctggcctgaacatccaacctctgagcacacgtgtgtggacacctgcctggattcccacttgctttgttcacccactgaactcccaacttccaaaatctgcgtatggctcttaccacacttaccacactgttgtccacatgtctgtgctcagctaccccttgagcccagggtacatactggacagttggtcagtcctcaggaagagacctacaggaagtggatcaaatccaccaaatagagcaatgtgtgagcttttagaagctgttgagcagtcctggagaacagccagccaagaccaggaaggattccaggaaggacctgaaacaatgaagtttggagatgaatttcagaaatcatcattctcagatgaagtaaaaactaagcaaaatttttaccaatactcctaccctaaaagtatgggatgcttcccagtcacttacttatgcttcttgatctgacaaaaaaaaatgtaagtacaagacaaaattattttgaaatgtatccacattgtagcccctatcaatagtttacacctttttttttactgctgagttgtatttcatttcatg

SEQ ID NO: 478604 - DNA, 656 bp, Homo sapiens
gtggaatttcctgctgtgttggtctctgcatcggtcactgtgatggtccctgctctggaacagtgtagacaacaactgagtctgaaaggagaaggatggacaggatccagatccagggcttttcaagttgggattcccctggggccaggtatatcaggtgtactagggtgtgccagagtaccaggtgtgccggagggatcagacgtgccaagggtgccagttgtgccaggagaccaggtgtgccaggaacaaggtgtgccagggaccaggtatgccagagaaccaagtgtgccatgcgtaccaggtgcatccagggaccaggtgtgccacaggaccaagtgtgctatgggtaccaggtgtgcccagggactattcacatcaggggtaccagatgtacaaggcaccaggtgtgccaggggaccaggtgtagcagggataccaggtgtaccagaagtaccaaagttctgttatttcaaaaatgtcatacaagagaaaccataaagtatgtagccttttacaattgactttcaatcagtataattcccatgagattcatcagagttgtggtgtgtttcaatgcttaatttcttttttactgctgaggaatgtttcatggtaaaggtatgccaaggtatgcaggccacctgggggctttc

SEQ ID NO: 478605 - DNA, 564 bp, Homo sapiens
ttttttgttttttgtttttttgttttgagaaggatctcctctattgtcctgggcagtctaatgctgggtgcagcctgctatgaccttcacagtgaggataacacacaagatgtagcttcacaagtcctctttgatcagcagccatccagctctggtctgccgaagcctcctgtttcccaggcagcttactccaaggactcaccgaacaatgcagagacagcaggagcctgtggagggggcctcctgctggcagatagaacatgcaatctggttccttgtgcatacacatggagacagcgtcctgttttcagtggcaatattgttttgcaagccccacttgctgtagaaatccattcaaagagaaatccattcaaaaagaaatccactcaacatctggctatcaaccatctggacagtgctgcaaggagtaagggagtctgttattgccagtactccaggaggaaggccaggctcaggaacgatggagggtggatacttcattctgggaaccctgtgaggctgtggaccagagatagttcctcttagcacagaaactgctcattt

SEQ ID NO: 478606 - DNA, 641 bp, Homo sapiens
cacagatggccatgtgtgaaccccggggaacacagccctggcccttcgcacagctgtttcctgattcacttttcttcttcagaagaatgaagctggatgtaaatttcaatggatgcaggaatgaggccaagagacttaaaggaacttctccagccctctggagctggagccctccggagctggagccctctggagctggagccctccgaaagcaggaattccgccatgcagagaagcttggggtgttgtgtgggaaggctgcagatgctgcatccagcccacctcctcccttgccaaataattgtgttgtccgtgtgcctgagcgccaggtccgcgtgtgcaaactggcagggatggctctacctagtggggttgctgaaggattgcgcacatgtacgatggttaacgaatgatgtttaacatcttttcaggggcttatttgccatctgcattctcctctcttaaatatctgttcatgtctcttgtccacgttctaactggattgctgtttttgttttaactgctgagctttgagagctcttatagtctatattcaagcctttgtcagatttgtggtttggaattaggtatcccagtctgtcatcgcgtcttccatcctttcacctgggctttctcaaacc

SEQ ID NO: 478607 - DNA, 485 bp, Homo sapiens
cacccatccatgcatccattcatccatccatctgtccacccatccatccacccattcatccatccactcatccatccaaccacccatccacccatccatctacccatccacctgtccattcatccatccacccatcatccacccatccttccacccatccattcatccatccatccatccatccatccatccatccatccatccacctacccatccacccgtccatccatccattcatccatccacccattcatccatccactcatccatccacctatcaatccacccatccatgcatccatccgtctacctatccatactaatgtacaatccaagaatgggtccctgaataatttacagttccctgtaactgaacagaaacgggtaaaagcagtcagcggctagcacttgctactgtgtcaggtactgcccagacaactttccatggattgacccatttaccctccgaaagccctaagcagtgt

SEQ ID NO: 478608 - DNA, 675 bp, Homo sapiens
aatttaatcattctaaaaccccctcatgcgatccctttccagtcacaccctccccctctgcatagcccctgacaaccacgggcctggtggaaccgccatcaataaatcaagtgtgatcagggtgaggaacaggaaagaaggaaatttggggaaatggggtgaatgtcaggtggatcagagagatacagtcatgggggtcaggtgtggtatcaggaataatgtgggaggccggattgaagtctgggccaggaacaatggtaattgtgggagactcaacaaagaggggcttccgaggccattgggcagtgtcagtcttcagccgctaagccgagaagatctgggaaggagtcagagagcctcgggccagagttccaggggctctgggagtggctaccagaagtcagggtttacttggggggtagagggcaacagacatgaaaagtgtgaaaaatgctttcccccagtgcacactctcattggctcccagtgcaaagaactgctgctgcacctgcggcagtgtacagggaggttgctggtggatgggaggtgaccccatcttcatgtctattcctgggtcgatgctgcaattagcccagtgcctgcatctcctttgtactgagtggctttggcgagctgtgcttccccttcccttaggggtggtccatactgagggtt

SEQ ID NO: 478609 - DNA, 755 bp, Homo sapiens
gcaaacaaaagccatttaggatctgtaaactaaatttgctgaattcaaaatatgaattttctactgtatagtgcatggaacaatatatattaaagtatactgtgaattactgtctcattggaggttttatcaaagaaacagttacccaaactaatgatcctttgaaaaacaaatgtgaagtggctctcctgtggcttctgtggatccttcaggttctgggaaggaacatttgttctaaacccattatttgtcaactgccttataccacaaaattgtcctggattccctgcctaacacgtattactaatgattctaattatcaaggcatttggcaagagtttcaagaagagcagactggttctggggggccttacaaggagaatacagtgtggagcaccagatgcagctgtagccaagaaggctttaatggcatgcaatctccctttaggtgataacatataaacctggtgctgcaaatctattgaattatctctgagagagaaaacaagagagagacatggagaagggaaaggagaaaggaagaaaggaaaatcggagaacgaaagtaaatttgacgatattcactttgcatttttatgattagccatatgtaagcaaagtaatttcatggttaatgaatgaaataaggatgaatttataaccttaaaccacattgataatgatggagcattttgctttgtaaattaactatctccaaggttcatttgactgtggaatgtattaatacttccctt

SEQ ID NO: 478610 - DNA, 522 bp, Homo sapiens
tcgatcttgagttaattttgtatatcaggaaagggacctccacaatgactacatcaatttatattctcagaaacagtgtaaaaagtttccagtttctttacttccttgccaatacttgtgctcttttgataatagctatcctgtcagccaagggaagccatgagagactgtaccgggaggaatggtgcactctggctcagatactgtgcatctcccacaggcttcacaaccggcagaccaggacattccctccggtgcctatgccaccagggccctgggtttcaagcacaaaacagggcagccatttgggcagacacaaagctagctgccggagttttgttttcttttcataccccaatggcacctggaacaccagcgagaaagaactgttcactcccctggacagggggctgaagccaggaagtcaagtggtctggctcagcagtttccttcctcacagagcccagcaagctaagatccactggcttgaaattctcactgctagcacagcagtctgaggtc

SEQ ID NO: 478611 - DNA, 1613 bp, Homo sapiens
tcaaagtaaaacacttgtgcattatgttttacgatactaagattcaggccctcagctgcaggtctgttggagtttatcagaggtccaccccagaccctgtttgcctgggtatcagcagcggagtctgcagaacagcggatattggtgaacagcaaatgttgctgcctgatcattcctctggaacttttgtgtcagaggagtacccagccattaatgagcgaggctccgtgggcgtaggaccctctgagccaggcacaggatataatcttctggcgtgccatttgctaagaccatcggaaaagcgcagtattagagtgggagtgacccgattttccaggtgccatttgtcacccctttccttggctaggaaagggaattctctgaccccttgtgcttcccgagtgaggcgatgcctcgccctgcattggctcaggctcggtgcactgcatccactgtcctgcccccagtccaacactccccagcattcactataattcctgaatttagatttgggataaaatagtgtataataaaaaaggcaaactagtgttgtttattgaaatcgggacaaaattgtgtatatggttacatcagggtctcccggaaaattaaaatttaatgaagagcgggaattttcatttgctttgtgctgctatattttcagcatatagaacagtgcctcaccatgataagtgtttaataaatatttgtttgcatacatcttaagtaaaaattattaacaagcctcttaacttattgcaattatgaccacaatagcatacttgtaattacagtttataattatttggctaccatatgaatgtctattacatgcaagcattttactaggtactttctcatgggctgactcattttgtttcatgatagccctgtaaagtagatacagtcatcccattttacaaatgaataagctctaagaattagtttgcttaagaacccacaggaataaaactaagttacctgaacatggtaaagttttcatttaatgtttggttttagctaaataattctccctatagacctttaagtgtaagaacaatattatttgttctaatgataaaaggaggtaggagaaatttggttacctgcaatgattttcaagtcatgaaagtataccaaataaacatttcacattcacatttctgcaacttttccaaggataataccagtcctgaatcttaactagatattagaattatttggaagctttaaaaaatgctgatgactagttctcacccacagaaatactgatttaatgtaccccagtttccatttatatgggttatagtctggggaaataaataaataattgactcaggaacatggaaacaattattcttaagtatcatttaggtatttttttaactcagaaacatttgtgtttgatttcaataagaaagaacatactctgctatataatagcctttagttgtaaagattaagcaaattaataaatgtaaagcacttaaagcaacacatatagaaacatagaaattactcaaagattgttagctattataattattgctgctgttactgtcatcattattacttgagggattaaatggaatgaacagcgagccttattttta

SEQ ID NO: 478612 - DNA, 1757 bp, Homo sapiens
gtgagagtgcccagcaaggcacaaaaggatggtcggctcagcaggactggggagggagcactcaaggctgtacttgagcgggaaggctgaggactcccgagcattttcccagcaaacctgcagcccggagcctgagaaacgagaagtgtctgtgaggctgaaccaacatcgatacagtcttctggccatcacagccccagatattgccacagggacctccacccagtgctccccacccatcagtgcctggccttctccttgctccccacggggctcccgtgatgcctctacgtctcccccaggacagccactccccctccttgctgggcatcatggagtggatacgttgaaccctgcttcatcctcacaagcagatggggagcctggcagtcgcttgtactggctccctttgaaaaatgagtggtccagactgtgcctactcctgtgctgctggctgccctggacactggcctctgagacttccagcatcatggcatcaggcttggccaagcagctgccttcatgcagcctggctgtcactctgcctgctgacctgagctcacaacatgacagcaacagagacatgggctgctccctgagccctgaccaggggccgggagccacgctgaggactccggggggctttctttattcccagccagggctgccatcatctgaaggctcgactggggctggaggaggctgcagttacattctcagccagggctgccatcatctgaaggctcgactggggctggaggaggctgcagttacactctcagccagggctgccatcatccaaaggcttgactggggctggaagaggctgcaggtgagcgagaaggccactggaaggcagactatgcatcctgccggagtgtttgctgaggcctggatgcttcctgtcggcctcagtgacactgagcctctgctggaacctgctccgggaagctctcaatgtgccctgattatctgtttcctatcagcttccactgataacgagaacctctcaaaggccggcccctgtttgcactgcccggtcgtcagccgtaggaagatgttcggtgacaggcaaggacccacccattgggcaaatgcggacgtgggccctgcaggattctggggctggtcacgcagcagggagctgctactgccagtgctactgcagctattactacctccactgctactgtggctgtcactaccaccactgccaccacagctgtcactccaccaccgctaccgcggctgtcactgccaccactgctactgcagctgtcactaccaccactgccaccacagctgtcactccaccactgctaccgcagctaccgcagctgtcactaccaccactgctactgcagctgtcactgccaccactgccaccacggctgtcactgccaccactgccaccgcggctgtcactaccaccactgctcctatggctagtactaccaccaccactgctactgaagctattactaccaccactgctactgctgttactgctgctattacactggcagtggcaatggtaacagtagtactaggaagaggagtactaggaatatgaatagtgataattaccactacttgaagtactcctcctcttcctattactactggtagtgctagtacggctagtaggggtagtaatcgtggcagtaccactactactcctagtactgctgggttgtaaatagaaaactccctagagaaaataaggtgggactgcaaagcttttatttcctgagcct

SEQ ID NO: 478613 - DNA, 699 bp, Homo sapiens
gagcttcagtatgcaccgggttcatcccccaacgcctgtggaaacgcatgggccccccgctcctggaggatccatggtgccttcgctggacaatatcaccttggcttctctcatttccagcaagttccagagctgggacggggccctggcgatgtgctttagctctttctttgggcctggcttccttgatggacagcagctggcccgatcactagctgctgctgtctgggagacaaggccaggtggttggaggggctggcagggaaccaagttcaattcacaagggttgtgtgcaggaggctcaggcaatgggatggaggctcagggtggagacactaagaaggagtcagagaaagagcacagtgctgtggagggtggctgtccagacctgcccaggatgccagcaggggccctgggtgcagagttggggggcctcgcctctgtgctgtgggggcctctgcaggccctgagaaaagagtggcattgcccacttccctactcttgtcttaactaccaggcacccgtccttgaatttcctgcagaggcctaggcttgcccgtgagattccaatgcaaatatattttccacaaaacggtatgtatttttgtaaatcacaaaaaatgttttgataaaatccatcctacccttgtttttattttgtgtattgtgtttttggtgttctgtcaaataaaactttat

SEQ ID NO: 478614 - DNA, 496 bp, Homo sapiens
taagtgcactgattgcttttgggggtgatgggtgaatatggggctgtttcaaagtatgaagtagaagccaacaaaatggaaatgaaagaaactgctaaacaggatacactgtggcaaatgagctcaactagcaaacccgtgttgaatactcgtgaagtcaatcctttgaagaaattcaccattcctaagatcaggaggacagctgagaaagaaggcaaggagaagcaagtcacatcttacatggatggcagcaggcaaagagagagagcttatgcagagaaactcctgtttttaaaaccatcagatctcatgagacccattcactatcatgagaatagcacgggaaagacttgcccccatagttcagtcatctcccactggatccctcccacaaaacatgggaattatgggagatacaaggtgagatttggttggggacacagagccaaatcatatcagaccacaatggaattaattaagatgatcaagtaggggg

SEQ ID NO: 478615 - DNA, 7609 bp, Homo sapiens
cacagtgtttgtgactcgatgttgggatgatcaactggtttttagggaaacaggtggtatttggttacatgaaaaggacatgctctctgaataactgtacagtggccaaaagatttggaaaaggaaaagatgctactgtcacctttgtgcatttcaagaaacctgtagatccatttgttcaagaaaactgtttatgcaatgcactaaattcagagataaatcctttcatctcaaatatttctaactcctatggaaatgtacaaaatggaaacatttctatacctgaaacatacagtggacagacagagcacagtttagcagaaattagagacacttctcaagtacttgcacatgattcagacatttcacttatgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgattgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcaataatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaaacattattacaggaaacttccttatgggcccattaaacctaactttgatagcaagtaaaaagtacagtattcctcagttatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaaaagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgagatgtacagatcacttagaaattttaaaaaaatactttcagatgctacaagataataacatggataatatttttatcacagaagaaaatgttttagacgtggtgataaaccacagccatgaggctatcattttaaagcctgaagctattgaaatgtatattgaaatcgtcatggtctcagaaacaattcactttcttaaaaactcaatagcaaagaaactagacaaacagaggtttcgaggtatgctttggtttgatttgtcacttcttcctgagctggttcagtgccaagaaaaaatggcttctttttcatttcttaaagataactcaacagatgtttgcctttggaaagtgatagagactgctgtttccgaacttaagaaagatctggatattatctgcaaatataatgaagctgttaattgctcatatgctattcatttgctctcaagagaacttcaagaactttcagaaataaaaaagcttctgaagaagtccaagtattttatttccacatatattgactttgtgccatatatagcatccataaattatggaagcactgtgacagagttagaatacaactacaatcaattttctacactgctgaagaatgtaatgtctgcccctaggaaagatttaggaaaaatggcccacattaggaaagtcatgaaaacgattgaacatatgaagatgatatgtactaaaaatgctgaactaaccatttcctttttcctatgccaaatgctgtataacagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtatgtatgttttaaaacaaaacttttataagtattctttttgaaaacaagtctactcataagcaaacaagtagtttgcagaattctaaaagttaagaatggtaaattgtctggcaaaatgaatttactaactataatattgatttaaacaattcatattatctataaaatgatacataaattatatgtataggtgataccttgcaaatgtctactttttaaac

SEQ ID NO: 478616 - DNA, 490 bp, Homo sapiens
ttgctggctctcacactccccagagcacagaaacaccctcctcacaatgctgccactgcaaggggatgagaaatgggtgatgtccttgatttcagactgttttttgtacctcttcagtgtctcttttggtaatatgaaattaaaaccagatgagggggatttctccccagtgcagtgcagcgcaaccgatccaccatggggcagccagagcgctttgttaagcagatcctggatccagtgccttatgactgggtgggaccctccaacaggcactgccagacaccttatacaggagcatttccaccagcatcaggtcagtgcccctctgggacagagctcccagaggaaggaacaagcagtcatctttgctattctgcagcctccactggtgacacctcccagtgcaagagggacccagatgaatagggtctggagtggaccctcagaaaaccacagaaaccctatggaagagggtcttacctgttaaaat

SEQ ID NO: 478617 - DNA, 694 bp, Homo sapiens
ctgatgtttctgtgaggccattagcttgtggtatggggcacctcacactgccatccctggcttctgccaactgccaacattcaggaaggcaggcttctttaaatctgaaggacggcgagggagctgctctgctacatacaaaattcccagccagaagcaggtggtctaccagtggtttaccaccaggttccccacaaaactggcagtgcatgaatggcatagatgacgtcacatctaaaaaagatatttgcaaagtaccccggttgcctcggcaactggtgctcaggaaggcggcctggggtgtagcagcggtgttggctggacgcccacctgctttcagcgtggctgaggggactgcccccaccccacagcctggccacctggcaatgcccagtgactgtgggaggtggctgtctgggaagcctgttctcgctgccgacttctggggctttgctcgcacatatcctcttttgctttcttgtccccaaaatgcctcttcccagaaagaatctgagtcagtctctcgtcattagattagttcctgccaaactacggcagatgtcaaagcagctgataggaagattatgattctccctttcgcaaccccaacagaaaaagcggagtaaagaacccgagcggagaaggttgtcaggcaaagttccgatgaggagggaagatggttctattttggcag

SEQ ID NO: 478618 - DNA, 583 bp, Homo sapiens
tttctctctagaaagacagctgtggctccagcaggacagatgggcaatagaaggtggcaccttctccaggatacggaaaaatggatggatttgagacattggagaaaatgacaagaaaaaatactttctaccgcccgcgccgcccccaggagccgcggggaccctcgcgccgtcgccgccgccgcctggatccccgcaccaggccagcggagaagaccttcaagcagcgccgcaccttccaacaaagagtagatgtccgacttattcaagagcagcatccagccaaaagcccggtgataacagaacgataccaaggtgagaagcagcttcctgtcctggataaaacgaagttccttgtacctgacgttcgagacgtcaacatgagtgagctcatcaagataattagaaggcgcttacagctcaatgctaatcaagccttcctcctggtggtgaacggacatagcatggttcacagaacccagcgccttttcggatagaagttttctactcagctagagaaatctccctaagaggatctgtaggcctcagctgtgaagcataatccctgcaaaacgcatttgcc

SEQ ID NO: 478619 - DNA, 1281 bp, Homo sapiens
ctctggcatcaataaatggttcccaactctggctgctgattagaatcacacagggagtttgaaaactatcagttgctcaggccccgcgagtccggggctggcctgccgtgccctaggcgtagtactgtaggttggctttcttcttggcctggacctccaggatgccttccatgtagtcctcgtgggtgagctccgtggcacccctgcgcagtgcgatcatacccgcctccacagacacagccttgcactgggccccgttgaagtcatctgtgcagcgggtcagctccctcgcagttcacgtcaggactgacgttcatcttttgggagtggatctgcatgattctggcccaggcactcgatcttgcggtccaggccgccctagcgtagcagggcggggtccaggatgtccacccggtttgtgactgcaattaccttaacttgggtgttgggctggaagccatccagctggttcagaagctccagcatcgtcctctgcacctctcggtccccggacttctcgctgtcaaagtgcttggtgcctatggcatccagctcatcagtgaagatgatggagggcgctttctccttggccagggcgaaggcatcccggactagcttggcaccatctccagtgaacatctgcaccagctgggggccagtcaatatttggaccatcctcctcttgatcattgggatcaacatccaggagctcgatgatgttggagacaaggtacaccagggttttgttcacattgattttctcactgttctctttgatcttgtccttcatggcttggagctcatgggtgactctcaacagttaactcttcatgatcttgatctcactgtccagaagccatgtgcgctggatgatctcctccgcgggagaggagcacaggccctggaggaaagggtatgttggggtttagtgcggctgcccttgctgcagggcagggcagtcagagagacacggaagacatcatgtctgcctgagtacttgagcctgcaggagatcgtgccggaagcttgctggaggcaaattgcagagggactcttacatgtctcagaatgtgaactcgccagcaaagagccatggatggattttgagctggagaaaatgcccaatatctgaattaggctgactttaaatctgttaatgttttggtttttctgagtggatttgtagtttgctaatatttccttaaagatatattatctccattccattcttgtcacttttcttaacttgatttaacacatgattaagtgatgattgactac

SEQ ID NO: 478620 - DNA, 798 bp, Homo sapiens
cagcacactccctagaatgtcttccaaacgtatgattctgcaagtcgtcatgttcaacagcctggagacatttccttcagaattctcttctcttcctttcccttcctgcacagatattcaccccacccccatcctaacccagcgttttggctggcgtggcttaattgatctagaaggccttgcctgtagtatccagagttttcgctattccaggcaccctagaatcattctaagctattggcatggaatgatgagttttatgacttggtgtttggcgatcctgggcagcttcccctctcctagatggggaatgcattatctgcactgctttcctcccttgaacagcagctgtgacaggtcacaagctctcaactactgggaaaaaggaaaaatgggctgcaaatcctttaagagtctgaactttgggtttgaaattggatttggggagaggggatacgacggcgaggtggatcctgggtataagatgattggcggaagtctttctaaggctgtaataactgagagagtccttcaagccaaggcgggagtaccagaaagggcctataccaatggaaggcctgactacatcaagctgccctcccttgcacagactggagctgaccttcaggctggaagctttgaatcttaaatagttaatggaaaattaagcaatgaagcctcacacagtgccattttctgcttccacctgttggctctccccagaatctacctttttagagctttaaagtcatttgaaatagtttgcctagggtttatatgaagtggtgacagatattt

SEQ ID NO: 478621 - DNA, 495 bp, Homo sapiens
gcaagccaaggaccccaacagcatgcacttgcttccttacaggagagattttgggcctcacaaagtggcaccagtgaaggtccaccagtatgaccagttcgtcccgagtgaagagaatatggatttgctcacgacgtataagaaagattacaatccctaccctgtctgtcgagtggaccccatcaaacctcgggacagtaaatatccatgtagcgacaagatggagtgtttgcctacttataaaggtgcagggagaggtctgcgagtgaaaaatgctccttgcttgtcttggggctacatctcaggctgtcctcttcaaactacagaagaatggtgccttgttgctgtgtcctcatgtggtgaaagccagaaggaaaaaagggccttggctagctccctccagtcattgtatagcagtgctaatccattcatgaaggtggagcctgcatgatgcaatcatttcccaaaaggcctcacctcccaataccaccgtat

SEQ ID NO: 478622 - DNA, 2286 bp, Homo sapiens
aggcctctgcttcaaggtcccaggggctaaatttctgccagaaatggtggcagagtttggggaagtgaggatgtgggaaattggcaagtggagtccatgtagtctcacatgtggggtcggcctacagaccagagacgtcttctgcagccacctgctttccagagagatgaatgaaacagtcatcctggctgatgagctgtgtcgccagcccaagcccagcacggtgcaagcttgtaaccgctttaattgccccccagcctggtaccctgcacagtggcagccgtgttccagaacgtgtggcgggggtgttcagaaacgtgaggttctttgcaagcagcgcatggctgatggcagcttcctggagcttcctgagaccttctgttcagcttcaaaacctgcctgccagcaagcatgcaagaaagatgactgtcccagcgagtggcttctctcagactggacagagtgttccacaagctgcggggaaggcacccagactcgaagcgccatttgccgaaagatgctgaaaaccggcctctcaacggttgtcaattccaccctgtgcccgcccctgcctttctcttcctccatcaggccctgtatgctggcaacctgtgcaaggcccgggcggccatccacgaagcacagcccgcacatcgcggccgccaggaaggtctacatacagactcgcaggcagaggaagctgcacttcgtggtggggggcttcgcctacctgctccccaagacggcggtggtgctgcgctgcccggcgcgcagggtccgcaagcccctcatcacctgggagaaggacggccagcacctcatcagctcgacgcacgtcacggtggcccccttcggctatctcaagatccaccgcctcaagccctcggatgcaggcgtctacacctgctcagcgggcccggcccgggagcactttgtgattaagctcatcggaggcaaccgcaagctcgtggcccggcccttgagcccgagaagtgaggaagaggtgcttgcggggaggaagggcggcccgaaggaggccctgcagacccacaaacaccagaacgggatcttctccaacggcagcaaggcggagaagcggggcctggccgccaacccggggagccgctacgacgacctcgtctcccggctgctggagcagggcggctggcccggagagctgctggcctcgtgggaggcgcaggactctgcggaaaggaacacgacctcggaggaggacccgggtgcagagcaagtgctcctgcacctgcccttcaccatggtgaccgagcagcggcgcctggacgacatcctggggaacctctcccagcagcccgaggagctgcgcgacctctacagcaagcacctggtggcccagctggcccaggagatcttccgcagccacctggagcaccaggacacgctcctgaagccctcggagcgcaggacttccccagtgactctctcgcctcataaacacgtgtctggcttcagcagctccctgcggacctcctccaccggggacgccgggggaggctctcgaaggccacaccgcaagcccaccatcctgcgcaagatctcagcggcccagcagctctcagcctcggaggtggtcacccacctggggcagacggtggccctggccagcgggacactgagtgttcttctgcactgtgaggccatcggccacccaaggcctaccatcagctgggccaggaatggagaagaagttcagttcagtgacaggtcactgagtggcagctccagtgtgtggacccagggtgatgaggggtggcctgatactcagtcctatcggtgcacctgctgtacctattacaccactatgatgccctctcctctaccagccagtcagtttatcaagtgtaggattcttctacagccagatgattccttacagatcttggcaccagtggaagcagatgtgggtttctacacttgcaatgccaccaatgccttgggatacgactctgtctccattgccgtcacattagcaggattatgttgtcatactgtactccagtcacacatgctacccccttgcatatctgtttagcaacagtattcctgcccccatgacttcaggctgatctgggaagggacccttagcaggcggctttgcggggaagatcaaagtcaacaatgaagaaggcaatttaaggagccctgggccggattaaagactgatattattaatgcctattttttgtgaataaaacatttgcttttcttctaatgtattccagttgcaatctttattcccctctttat

SEQ ID NO: 478623 - DNA, 3619 bp, Homo sapiens
gttatgaagccggagcctgtcccccggctgggatgagcagcagacgtgccggtcactccctgttatttaggggcctccgttggcgggctgccctgcctgccctctgcgtgccactgggccgtggtgtccatactcaggacccaagcccatgccgctctgccactcgattgcaggaatcctggaggattctgcccagggcccaggagggcatgtcccagcccttctgtgggctgagagcactgaggacttccccctgccctcctctcccatgggaaccccacgccccacagggtgaggctgccgggctctctcacaggcaccttcctgcttccatgcccaacgggcatgccagaagttccgttctggagtcaaaccacatcttcaaaaaccaagcaccagcatctctgagccctgggaccctcggtaagtcccccatccctgcgcctcgcttcttcatctgagcacaggagagcagcctctgtcccagggctgcctggaggatggcgggaggccctgcatgcgtgggcacaggccaggcacccactgcacagagtcggacggggaccgtgctagccgtgccaggtgcgggggatgcgcgaaccggccgacagcggcccagcccttcgcggggccctgccctcggagtcacagagaggctcagtggctgagcctggggtcatcattgatccccaggactgtcccctgctggggaccggacaccagcctgtgggaggacttagctggagaggccacagcctctcctcggtccccatctcgggtggacccctgggctccgagattcaagtgggctgccgagtccctccccgtgctcttgggccagccactagcctggagccgcccacttcctgctgagtccctccccgtggtcttggacctgccactggcctggagccccccacttccaggtgctcccatcctgtgtctccccgatcccagagcaccctgggccaggctgggacttatctacaacaagctcacagctccgctcctgcatagctccagtgaccaccacgggcctcgctccgccaccagtcccagccgccttcctcctttggctgtgctgagggctcctgcgccaggcctgtccccctcagggccccatgggtcctgccacacacacagatacatcccacagccacacaccacgtgcacacacacatacgcacccacaacacacgcacacacacgccgccaacatgcacacatgtacacacacacaaacacacaccaacacacagatacccttcccacgtcctcccctcacagatcccagtggaaacccgatagcccccagcacatccttgagacacgtgtgtgcatgaaaatcaatttgcaaagaatatccccattgcagagacgggggtggggactgacaataaactatggagaagactgatctccgcggagacctgaaggggaagacaaggggctgcagtggggagggtgctccgagcagagggagcgacgtgcatgtgaaagctctggcagtcctcacatagctccccaagcagggggagacctagccggacactgaggctgtggactgtcctaaatggggtttgtcctggaagctgggagaagtggggaaggacagggccaggaggctgctaagagagttggagaactgggtttcaatcctgcctgaccctctcaggatcagcgatctcaggcaaagccctctgcttccctgagcctcagtgttctcatctgcagcctgggggcaacgcccctccctcataagatcatcttgaggatgaatctggatggtttgtatggcaggtggtggggacggagcctggcccaatgggggtgagcaggaggggtcacctctctgattctgacacagcggggggtgccccctaaccccacctactctgagtggcccccatttttaccctgtcccgcggagggttgggggttatactgaatccacctctctgtcccccaggggcctccaccaggccgtgcctcctgggcaggcatagacttggcagctttacagttttattttctgagccccctcgcctggccttcacatcagccccagcaggcggcagaaatttcccgcggcctatgcagggccccatttgcgcatcgccgggaatgctaatcggctcctggcggtcccaggcggagaatcccgcctttccctgacatttgtaaagttcacgttttcaaaataaagccacgtgaagggcgaggcactcgcagatcacttccctgtcaccggcctgctggctccttccctgcccttggccttcactcccccgcttaaaagccatcagtcctgggagaacagccacccccctccccgagcttcgctggccagttcctttctcccagccttctgcctgctttctgccctccctccctcctttcacacactcacccattcacttgttctttcattctgcactatttattgagcacctagtgcacatccttcctgggtgtatgtcaaggacacagcaggaagccccaggattcttgtccccaggagctgacagtcaagtgggaaagagggacatgaaatactcacttaatgacaagtgtgagaaatgccacaaagttggaagcaggggaggtgtcacagggttggggcaccagggactgcttccctgaggaagtggcatcaccccaggcctagaggaggagcaggagtcagccgccaccccaccctggcgagaagaggcagaagggcatttcaggacccgcgggtgcaaagtcctgggatgggggggccagggatgcctgagggtctagaagaggcccctttcattcatcccctctgccttttgtgagcatctaccctgccacctgcccaggggaggagtcagacccactccctgcctgccctcaaagggctcctcgtctgtggtggggcctgctcctggaccggcgaccctgtctgagcacagcacgcccacccagggcccagccagagacccagagccagcctcagctttgctcaccaccccgccagcccaactgggtgattttctgtccccagtgccttctggcacagatacccccatgcccaggggccacagtttgcttcccgggtcctgcagaccccagctcctccctgctcctgtttaggctaccacctcattctcctcgggtccctgcagcagctgccaaaccatttctgcttccacaccacccccagcgggccaatctccctgcacatcccaagagaaaatcttcccacagctccccatggccccccggtgaagtccaggctctccagcaggatgtcctgggcccttcttggctccccttttccaccctccccactcctcaaatgcccatcctcccacccccatcctccgcttctgagcctttcacatgctgctgtctgcctgggatgctcttccccaaccccttttcctggatactccattctcctccaggtctcagctgagactccacctcctccaggaagccctccctgatctctccagactgtgttaggcatcaggtctccactctcactgcctggctacaaacctctacagaatggcactgtgctgaatactgcaggcaattttagcacaatgataagtatttgtgcctctaaatatagaaaagctacagt

SEQ ID NO: 478624 - DNA, 699 bp, Homo sapiens
tgaccccccggaaccctcctccctgtgaggaaagcgtaaccctgtcttgcagatgaggaaaccgaggctcagtggtgccgccgaatcactcggatttgctaagcgcttactctgggctgggcacttgcccagctgcaagaggaagcaccgtcctggggagcccggagacccaggcccccctcacaggcgaggggctggcacgcggcctctggaggaacttctggccttcaccgtctccgcctggtcactcgtcaatggccggctgccttctggaaagctgctgctgcgcgacagtgaccctgggtggagtgaggcatccacggaggctgtgggacctgccttccggcctccgtcacatgaccgcacagcgaggaggcgcttctgtgaaccaggaggtggccctcaccacgcagaaactgtgggcgccttcatcttggacttccagcctccagaactgtgaaggattggtttctgtgggcccccacccatgtttacacaagaaagctccatttataagatggtatccattcaaggctggggccccacaggacccctcaacagctgctggctgagggcagggcatggagcccccgtccagactgacactgtcctgcttgtccacaagaagacagctttgcaggcccaagttaagggtcaatctaaaccttaatcgcccttgacataggggttttactgttc

SEQ ID NO: 478625 - DNA, 781 bp, Homo sapiens
catgaacttatgaatttgggggtagccttcctgtctttggcacactggaagagctgtggcgtagtttctcagggctacgagagaccgaaaaccgaagctcagagaggtcaagagaattgcccaaagtcacacagacgccagtgggaggctgatgccccagctggctctgctgactccaaagcctgggtttgggttcatctgcaggaggaaacacagctgagtcaaaagcccagtgactcggtggcagcgcatgtcttccaggaacagaacaaacacaagcccatatctgcaggcgagccttgcctcggcctccacagcgcgggtggtagagtcaggcgccccaggcccctgaaaaccaggacgcagtcccgtggcccgtctctcccaagaaacagaatcctagccggaccccgtgcctgctgggcgtggagtggaatgttgcagctgcttgggtttggggcaggaaggaaggggagatggaacaaggttgagggtctccgttccccctggagtgcatggaggcttcctccttctcccctttgagatctcaacacaaccccccacgtagattttgaatgtgatcattgaagagtgaggggctgctgatccctcccgtgagagacctgacctggcccctcttggcaaagctatccaggaaccaggtcagaggcagaaggacctttgccctacaaactaccccatcctttcccggactcagagccttgggctatacctggatggattcccttggcctttccacctgaggggcctggaggttagg

SEQ ID NO: 478626 - DNA, 1033 bp, Homo sapiens
ccctgatggcccaggggcctctgtctccccccaacagccctgctcctggacatcatgacggtggccggcgtgcagaagctcatcaagcggcgcggaccgtacgagatgagccccagcctcctggactacctcaccatggacatctacgccttcccggccgggcacgccagccgcgccgccatggtgtccaagttcttcctcagccacctggtgctggcggtgcccctgcgcgtgctgctggtgctctgggccctctgcgtgggcctgtcccgcgtgatgatcggccgacaccacgtcacggacgtcctctccggctttgtcatcggctacctccagttccgtctggtggagctggtctggatgccctccagcacctgccagatgctcatctctgcctgcacgacgcctgccaaaatgcccccaacctactgcctgatgcagcggcagccggtgctggctcaggacaatgccagcacttcctgccggtgctgacgtcccgtcccagagcgttggtgtcgttgtctgtcaaacggggatgacaggggccccgtggggttgatgtgtgactcggggtgccctccacctgcaaacctgacacatcacaggtcatgctcagtgttggtcacagggctcctggcgttgttgcccctggtggcaaggaaggaactgggacacgatgtgctgacatggccgttagcacaaagcagacccgggatctgactcttccaggctttccctggacttcatcactctcagacaccgacgtgtctctagaaccatcactctgcatcccctttccatgaagacccaagggccatgggaggagctgccaacctcagatcccagatgacagggaagaggctgtgactccttcaggacttgccatcctgccttgttgctggacagagcctgggtggggaggtcgatgccattttgcattggttgacagcttccagtgcccatcatggaacaagagagatggtgtgtacctgctcaggcatgggtaatgcactttgttgagtaaagccaataa

SEQ ID NO: 478627 - DNA, 897 bp, Homo sapiens
gctagtcttagtgcagaagggccaagggtgtcctgtggtttggtcattcagctcctgaacctacttccgggcctgcggagacctctccttctgaggcagagcccgccttctgctgtcacagccaaacgtggccaatgtgcacatgtatcccagacggccattggcagccgctgcccccgcctccaccaaggcacgtgctgggaaccagggaccgaggggaaccgttctgggatgggtggcgaccctggacaccaaggcacatggcggtgcccgaggggtggtgctgcctggtggcagcggaggggagaaacccccacacagctcaggccgggcagcgatggcagtggtgtcttcaccaaccacttccgctggagcccattcttccctcccagcctcacgggctccgagctgggtcctctggcctccagaggttctgggagtcccagtgcccttggaatgaattcattttctgcttaaatcagctggaaactatttccgtggcctacaaataagagccctgtcagttgttggaatttctcttcgtgcttttctctagtgaatttccagggcagaaaaatgggctataacgttcttcttttaataagttgtttttaaaaaactattacatcaataatacatgttcactattttaaaaagcaagaaataaagaataatacaaagaagaaataaaaatttttcagcacccagagataataagcacaattactattttgagccaaccttgcattttgaaataaatcccacttggttgtgatattgttttatttgacttgctaatattttttaaggattttcacatccattttcatgggaagagttgacccatgatgtttctttgttgtaatgtcttcatcagaatttagcattaaagttttg

SEQ ID NO: 478628 - DNA, 1222 bp, Homo sapiens
ccccagaggcctctgaggaaactgagccagcatgagagggtggctggttcctggagcattaaacgcttcaggaggacccagatgtcatcaggcaggctgaagccaccatagcacttccccgtcacacttcagcctgtgcctgctgagaacatggtgcgctcctaacagacagtctccatcatcccgccccagaaaatagacgccgatgccaccatcgaatgttcagccttcaggtggagcggctctcaggtgaggagctgacccaggaacagtcccggggagctgatcctcacctggatgagatcccggactcggaacagaggctgcgatgggttgagacttttggggtcgtctgggagggggagcgaggatattttgcacgggaagaaatgcaggactcggtggccagagggcggaggaaaaggagcagagtgacggtggacacgcgagaccaggccatcgaaggcaccgtggctggccgccggccctccctaggattcctcacctgcagggaagctgggaaaggcgaggaaatggagtcccccgcagcgcctccagaggggagcacggccctgctgtccctggtgtcagctgtgagacctgccgcagacttccagcctctgggactctggaatacgtttgtctgcgtgaaccacgcagctgtggtcaattattacagcagccacggggaaggaacgcactgcccgtgggcgacggggaaggaacgcactgcccgtggacaccattgctgctgcgcagagctgactgctcggagcgcctggtccaggcaagcccagcgtctctcaccgcagcggccggagcgcccagtccaggcaagcccagcatctctcgccagggcggccgtggttcgatcgtgcgtctgctgcagctcctcatccgagagggcatggtgctgggcccagtgtacagaaaggggttgtgggaacctcccaatttctggtgagagaggcctattgtacaacaacatcagcctggtcaccgctgaggaccagcaggatgagtgtgtataaagtgcatggaggatgtgttggaatttaaactctgggttcaccagcctttgctaccacagcatagtaaacgttgctgaaaagtttctaagtatcactagcaagcctctgtgaaatcccggtgggaagccctgtttctctgctaccttctgctcctaggagaggccatgaagccaaggcacaaggatccaggc

SEQ ID NO: 478629 - DNA, 630 bp, Homo sapiens
gtcaagagagatgacaccttctgagatgtccaaaagaaccagtgggtcctccctggcttctggtaccaccagccttccccccgccacccctggccgaaaagagccagagaatggagagggtttcgtgctgagggctctaggacagtgcctgcccacgtggcatcccacctgcagcactgccaccatgagaagccaagcagaggggttcacacagcagcacacggaggggctggctgccaggctggccacggccgagctctggggctcctcagcagcaagggactggccctgccgtgcccgagtgtgccgcatcgaacgtggcctaagccagaaccctcagccagaacttgacccctctgtcttgtcaatgcttcccatggccaccagaggccgggacgccgttaccccacgctgtctgctggccgggttaccccgtcttgccaatgcttcccgtggccaccagaggccgggacgccattaccccacactgtctgctggccgggttacggtgaatcccccgggtgcccagaagtgagcttactaaccgggccgtccctgaccactcaggataaaagtgtgcacgccctgtcccttcctcccccaactctgccccgtccttctgatctcccc

SEQ ID NO: 478630 - DNA, 1052 bp, Homo sapiens
ggtagtgccgcagtagatttatgctgcatgaaaactgtgggccttcagcctggggaacccctgcaaaaggtcccaacaggaatctgtggacccttgccagcggagacaataggattacttctacgaaggtctagtttaagtttaaaaggggtacaaatacatacaggaatcattgattcagattataatggggaaattcaaattgttatatctacttctgttctctggaaagcagagccaggagatagtatagcacagctcctgatcgtgccatatgtggaaatgggaaaagtgaaattaaacgaacaggaggatttggaagcacaaataaacaaggcaaagcagattattggacacctgaaaccttatcatgagccagatgtcaaggaagagattctgggaggatcccaaggaccccccggttgcagtcatgttgagactgacactgaggaggaccccaactgtcacaagcaacacccgttgaacacagccactcacctggcgacagatcaagaagctgtcacagatggtggaagaaaacctgaggaaagcaggacaaccagtcacaatgagtaatttaatggtagctatgatagcgatgatcaccattgccatgagtattccttcaacaagggctgacacagagaacaattacacttattgggcatatttatcaatcttggctggcaagaatacctagatgtaatcactctgacacagttacacatgatttctgatctcagtatttatcataataaatttgctcctataattgaggcatattgccctcaaaaacctatttgtaaacaaaattgaacctggccagtaaaaatgaacatgtttgtttaggaagactgcattgcagaacagtcagaggtgctacacaatgattcctatggaatcattattgattggtcccgtaaggggaagtttagcttaaattgcacctctcagactgcatgctatggccacgctatgttcagctggtctgaacacaacattcagatggtagaaatggcaagaagtatggcaagagttcctgttatctggaa

SEQ ID NO: 478631 - DNA, 761 bp, Homo sapiens
gagggtccgctgcttcattcttggagtcaaggcacatgcatgcacatggtggatcagccaacttggggtctggctggctgggggtggggctatgaagctattactctggctaggagcatgggtgcacagttggtcgaccactctgggggcatttctgccagcagtggtccatggaagtggtcttcaaactctggatatgagtgcaagcctgttctgctggcatcagagtgtgtcttccaggggtccagtgcctttacttggaaaatctgggaaagttgggaacttcctagagacttgttgaatggctttgcccaaaatgctgatagcgatatggacaataaggtccaggctgaggtggtcccagatggagatgaggaacttgttgggaactggagtaaaggtgactcttgttatgttttagcagaaagactggcagcattttgcccctcccctagagatttgtggaacttttaaattgagaaagatgatttagggtatctgatggaagaaatttctgagaagcaaagcattcaagaggtgacttgggttttgttaaaggcattaagtttaaaagggaagtggagcataaaagtttggaaaatttgcagcctgactatgtgatagaaaaagaaaaacccattttctggggagaaattcaagctggctacagaaatttgcataagttgcaaggagcctaatgttaatcccctaaaccatggggaaaatgtctccaggtcatgtcagagaccttcatggcagcc

SEQ ID NO: 478632 - DNA, 491 bp, Homo sapiens
ccatttgtttatgtgtttagttgcgccatatgtttgtccctggctctatcctcaagcagatttgacaatatgcagttctagggcaggttccagtcagattggagctacattttccaaatttcagtctgtgctgattcttttaaaagagatgctagttatttctaggagaatgcatgggcttacctcagaaatctgtgcaacttcgtgtgactttcatgtcaggacttgccagagatgccatgtggcatgcttattcaccttgaagatttctagcttcaccaggtttcttggtttgctggagtttggatttactactgagtcatatttggagcatgctggaatcttacaactgagattaccgagtcagaaactgtgggaattgaacaatgaggacacctggacacaggaaggggaacgtcacacaccggggcctgccgtggtgtgaggaggggggagggatagcattaggagatatacctaatgtaaatgac

SEQ ID NO: 478633 - DNA, 646 bp, Homo sapiens
ttaaacagggctagtttaattccttgcattgtttaaccaatgcttggttatgagaagaaagagatcagctgttaccggaagagctattggaagctggcggtcaaatgtgagcaatgtgagcagaggcagaaagtatttcagccccatcagagttgcttgcagagggtgaaagatataggctgcaaggttccgcagtttcatcctggtctgaaggctggatttttacctgcttgtccaggccatgaaacaccccctgtatctgccatcattgaggtcattgcagttcccaaggactacagccttgtctggagaaactgcgtggagacatgcatgaatgcaggtctctcaaacgagggtccacatgccaacagcgcagtggaccgctgtgctgacaaccagaatcaactgccaaacatatatcatggggcagatataagccatacttgctgtaccttctctgaacttgtggcccatagaaagtatgaggcataatacaattgttgtttatatcaatacattttgagtttttagaaacttgcttatgtgccttggttttcactgaggaggtggaagtacattgtgctggttagggttcactcaggttcttctatatctgaagaggatggctactttaacatctttgcag

SEQ ID NO: 478634 - DNA, 713 bp, Homo sapiens
cttcaaattccacactgagtcattcctaccttggatagtttacatggccacgccaatggcacagcccttaaacagaggacccctgaaggaaaagaaggagccaggcataagagaagttggaagagtcttccaggcagaagaagaagcaaggcatgagcctgggatgggaacaggcatctctgatagtggagtaccacctgaacatcagatctgcctagggtccagaaacaatggtgttttcttcatcttttgcggccgaaaaagaatcaccagattgttgtattggaaacagggtgatgagaagacaagtttcaaagcacagatagcagttaagaagtttgtacaaactacccagataagagaagaagggaccttggaccatggtgaaatgagtggaggtggtattgaagctgctctaatagaggcatatccagattgggatcccagggacgcagaaaaggaacaactgctgagagcagaattcttagagaagcagtgacttgaaacagtctctaaattcattagaagcccttattgtgaataaaatagggctgccactgttggctaattaatcaaaagaaccagtttaagagaggatcataaaaataatgcatatacactctaagcagcttataaatattttaggttaacttaaaacataaaaatctgttgttgtttgccaaggttcagatgtacagccaaggccttgattt

SEQ ID NO: 478635 - DNA, 644 bp, Homo sapiens
taggctctagcaagcagtcgccctggaaagagcctgcgcctagtctttctggagtcacgactgcatgtctgaagtactcactcagctgtgtccactctggcttccaagagacaaactaaactgtaacatcatctataattcagataatttgtcaaaccatgacatgaatacattcatcaaatctgagcgctgtgtaagtacaggaagtggcataaatgtcaagaacagatgtgaagctggaagtctggagacattttctgaccatactggaatcgccaagaaaaccttgttaaaatataagtgtctgggctccattggcagacattctgattcagtaggtctgaggaaaggccccagaatatgcatttccaacaaggtgctaatgctgctgatctggggaacccactttaagaacaactggcatggagaattctcagaagtcaccagttccatggtagcttactactttacaaaattctgccatccatattcccagggttagtttgtgttatggttaatatggactgtcaacttgactggactgaaggatgcaaagtattgttcctggctgtgtctgtgagggtgttgccaaaggagattaacatttgagtcagtggggtgggaaaggcagacctaccctcaat

SEQ ID NO: 478636 - DNA, 801 bp, Homo sapiens
acacaacatgctgtttacaaacaatagtagttctcctgtccagcctgcctccgctggatttctcttccagacacttctttctatggattccaggtctgcagataaactctttcaacaaattgccaatcaaaaaatctttgaatccatctatgacctggaaaacaggggtccccaacccctgggccatggaccagtaccatacagcagtaggcaagctgtgggcaggcaagcattaccacctgagctctgccgcctgttagatcggaggtggcactggattctcacaggagtgtataaaatttataaaagaaagaagattgattcacagttccacatggctggggaggcctcacaatcatggcagaaggccagtgtctgggcccctgtgtcagaatcacaggattctcctacagcactgacctgctctttcatagagaattgtgaaaggttataaaaggcttatgaaaatcttacctgtggtcaaatttattaaacttggatagaattatttataaagatttattgaaattagctttaacataaataatacatcataccaagctaagtatagccttcgactattgtgtggagtatatcttgtgatcaaaatttgaagcatatttctgtttctacctgatttctgcaaaatttggaaactgtgcatattcctaatttatagcaatagttatttgcataagtttaataaaattctgttttcttttataactggacacaattggaggcactggttattttaccaaggctttgactggaataatgtattttcagatatgagcagaa

SEQ ID NO: 478637 - DNA, 822 bp, Homo sapiens
agaagtccaagatagttgtagccatgtcggatttctcttatgtcataactttacaaaggcagtttcaatgggagatagaaaggaaagatgcagtggcagttagacacagtcaaagaatgccagaaattgccagcaaaccaccaaagttggaagaagccaagaagcattcccctgcaggtttcagagggaccgtgaccctgcgacaccttggcctcagagttttcagccttcataactatttacataaagatgattcttccatcaccctagactctcagttccttgaattcttctcctttaaaagccctcttccattttaccttacttctatttccaagatgcacttattaccaataatcaaaactccttctcatctcatttccaggttcacagaaaaattgagcagaatatacagttcccatacgcctcctccccgaccacaagcacagactcccccatcaccaacatcccaccagagtggagcatttgctggaacaggacgctctgccatcgtggcaatgatccacagcttctctcttccactgatggcatctgaaagcagaggccctgatgaacttgccctctcatttttagtcaaaatgagaacactcagtccagatgacttcaaagaggcctatgaaaatcaatgctctgggagccacctgactgactgtactgctggaacccattttgcccagggcattagctccatgagtgcatatggtgctcaccttgtggaaaattccaaacaattataacccttaagtctcagcagagagtgtcagcccggagagagctgacccttcaagtcagtagtgaggg

SEQ ID NO: 478638 - DNA, 1318 bp, Homo sapiens
cccacacctctccctccacacctccccgcaagcagaggtagctggctctgaccttggccagcccagagaggggctcccacagtgcagcagcgaagggctcctcaagcgcggccagagtgggtgccgaggccaagaaggcgccgagagcaagtgagggctaccagcacgctgtcacctcttactaatttaaaaatagagccaaggccaaagcagatacgcttctttgtcatgatcgtgctgcggtgtggagtttttcgggcccaacttttcactgagcgtggcaaatatatcagcagcttagaaataatatcctgtgtttgtgaagcatgcgccagcaagactcccaacgccctccacaaacatcagctcaacattactgcgctcgcgtttttctcaccatgtcatggcaaggaggtggcagaaaggctacagtgtcggtgggatggggacacctctgtgggtaacagtgataacagaaagcatttatgtttacctgtagcacagaaagtcaagctgttggagaaactggaagtggtgtgtgaagtgtctttcagaagagatggtgtcagaatggacaccatatatgacctgaggaaacagaaggataaactgttggagttctatgccgaaagtgatgaaaataagttaatgataaaaagaaaaacaatgcttaaggctaaaaatgaagatctcgattatacagcattaaagtttttgaagatgtgtggtgacagagcatctgatgatcacaaagcggcagagaaattcattgatgagtttgccaaggtcattgctgatgaaagtctgatgccagaacaagtctgtaatgctgatgaaacatcgctgttttggcataattatcccagaaagagactgacaaaagctgatgagacagcccccaagtcaatgaagaataaatataacaacacttccttgaacagcatgctggcagcagtgactagaggtgtggacccctttcataagctggaagaagtggatattgaaggagtttttaacataaataatgaggcttccatcactcattcattgaccaatggtgaaattgttgaaatggttctgaatccaggtgatcgtggtaacagtgatgaggaagatgacattgttaacactgcagaaaaagtgcctgttgatgagatgatgaaaacatgcactgggcttattaaaggactagagcagtgcagattcataacagaacaagaaatcatcatgcagtttataaaatcaaagggagacatctaagacaaaagctgttaatgaggcagatgactctggaggaaacattttaaaaagccaccca

SEQ ID NO: 478639 - DNA, 635 bp, Homo sapiens
atgaattccaaaaggaaactccccgtttgtaatcataaaatccttttatgcaaaataaaataaacataattttacttccaaattccataaatgtgaataagggccgcttgagggctccttggtcaagcagtaacgccagtgtctgggaagacacccgttacttagcagaccgcaaaaggcactctcctttccttggaggagtcagggaacactctgctaccagcttcttgtggaaggctagatattatccaggcctgcccgcagtcatcaacaggcctaaacccctccctgtggtgctgtgcttcaatggtcgtgttccttgtccactttcatgttcctcccgtactcctggttcctctttgaagttcgtagtacatagcgatagaaggaatactgaaagtcttaaagttttttatctttcttataagtgcatagaagaaaacgctgacgtatgctgccttctctctctctgctttggctatctaaaagggaagggcccccgtcctttgatcacgtgacttgtttcaccttttcaatcacttagaaaagtcaccctccttaccctgcccccttgtcttgtatgcagtaaatatcagcgcacccagccagctctctgggatcatcttcattttttt

SEQ ID NO: 478640 - DNA, 499 bp, Homo sapiens
catttcaaagacttctggatacagtgtatgagtacattatccagggaaaccaaagcattatcctacccttcccctacattaaagagagattatggagaccagataatacatggaatcttggtcaaagtctggttcacagtggatttgtgggttctctgtgtgaatgaagtggctgtttctctgatccatgtgtgtaattggagtgaacatgttgtatccttggtggaatataactgttttttgtcctatacgaagggtggtgttgaaaaatcacccaagaaggactgtggaaccggagagtatgtcttccttttgttaagacgaggatacattaaaattaaatacactgtttttgtcaaattctcctcaactaccattagaagagcaaacaaaagttctgtagcataagaatacatcttttttcttacatggctagtttattaattagcagtatttcaaatttaagtacatttaaatacattgtcaattcccatgattt

SEQ ID NO: 478641 - DNA, 800 bp, Homo sapiens
tctgctgtgggggtggagccctcatggataacctcttctagggaagtgtggaggggaaatgtggggttggagttcccacacagagtccccactggggcactgctcctctgtgaggagaaggccacaatcctccagaccccagaatggtagatccactgacaacctgcatcatgtgtctggaaaagccacagacactcaacaccagtccatgaaagcagccctggggactgtaccccacagtggcacaggggtggaggtgcccaaggccttgagagcccaccccttgcatcagtgtggcctggctacatggcagtgtggggaaaaatccaacccagggaaagaggataatgaagaggaccgtttgatgaaaagaaattcttcatcattaatggaaaaggtggagggccaggccgagcaacgagagagaagagtttcctcttcccacaaattcttcctttggcagcaaggaactctggattggagaaaggagtggagggacaaaagctggcagggcttacctgatcactgggaaaatggcaccaatgacttgctccatgcaggatttccagaaatcttccgtttgtaaaaagcacagtatctatgaagcacaataaagcaaaatgcaatgaaatgaggtgttcctccactaatttacattcccaccagtagtgtgccaagtttccctcttgtccatatcttgccaatatttatctcatcatgttgataatagccatcctaagaggtataagatgtatctcattgtggttttgatttgcatttccctgatgattagtgatgtc

SEQ ID NO: 478642 - DNA, 880 bp, Homo sapiens
tgcattgtcagaggacaccgaggatgactgaaagaagctcggcgggtaagctgggcactcagaagaaccaggattctgaatgtgagggacaggacccggaggaaattaaagaaaagaaagggaagctgaaaaaggtgtattttactagccagtcggttccacctgctgaattaagtgaatggccacctcctccctctcctcctaatggctacagcaggaagagaagactctgggaagagccaaaactcctgatacgagtgattccgcaaacaaacatctcagagacaaaggagaaaaccgagaatagtcgtcaggcaaattctccaacatggggacaaatcaagaagctggtgcagatggcaaaggacaacttgaaagcacagaacaaactaaaaacaactagtaacctgatggtggccatgctggcagtactcaccatggcggcaagcctccttactataggagcaactcagaatttcacttattgggcatatgtctcatttcctcctttaattagatcaccctctctggaaggaatcaactgccttgtcatgaggatactcacacagtcttacggagaagtcaaagaaccgaggtctcctgccaacagctgggtgagtgagccatcttggatgaaaatcctccagccccagtcaagccttcaaatgactgcagccctggctgaaaaattaaatgcaacatatgagagaccctaaggcagaatcacccaggaagtatactatatttaatggaagagaggtttatttctgttattttgtctgggggacttttcttgaaaaatatgtttggatttttatgggctaaagaaaatgttttaaatgaggtttatgtgatttttatttataccctgtattttttc

SEQ ID NO: 478643 - DNA, 830 bp, Homo sapiens
agagagacttaattcaacccacagcagtctgtgagagtgtaatgaggctttggagaaacatgaaacagcaacagtgtattgaggagggcatctgtctgtggcacaggaaaggaagaggtttgcagatttcaataaggtggtctaggatatggttcactgcagaggagacatttgaacaacatccagaaggaggcgagggagttcatgccgccaaacaccagaggacggataaactgaggcttgatatctccttccaggtaaacaaatttcgtgggcagattcctatcaggataattgggaaacttcctggcaagtccactgaggtgctgtttgatcaaggcacagaggggaagtccttgtttgtaaaggtgcaagatgacccacaaaccctcaccagaaactggaaaagtaaagatttgataaaggcaagcaatgcaaagaagcaactgaagcagaagaaagaggagaaataggaaaagggagaggaggaggaggaggagaaactcttaaagaacacgaaaatttggaatgtaataataatacttggctgtacagacaataatattacatagtcataataacataaatactgtttgctgattttcaaattttcagatcaaataacaagggaaagaagacttgattatgtatacacacacaaaaagaaagtgttatcaaaactgacaagaaaaagtaagtcaaggtacttaaagtagtgctggaagttataagtttcctcgtacatatttttaaaattttaaatctttctggaagtaggtaaggtacaaataaagaaatagcacagaactaattacattttttttgggttt

SEQ ID NO: 478644 - DNA, 664 bp, Homo sapiens
ctgccggtttacactgtttctccaagccatcacagctgatatctcctggacctgagacttaacaacctgctaaaaatgagctttgggggcctacaccatgtttcaatttggactagccatgtttcaaatatcccgtaaagacatgtggctcctggtgactgtcctactggacagcacagatctaggtccgtggtcctcaaatttagcctccccagagcttctgattccctgggtctggaatggagcccaggaatttgcatttctaaccacttctcaggtgatgcctgtgctgctggtccaaggaccacaattagaaaacccctgtctgctaagtaacgggtgcctttccaggcactggcattaccgcttgaccatggagccctcaagaagcccttatgctggcgtgacagaaggctcacctcttgccttcttggtcacttctcacaatgtcccttcagcacctgaccctatacccgctggaaagagatatgatgtgaactctaccattgatatcaaagatgagcaatggaggatggagtgtgggcgcactcgtccaggtgagagtggatagatttttaactgtggcagtaactgtgaggataacaagaaaggcaggggttgtgcgacatgttttgaaatgatttggaattagcagggttgaatt

SEQ ID NO: 478645 - DNA, 759 bp, Homo sapiens
tgcagtaggcccaccccaagcgtaggttcctggaatcagggatctcttcactgagttataggatgcctttgccttatggtcaggtgggcatcatgaatccaagtcagtccagaaccatggcccatggacgggcaggagtgaattcaacacaagtcacagccagcttgctccatcttaaaggcgaggagccccagccccaagtcctgagctcttgccaacctgttcgagaccacacattgaccctggaagaggaggagcagccccggctcctggtggcaggaggtgccttcctggctgtagcaggaagagtctccaggttatatggccgtgtccctgtgccaggactcggggtaggggtacactctgttctgacccccccaggaagtgagttccaaaggagtcgggcctttggaggagaacttggtggctgtgcttttgacctggcattgcaggagcataagccctggtcaacttgagcgaaaaagccggacccactgtcaccatctcacaggctgtgtcgcatgctctggcggaagctctgtaaacaagaagaaagggactgaggacccacagggttgcctggacatttggaaaataattttaaatatttacacttgatctataggagattacacatttgctatggaaagcttcaattattaaatgatcaggttcactagagtaaaaacaattattctctgctgagaaagtattttatatttctactttaaactttgctctgttctggttgaatgtgtt

SEQ ID NO: 478646 - DNA, 667 bp, Homo sapiens
ccccattccttgtgacatactctgtggagggaaccaagagtccaggtgagaagccggtggtccaggatggaggggagggcaccaggtacacccacaggcagcatacagggtcatgacttgcctgtggttggctgcagactctgctccagaacagcaaccaccggccgtctgcagcaggccactctactagtgtgggtgcatggaagggggcctgctgcagtcctcacttcatggtcatttgagctgaggcagtcacgtggccactacaaccaggcctgcaggcagaggcaatctgtgtttaaaatggcccacacgtttcttaaatgtttggctgcagcccctcctggcttcgagcagagcccggctggatctgggaagtgtgcgaccccactgatgtcatgctgtggaactgccaagcacccaagagatgggtacaatctaagtcagagagtcccctggctcaaggagacaggaaccctgcgaggccgatggctacagagaggaccagaaaatagaaaggacatcctgaaggctgacagatttgatcttgcaaaggacaaacttgctgcataaaagttaaacatttctgtttggcaagaagtaaaattactaagaaaaacccgggaaaatgtttggcaatttctgtgaaacataaaaggttagtggc

SEQ ID NO: 478647 - DNA, 571 bp, Homo sapiens
ctcctgttccttttgagagggcaacgctgggaggtgttgggtgcatgggaaatgcaccagcaagtgggactcaccttccctggggtggatgtcatgccgcatatgggatttcacccgtggcaggctgttcatgtcgggtgttgctgaagagattgcatgttgcctgggattccatcccagtcatgccagagttaacctccgagtacagttatgacgattttcactcagtcacaggcgcagaccggcgtcagatggcaagaggaggagtgcaggaatcaaaggtcacagtctcaggagcaaagccccacagacgtctggcttctggatctgtgaccatatggtcaaagattgctctgcacaataacctccagagcagtcaggttgaggatgtctggtactgaagttactccatttgagaagttttatatatttttgttaaataaaattgaattgtaaatgtttaattgcagtaaagcatagtgaagaaaattaaaaatcacttataatctcatcactccaagatacaatcaccattcctactttgtgactttatacagtgatagtcgtgtac

SEQ ID NO: 478648 - DNA, 1466 bp, Homo sapiens
tcaggactacatcgtaggggtcccattgtgtctggagctggttccttccagtgggtttgtggtatggctgacttcacgaatgaagccgcacaccttcacggtgagtattacagctcttaaagatggcacggatccaaagagcagcagtagcaagggttattgtgaagagcaaaagaataaagcttccacagcacggagcaggaccagagcaggttgccgctgctggctgggaggtggccagcttttattcccttatttgtccccgcccatgttccgtttctgtcctatcagaatgccctttttcaatcctcccttttagggaggctacttttaggatcctgctgattggtgcattttacagagtgctgattgctgcattttacagagtgctgattggtacattttacaatcctcttgctagctacagagcgctgattggtgcgtttttacagagtgctgattggtgcattttgcaatcctcttgtaagacagaaaagttctccaagtccccactcgacccaggaagtccagctggcttcacctctcaccatctatgaagcactccaagcccttccgaggatgaagtaggagcctcctgtgtctgactgactggctatctggctggctgactgactatttgagtgactgacggactggctgactgactgactgactggctggctgactggctgactagctgactgactatttgagtgactgactggctgactgactggttgactgactgactggctgactgactatctgactggctgactggctgactgagtgactgactgactggctgactgactggctgactgactgactaactgacttactgactatctgactgactaactgactatctgactgtctatctgtatgactgactgattatctgactgactggctggctggctgactgactgagtgactatctattacttcatgtttctccttaaacccattcactgttttttagggttttgccttttccagaatgtcctatagttggaatcacacagcatgtatccttttcagattggcttcttcacttggtgatatgcatgtaaacttcctccctgtcttctcagtacttgcagcccctttctttttagcaatggatactattccgttgtctggatgtcccacagtttgtttatccatgagcctatccataggcatcttggttgcttcccagttttggcaattattatggataaagctgccatcagcatccatgcgcaggttttcatgtggacatacatttttcaactcctttgggtaaatacccaggagtgtaattgctggattatatagtcagagtatgtttagttttataagatgtaaataaactgttttttaaaaaagaaagactatatcatggcaataagtggaaaaccagtatcgtcttgccgtacgtagaaagtaaatttaagaaaagaatacaataaaagaaaaaa

SEQ ID NO: 478649 - DNA, 755 bp, Homo sapiens
ggaaggcacgtgcactgtgcattatgtatgtgtctcatgttatcaaacatgatgaacggattgtggagatgatgatcccaagaggtcactgtgatgggctgaattatgtccccaagattcatatgtactgggagttcaagctcgaacccccagtacctcagaacgtgactgcatttggaggtagggcctttaaagagtccgtggtgcttcatgatggcagctggagctggctgatccagccaccagtgatcttcacgtcagcaaacccagaacttgcagtacccatgggcagtgtgcagcagtggtccgcgcaggctctggctctagaccacctggagaccgagagtttccactgcggacttgaagcatccgaaccctccccctacaccaatggctttggcaaatggtggggcacggagggcaggcacaaagggtggaccgcatctgggagtgtgctgaatgagtgcgctagaccaccagctcaggtgtcggccctcctggagcctgccccatgtgctcagctgcaacttgccccgccctccccctactccaccatgagaaccaagggtggctgtgctgctgttatccgtgctctgcaagtcctgctgcgtgtgcacctgcatgggaggctctttgcaaatgttaatactattcttaactcgcaggccataggctagattcggcctgagagcctttgttgacaaacctatggtctgaatggaagaaaatgatggggaagatgttggtaatgcaga

SEQ ID NO: 478650 - DNA, 5665 bp, Homo sapiens
aggagctgagggcaaggaggaaatgaggacctcggtcctctcacctcaaggaacttaattctgccaataaggatgagctgggaagcggatttttccccagagcctccagatgaggactcagcctggctggcacctcaattcagccttgtgagaccctgagaagtgaacccagacatgccaggccaggcttctgagctgcggacctgtgcgctgactgacggtggtgtttaaagtggctaaatatgtggtagttttatgcagcaatggaaaatgaatacagaggccagctccaggccaaatgccatctgacccacagatgggtccagcaaggagactgtggtggtccagggaagggctgtcagccccaagcaagagagcacctctgcagacaggagcccctcaacctgttgtgtgacagtggtgccaccaagttcttccccatgggggaagccgcctcctacaccctgtgctgccagggcccccgctctgggtgggaaacgagccacgagcagctgctcctgctctctgggcacggctctctggtccacggtttgctctggcccctccttcttcccctagaagagtctcctatcaccatcacctcactggccattcatatcgtgggcggtggggactgggctgtctctgggtgccacgtagccctgtcagccacttccagcctggagacagacaggagcccagggcttgttttacgccctgaccatgctcaggttgtcttcgacaggaagtcagagctcccagcagaccgctgtgatggccgcagtgctttctgaggcctaatttcagtctctgctgtatgtctctgctttcgccccgagaccttgcaatctgacgagtttctctcctcagcacctgtctgtcctgtcatcttttgatagttgcagccaatggcagccggcaccccaactcctgatgtctgttcctcccatctcttctctcaaagccacacggtcactcgatagacacaaatctattgtttaaaaagttaaaatgtatcaaagcttacatacacaaacacagactgtacatagcatcatttgcagttcggagaaagctatgcaaacatgaagatacagtattaaattgtaaccccataaaattaactgtagcacattctgtactattataataatttcacagccacctcctgttactatcgtggtgagctgaagtgttgcagcttactttaagaatatagcatgtaacacatctaacatacaaaatatgtatgtttacgctatcaataaggcttccagtcaacaggaggctattagtagtaaattttgggggagtcaaaagttatactcagattttcaactgtgcagggggccagtggccttaacccctgcattgttcaatgaccaactagatatataattatatatgcatataattatagaatatatacagtttaacaactttattgatatagaattcacgtaacatacaattcattcatttaaagtgtatatttcaatggcacattaccaacttcaaaaattgtggcatatatatacatatacatgtatctatatgtatatattcttatgttgtattattcttatgtattcttatgtattacgtattactatgtattacatattattatgttgttcatgtatatgtatacatgtatacatatatatataacaaaatttgccattttaagcaattttagcgttcaattatgaggcattaattaaattcattgttgtaaaaccatcatcattatctatttccaaaacttttccataccctaaattaagtctgtaactactaaacactagcttcccactctcccctcaccccagcccgtggaaactgctaatctattttctgtttctatgaatttccttgtgatagatattttacataaatggaatcatgcaatacttttccttttgtgcctggcttatttcacttagaataatgttttcaaggtttatcagtgtggtagcatgtgtcagaatttcattccttttaaaggctcaataatttcccattgtatgtatatatcacattttgcttatccattcatctgttgataaacccttcagttgtttccaccctttggctattgtgaataattttaaaataaacattggcatacaagtatcttgttgagtcctgttttcaattctttggggtgtgtacttaagagtggaatttctgggtcacgtggtaattctatgtttacttttgaggaactaccaaactacttttcacaatggctgcaccattttgcattatcactagcaatgtatgagggttctaatttctccacatccttgctaacacttgttattttctgttttaattcattgattttagccattctagtgaacttgaagaggtatctcctggtggttttgatgaacatttccctaatgactaatgatactgagcatctttttgtgtactaatgggccatttgtatatcttctttgaagaaatgtctgttcaagccctctgcccattttgaaacggattgttttatattgttattgaattgtaggaattctttatatgttctagatgttaaaccattatcagatatgtaatttgcaaatattttatctcattctgtagcctgtcttttcaccctcttcataatgttttttgatgcacaaaagtttttgattttgttgaagtttaacttatccctttattctttgttgttcatacatttggtgtcatatctaagaacctattgttcaattcaaagtcacagtgatttacaccctatgttttcttctaagagtgttatagttttagctctcatatttaagtcattgatccatttagagttcttttttgtatatggtgtcaggagcagcctgcccttgaattctttcttactcagggtgtattgtccattctgcatctaactttcaaaatattcttttcttttgcaataaattactctatgctgcacctcctttgctgtgtgtttcttgtttaaattattttaaatcaagaaaacaagaactgaggtatcaccacagccatcaacaatgttagctatgagtttttcataaatgccctttatcatgttgaggacatttccttttatttctggttttctgagggttttttttttttcatgataggtcattggattttgtcaaatgccttttctgtgtcacttgagatgatcatgtgattttctcctttgttctattattttattaattttaatttcattaacttatttttaattaataagtaaaaaatatatattcatagcacacaacatgatgttttgacatctgtatacactgtggaatggctaagtcaagctatttaacatatgctttctctcccatacttatcttttttgtgatgagagcacttaaaatctcatttaaatttttaaggataaaatatattgttattaactctagttaccatgatgtgcaatagatcttttgaatttattcctcctatttagccttcattatattaatgtgatgtattacattgattgattttcttatgccagactaatatgcattcctaagttcaattatctccactagaatctttccttctttctgctagctttggatttggtttgtgctttttttcctaggtccttaatgtgtaaagttagggtattgattaaagagctgtcttattttttaatataagcatttacagtgacatatttcctttatagcactgtgttcattgtatcccctaagtattggtatgttgcattttctcttttgttaaactctaagtgttttctaatttctcttattatttctccttgacacattgattatctaagactgtgttatttaattttcacatatttgtaaattttcctgatttccttgttattgatttttagcttcattccattgtagtcagagaagattctttatacatttttctttttaaatctattgagagttatttgtgtcctaacatatgatctattccagaaaatgttccatgtgtacttgagaaaaatgtgtactctgctgttgttgagtttataaatgtttcttaggtctagttggtttataatgtcttttcattttctattttgattgatcttctgtttatatgttgtctgaattactgaaaatagggtgttggaacacccaactattaatattgaattgtctgtttctccagtcaaatgtgacaatgcttttgtcatatatttttgggctctgttgttttgtgtgcatacgtttctaggtgttacatctttttgattatttgacctctttatcagtatataatgcccttctctgtctcttttaacaattttctacttaaatgatattagtataggcactgccactatcttttggttccagtatgttcatggaatctattttccattcttttattttcaacctatttgtgtctttgaatttaaacactttctctatgtcttagctttttttttcccctcatgtcctccattactgccttcttttcttcttaatctttttgtagtgaaacattttgattcccttcttactttgtctatattctttaagttttttctttgtggttaccatgggaataacatttgaaatcctaaatttataacagtctaatttgaatttttatcaatttaatgtcaatagcatccaaaaactctgtccctatacagttctgccctcctctttatgttatttttgtcacaaattctatgttatgtgccaaataatatagatttataattatttctatgcatttacattttaaaacatgcagtaaatcaaaagtggaattagaagcaaaaattaaatacactagattttatatctgcccatgtatctcacattaataaagatatttatttctttaaacgttttcaaattactgtctagtgtgctttcatttccatctgaaggactcctttttgtacttttgcagggcagttctagcagcaatgcactccctcagcttttgtttatctggaatgtctctctctctctctctctctctctctctctctctctctctctctatatatatatatatatatatatatatatatatatatatcttgccaccacacccatcccctttctctcatttttgaaggacagtgttgctgtttataaaattcttggctgacagtttttttatgcttttagcaccttaaatatgtcagctcatcacctcttggtgatcaaggtttctgatgagaaatcagctgttaatcttatcaaagaattccttgtacatgatgaatcacttctctcttgctgctttcaagattctcttttgtctttcaacaatttgtgtcttggtatagtttttcttgtttagtttatcctacttaaaattttttttgaggttcttggatttgtagattcatgtctttcatcaaacttgtgaaatttttggatgttatttcttcaaataaattttctacctctttttctcctctcctttttggactcccattatgcatatgttggtccacttggtggcaccttacaggtcaaaattagtactgaggagtggggcattgctataaagatacctgaaattgtggaagcaactgtggaactgggtaacaggcagagtttggaagagtttggagggctcagaagataggaaggtgagggaaagtttgaaacttctttgagactggttaaatggttgtgac

SEQ ID NO: 478651 - DNA, 480 bp, Homo sapiens
ggttaacataatgtcctccaggttcatccacgttgccaagatgacaggactgaccagcacagtggacggtgacattcaactgatgcactgttcagagggccagatggcagtaacgggcaatgatgaactttgcagacacagggctgaacagaaaaagcaaaataccgacatgaaaaactcacaggcacaaaacaacatgtgttcaagaaacaaattccagacaaaaggaaacaccaaacgcataggaatgggggcctcctggggagggatttggaaacaagggaacaaggagagaggtgccctgaagctgctggaacccactttgcgtctacacctgaaggatggggagcacctcagaattcagacctcagggctgaggggtctttgctcctagaagaaagtgccacatcccttccaagggttccacatggctccccctgtagcagagggtcaagttcctctcagatttcaaatctctcc

SEQ ID NO: 478652 - DNA, 773 bp, Homo sapiens
ggcatggtgacatgtgtcaaactcatagttctggctggatacaggatggacggatgtaattgccagagttatgggcaccagatgacctctgagctaacagccctctgcccagctggagcccagtctttcaggtcagccctggtgatcctggccaaacaggatggctttgcttttcctctagggtctagccagaggcctctctactgtagccatagggaagactccccgatctcatcctccacatctgctctcagaatgaacaagggattcatgataaaacattctgatttaatattctcagcgtgtcctccctgtcccatcagttcattctgggtgtcctgtcctctctctacccctcccaatacaccgggaaaatgctcccggaggctcccagttaatagtggggacgtcctgaccagaatgcagatgcttcacttggtgtccttggcccggtcttgccaagcatccagcctgtccctgggtgtgatcagcttctccttccctggggtccagacccttcttcctaaggctcatcaccatcagaacaggctgtggagctgctctgcaagtgagtgcggccctgctgacaccttaattccagatttgcaggctccagaactgtgagaataaatttctatttttttaagacaccaagtttgtggtggtttgtgacggcagctcaggaaacgaacacgctggctatctcatcaccaaataaagctaaaaccacctgaaattccatcacccagaggaaattgcagcttctgacagcc

SEQ ID NO: 478653 - DNA, 547 bp, Homo sapiens
cagtctgcttcatgcacatctatagcttccattccagcccctgcctggctgtacacatgtgtgtgtgcatgtacatgtatgcttacatatttgtgcatgtgtatgtgtgtgtgcatgtgcttgtgtgtatgtcatactctgttcaggctgccgtaacaaaataccacagactggagggcttaagtaatagaaaatttatttcttacagttctggaggctggaagtccaagatcaaggtgctggctgattcagtgtgtgtaaagaagaagcggacctggcacaaacacggcccggggcaagcgcctgacgtcaagcccgtgcagaatggcagccagctcttcatcaaggagctgcggagccggacctttcccagaggacagaattcttggccacaggaaggacacagccgggagcggctcctgccatgcgagtgggtatgaactggtatcttattttttgattttcatttctctagtgattagtgatgttgagcatcttttcatgagcttgtcgatccttgtatatcttccttggaaaaatgactatt

SEQ ID NO: 478654 - DNA, 579 bp, Homo sapiens
tcaagattttttttgttttggtcttcaaattagtttgccaatgccgattgatggagttggctctggttcaaatgcctctgacagaatggctggatcatataagagagatacagaggagaaagacagagggaggagaagatgacgtgaagatggaggcagagattggaatgatggggctacaagccaaaaaataccaaggaacatctgaagccaacagaagcaggaagaggcaaagaacagactgttccttagagctttcgcaagtactgcagccctaccgacaccttgatgtcagacagacttctggactccagcactcagtggcaaatctgtacaggtccgcagcaacctcatttcttgcctcctcagaagaacttgtggtgccaagaccttacagtccttttcaacaacaagtagtgctgggaaaactggatatccacatgcagaataatgtggttggacccttacctaatgtcatgtaaaaaaatgaactccaaatggatgaaagacctaaatgtaaaacctaaagcaataaaactattagggaaaaaaatggcaaaatttcacaacattggattt

SEQ ID NO: 478655 - DNA, 940 bp, Homo sapiens
aactatatgataagttactctcttatcatggtttattctttatatattgggtcaagcccttgaaatggactccctgtggcaaaaagagacccagaaaatgttaaaaccagattctacagctttggccaggcaggaggtcagtgacccctcaacactcccctaccttgccaactgccgcaagattttctttcctgtaattaaacagaaaccagttcctgagaaacaatgtttggaagatttccccaccaaccttgacagaccgcttgacatcgtagctgacctcccctctcttattatggtcttgcctttacaactgaccagccttacaaaacattccttcctggtagatgaccaccaaccagagcctggttctgaccagtccacagaggctgtgcatgggatgcctttgtatctggaggctggatgtccaagatcaaggtgccagcaggcttggtgtctggtgagggttgctgtcgctgcttccaagaatgatcaaagctctgctcttctggaagccacagttaagggaatccaggacctgagcagctggcagaggagtaagaatttcttaccagccaggctctgacctctctctctgtgcaatctggtcaagtggatagtaaaaatcagcttcctttgcaaaacttttcattaatgggataaaaggatttgtgtgtgactaatcttgatgtattgactctggtgtactttttggtattttgtggtcatattgtttgatccctttatgcctccaaatcatctttttctctttgtctttgtcttcctgtgttgttgtgtcttaaagagagagatattggactgtagtttttgtttattgtgtctttgccaacttttggtatcaagatgatgccagtttcatagaatgagttagggaggaatccctctgtattagtctgttctcccattgctgtaaagaaat

SEQ ID NO: 478656 - DNA, 633 bp, Homo sapiens
tcatgtactctctaaagggggaaagccttcaacccatatattgtggagctatgagaagagggccaccgtcctccagaccccagaatggtagattcactgccctgtgcatctggaaaagccgcagacactcaatgcctgcccatgaaagcagccaggagggagactgtaccctgcaaagccacaggggcggagctgcccaagaccatgggatcccacctcttgcatcagcgtgacctggatgtgaggcctggagtcaaaggagatcattttggagctttaaaatttgactgccccactggattttggacttgcatgggccctgtagcccctttgttttggccaatttttcccatttggaatggctgtatttacccaatacctgtacccccattgtatctaggaaacaaaggtggaaaggctgatggcagcatgagttggggaggggatgttgccactactggggatggggaagctatttcttctggcaaaaaagtttcatcagagtttacaaactcagtgtccccagcttcatcagggtcctcccacatgtccccattccaagttgcaggatcccattcttttccaatcaatgccctcactttaacaggagacacctggtgaggctgtacatgc

SEQ ID NO: 478657 - DNA, 910 bp, Homo sapiens
tccttgcggccaggaacagtggccaacacctgtaatcccagcactttggaggctgaagtagagggagatgacctcagcaaaggacatcgaacctgtgggagcacctgtgaggcaagaagtcctctgccctctaccctcaccctccccagccatcacagtgcggtggcagacaggccctgtgagcggcaggcacctgtcagtgccagagtcctcccagcaggcctggtggccctggtgctcagccttggaggccccgtgctgcctcgtcccttccctggggcttagcttagctctctttgttgagttggcaggtctttggctaaggatttgcacatcgtcagtgttacaacctgctgccactgttgtatctcgtggccgctctgccctctgtgcagcccaagaagtcttggcatccctctgcccaggcatgaagcttccaagtcttcgccccactctccaagccaaattgagctgtctctgccttgcctttcattttctttctctgtgggtataattgtgttgacagccacaagaaaccaaatgtttccctacatcatttagagatgtgtggcctatgaaattcctttccattttgttgttttcaccatgactgcaatgagcacagttgtcaggagaaaaacctcaaaacattttggggaaatagagaaaacttagcatcctagcaatgtgttgccattagactaatgaatcaatcaggcagccagatcacagtgactgcctgaacagaatgcacctagctccatgcagatgtaacctgtgatgtcacagccatggcctgtccagtgcatcccagggctgagtgaaacacagacccagttgggagctgagaggaaggatggggtgaatagccaagggggtgtcacagggcagatgatgagtaggtaaatta

SEQ ID NO: 478658 - DNA, 1463 bp, Homo sapiens
gatcctgggccgtaaccccaaatggctctgcgggtcagggagtggagcaacccaaacccaccccctaccctgctccccatcccttctcctgctgaactttccttccactgtgctgaacacgaggaaatggagactcagagaggtgaagaagctcatctgcggccaccagctgtggaggatttaatccttctggcaggattaaaatccaggcctgagcaattgcactctccagtgaggaaaccaaacaccaactttcctgataagggatctttgtggtcagcgggaaacagctgctgcaccaacctcgtttcaacacgaagccgaaatgcccaagcactgaagatggttgggagtttgggaagacttgataaaaatgaagaattaagcagttatgagccctgatcaatactgagatgacgccaataacagcttgtgtttatttcgccattctcttgggagaggctcagatccttatggctcttcccaggtgtagcacattttgggcaatagagttttgctatagatttgtatgaatagattttttaattgttgctaagttgaataactttttttttaatctgcatgggaaggatttggtatagaaaagaatcccaaagtgggttcttctacaaagtgaagagaatgtacatctatcacgttattgctgaggaggattttgtgtctggggcaaagatagggaaaggggtggaggctgggtttgtgtgaagaaattctaggcttccttccaactagaagggtccatgtttcaaatgttttggcacgcatagtttatattactttatctcctggtttatctttctatgtttatatttcatataacaagtgtcctttaaaatgaactacacttagaattctacaggacaaatgacttagtgtcttcaataaataaatggcattttagaaaggatattttacaagttaagagacttaacaggcaggtccaccagatgcctcaaataaggactagaatgtgtggtcctcatttgggtcctgattcaaatgaaccaactgtaaaaagacatttttcagacaatcaggggaaaagttgaacaagaaccagttaatagattgtatgtcataaggagttatccttaataatgttagatgtattagttgcattgtggttatgttagaaaaaaaagcctatctgttagagttgctttctgaagtattactggtgcagtgatatgatgcctgggattttctttaaagtgttccaagaaaaaaagagagagagagagaaaggggggtggggagatgaaataaaaatggcaaagtgttgcaactgttcgaactggataatgggtgcacagggactcattccatttcgtgtatgtttgaaacgttccataataaaaagttaaagttttaaaatgcatgccatgcttaaacattttaaactgtagcctgtacctgattaaatgttgctttcctcagaatct

SEQ ID NO: 478659 - DNA, 920 bp, Homo sapiens
ggcgcctcctcgggtcatcaatacagtggtagaaatgtcatcttcaacttcatactggccccagggctgcttccaaggcagccagcacagccccttacagcctggaaaggaacacaaccactggcaagctgggcttacgcatccccaaagaggacacgggaacaggccagaaacacacacggcagagactgcaagccccatggcagcccctacccatttcgtccctgactcacagcttgatgatgtagcaatgagggtgaaaaagaggccctactttcacaaagttgtgccaccacaacctctaactagttccaaaatatcttcatcaccccaaggtaaaactctgtatccattcattagcagttactccccacttcccttctccctcctgcaaccaccaatctgctctctgtctatggatttacctattctggatatttcatataaatgggatcatataatacatgacctttcgtgactggctgcttttacttagcataatgttttcaaggttcatcctggttgcagcacggatcaatacttcatttctctttaaggcagaataatattccgttgcctggatagaccacattttgtctacccatcccctgtcggagggcacttggattgcttctaccttttgtctcctgagaataagctgctgaggacacgggtgtacaactcaaatactcttgatttgcatcacagctggacttgcagctctcaaaaccatcccctctcctggttctgccctggtgctcccatccccctggttgactcctactcaatccttagggctcagcttcatgccacttcctccaggaagcctccttgctgtgcctggacaaggctggtgctccttttcctgaggggctccgtgacactctggacaacccccaagcaagacctctgcacatgcc

SEQ ID NO: 478660 - DNA, 2695 bp, Homo sapiens
agcccagaacctgatggctgtgctggccgggacctcagatgctggcaggagcttcagctgcccttaaatgctcctgagtggctgcaaaggacagggaggtgcctcgtccttaaccaccaggttcaactcactcccagatgaaagggttcccgctgtccttgtgcgtcctcgtgcagtggcagtggagaacgctggacagaatggctgcagaggctctgcggtaggcctgacgccactcatgattcccagggactcctgtgcctcgggcagccagtgccaccctgtcactcacagggatgaggctgatccaagggctccactttaataacgggtccagctggtgccagcttttattttagcgaccggggagagccagggatggcttctcagaggagggagcagcagggtcagcccctgaagccccgtaggatgtcctggagacctatggcgacggcaggcctgggttgggggccagaatccaccgttttcagtgcccactattttgttcccaaggaagaaacgtccaggccaggggcatcgcagggcaggtaaaaccccaaggaatacctggaagtgggaggagtggaaagcgggtggtgaggggggcacccctcttcatccgctgtgggaattccaggcagctcgggagaacttggacggactgttttcattaggagtcatacccactaacccacacacagacctctgcacttctcatctgaacacggagaatatatttcagagccatgattgtctcactatgtgtgtgagggggaaaagctgacagctgcacttctccatctgagtctgagagaccacagacgagggcagccagagaagagccccctcttccagaagcagaagctactctcctctctggttataaaatgcagagtggtgggtgggcttagctgggggaaggttactggggacagtaaagcataggctctataggaccagaagttgccttcctgctctgctgtgggaggaccccaaggtggcccgaccccagtgacctgggccctgagggggatgcttgggagcggggtcttcctgaaaacaccctagggaatcccaagggcagcagagaaccacatcaccccaaactctgggctgcgggcatgtgcacatgtgtgtttgaggtcagcagtgattatcagtatactgaacaaccagcaggccatgggtgccgcccaaggggacaggcaggtgccaggactttgcatggttgcaaatgggtgcttttggggtggggcctacatggggctctttttgaacgacgacaatgatcaagcgagcagggtgtgggggtgcagtgctctgaaggccgctgcagggttggtgagctccccggggcagtgggaggcagagggctgaggcacagagcagggctgggggatgctggcccacagtaggtactcagtgggtaggccacaattgcccagaagatgccccctgagctcgaagctggcagggctgggcagttacccgctctcactgaaaaaggggtgccaatgctcctttgcatcctgtctcctgagactgaggagtcctcagggactccggaatttatggcagtgagcagcgatgggtcctgcctctggggcttccagacgagagaccggctgcctgcctggctgtctgctgctccatggagtgtggaggaggtgggcttccttctcacagcagccacccctcgccagggagctgagcagctttgcctggaggagcctgggctcttctgggctaagctttgctgctttcctctccctgtcatgctgctggaactcgggaaagagacatttccatgggaactcacggattggagggatcccagccaggcttctggtggaagaaactttgcagacaaaggcacagtggcacactgcgtctcaactgctcaaggtcaaggggacaaagagtttgtcgaagaatcaaaatcgtggcctggcataagtgaacagagtgagcgaggagaggggtgagaacttggtagggggtgtcctttgagcttgcacttgacttaaatcagcaatgtgagctcatttcttctgtctgtctgtctgtctgcatcaggacttgcctcctcttggaagtccccagagggcctggacctcatctgttacctctcgttacaaagctagtagattatttttgcttgtgactttataatttcctgttactcatctataccatgcaaatttcctcattgtaaaggagtcaggcaacccagagaggatatctataataaagcacattggtcccccctcatctcccctgttcatactttggtgtatgtcttcatcgtccacatatataacggatgtgtccatatatatagtggacttatatacaatcatatgtatataatcatacatatgtatggttatatacaaatccttttcaaaaatatagatggaataaaattaagtgcattgttctgcagatgctttttgatagcaaattccacatacacaattcaaattaaaactgtgcattggagccaaaatcccaccagtgaaggggatgattaggctgctggtgagaggggagccagcggttattttcagggagattcattaacactttcctgcccctggtgctcagcttcttttcattgccagaaaaaaggtcatttatcagaagttaccttaatgaagtttaaaaatgaatgtccgtcaaccacctggtcccc

SEQ ID NO: 478661 - DNA, 1220 bp, Homo sapiens
cactcttcctccaagtacactcagggcccttccccagttcccgggcagttcagcggtcagactgcctggccacctcccacctcctccactttatgaggcacagggccttgggatgagttaaagacccctggtacagcccggtgctgccaactacaatttggctaatgccttaattgcatctgcttcagcggccttccttctggctcggggaccatgtctatttccctgctccctggtccccagcagccaactagggcaggccccagcagcagaacagcttgattccttgagcccagggaagctataaatctagagctttaatcatgtcttcatgatcattcagcaaagagcgaccgaggatttattctaccgggacggccaagggaagactgcggggagcctgcgtccttgagaatgcagtaagcattttttaaacgccccaagggtcctttccagttttctctgcaaatgttaaggaggaggagaaatcaaggaaatccagagaggactctgtggtcccttgcacacggcaggcacctaatatctacctattgaacatctccgctccttcattttatgggcgagaagaaagaggcccagagaggtgtccaccacacagcagaggttactcacagtagaggagggagcctggccccggtggaagacccccagtgatacagcaggaaaggggtcaccgggctaatgacgctaagggggaggggatgctgccttacctggggaccagcagagatggtggagagtggtgaccccagtgggcaccgtctcttcccattcagcccaaccacccagggcttcagaagcaggcctgagcctggaggcaacggggagtccaggcccaaggacagcagcggaggtccctggctgtacaagacgcatggcaccggcatctgctcagcttctgccacaagccaaggagcaccgcagactgccagcaaccaccagcagccgggagagaggcctggaatgagtcccccctcggagccccagaaggaaccactgctgctaacaccttcatttcagacttctggcttccggagcggtgagatttctgctgccttcagccaccaaggtggtggcgatttgctgcagcagccacaagaaacggatacagaggcgatggtttggggccaggaatgcatgatcaggtcttcccagccgctggtgctgtgacgccaacctcctctggtcttggggctgcc

SEQ ID NO: 478662 - DNA, 1147 bp, Homo sapiens
gcaagcaacactcaggcagaagatgccgccagccatagagctcacacaggcagctggcggccgacctagagcacgtgaccccactgtgctgtcctgcctgtcactgactcccccacgtttcgtgaacaaggatgaccatggaacaaagttctggccaatgagaactttcaggaaagccattgttctcctcaccgaaaaagagggagggaagggaagcgaggggcacatggggaccactctcccaaacctgggctgtgagcgcgaggggcacgtggggaccactctcccaaacctgggctgtgagcgcgaggggcacgtggggaccactctcccaaacctgggctgtgagcgcgaggggcacgtggggaccactctcccaaacctgggctgtgagcgcgaggggcacgtggggaccactctcccaaacctgggctgtgagcgcgaggggcacgtggggaccactctcccaaacctgggctgtgagcgcgaggggcacatggggaccactctcccaaacctgggctgcaccaccactctaggagacaatcggcgtcatctggtgaagtgcagctgcgtgccctgggaacgggccagccacgagacgccgcaggtgcgctacggtgtgcgtcagcggcaccagaggagctccttcagcctgcagattttgaggcccccagattcttgccttccacgtgcagacgggccgaggcaccactttgagaaacagtttccaaggatgaagctgcaagcaaggaggggcatggagccgagggactcgccgggggtcccagctggagtccctggattgactcgccgctacctcttgtacttccccggggtgttccaggggctctcggagcgccgtattgaaatcgatgtcctcgtggtctattccatgtgtcctccttaggaaaggataaaattaaaaatcttgtcttaataaagttaaaagtaactggtgtagtgatgctgagaatctcagacaacctaagacttactgacttggttctgaggtagttgctagtggccagttccctaacacttccctcacagagctctttcctccttgtctgcccatgcccgggcattacttaactttgttgggggtgctcaggctttcagaggtttccaagctttgctataaacc

SEQ ID NO: 478663 - DNA, 783 bp, Homo sapiens
tttggttggtttttactgggagatgagatggcctcatctgggacctccctaccccaggatccccctgtttctgctcacgctgtctgctcggccggctgcttcaagggctgaggagtcagctcccgcagggctcatgtggaagagcaagcctgtggcagttgacctgggtccctgtggtgtggacaatcccagggcccagatgctgccctctgctgcctgcatttctattcgggagctggatccccaggcgacatcgggtgccacacaggggcctaccaatacctccgtggctttggagcccaattttgtccccatgaagaggaggaagccttggctaggaggtaaaatgagtcgcccaaaggcaggctgcaagtggaatgcagagcgcagggcagagtttgggcctctagtcctcatcgtcacagtgctcgtcctcctaaaagtcaggtggcagcaagcagccccagagctggattggctggatgcaaatccaagctccactacctgtgagctgtatggccatgggcaagtcacttcctcttcctgtgccttagttttctaatctgtaaaatgggatactgtgactacttctttcatagggagaaaactacatgaattaatatttgtattagaacaaagacatgcttagaacagggccaggctcatcatatgcactgtagcatacatgcttgatttcgtgggctatggcatccttgctgcccttgagatgtgggagaaaaaactggttctaagccctgaattcattaaaatggaaggaaaatc

SEQ ID NO: 478664 - DNA, 1700 bp, Homo sapiens
ggtgcttaaacctcattgctacactgagctcggagatgcggtgtttgccggcgtggattgaacagcctcgccctctgaagggagcaatcagccagcgggccagggccatgcagctacatctggccactcctgtgacctctttgatcactacctctttggagagtcgcaacaaagttggtgtcaccagagtgcagctgcacaaactactctccaattcgagtcctttagaagtccctgggcactgggcccccatgtggctggatgcatgcacagagggcttccatggtgctgtgaaagagaaaaagagttactgccctctgacctatgtccaaagcaaccatcgtactaatgccccgttcaccccgagggtgctgctgctcgggcctgtgggcagtgggaaaagtctgcaggccgccctcctggcccagaaatacaggcttgtcaatgccttggctcctgcgtaataggaatgtgctgtttatttattttctccagtctcgtttggtgcccccaacccaggtcagtgtgtttacaggcagacaatttctgaaccagaggaagacttctcactccgcacagtttcaataaatattttaccaggaagagagaaaatattgaaatcagctctccaggtctttcccggggtggtcccaggcggtcttggatgccagcttgtgttcaggaggataaagggatgggaatcaggaagaaactgtagcagagacacactgccaggttgaagggagttaaaagcactgcccctacgcacaccatgctccacaaacctaagtagcctctactgtatttactaaggaaacgagacctgcacccccaaatatatgcatatgcatacaacccccccaaattatacaggcataccatatgaatatagagagggaatacaaacaaatatatggacacacacaaatatacctacaaatatatgtacatttttgtacatttgtatgtatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatatgtatatatttgtatatacatacacatatacatatatgtatatatttgtatatacatacaaatatacatatatgtatatacatacaaatgtacgtgtatatatatgtatatgcatacaaatatatgtatataccaccccagaagaatcaagttttgaataaaaatgcttctcaggcctcctccagcttacaattct

SEQ ID NO: 478665 - DNA, 707 bp, Homo sapiens
cctgtttcactcagcatgatgtcctcaaggcagttgttgggatggcaacatcaatgctggccgtggcacttcctctttggccagctctgcacagtggccgagctgtgggccctcagctcctggcagggccctgtgtcccctgaccagacttccactgggaggacctgtggccctgcaggtccagcccagaacctgggctccaaggtcagagcttttggcaatgaaataacaactacatttattgtgtgcctaccccgcaccctgagccattcacagcgttcacaggaaagtgctgtgatcgtgccacaaacgtgtcagagggaagagaactgcctgggaaggcatccggaggaggagtgccctcctgcttggcccatggttctactccacaccgacggttggcagccggcaccgtgcgataaacttatcaggccaaacctgagcatgccgggctctgcactgcactagaggggcctgaagggacctgcagctttgagggaggggacagagacacaaacctcaaggccgggaaatcatatttcagcagacagagtcttttttgtcatgccagtgataatgttatcatgcacgcccaatacagaaaaataaaacatacacactaaaaaataagaagaaaaaagacactgccgtttatccttgcacacttccttccgtgtgtgtgtgtgtgtgtgtgtgtatgtaattaa

SEQ ID NO: 478666 - DNA, 1211 bp, Homo sapiens
aagattgcctatggtgatggttccacaactctgtgaatataaaaacgattgaattataatatactttacatgggtgaattgtatgctgcagggctcagtctcctcacagctgctcaccccgctgggaacctggcggtcctgagcgccctgcccctccacccacaccctgactcagcactctgtcctccggctgcgggagtgcgctggccgatggctcagttgaatccttctttgagagttgcactgtatggaagagaaactattggcctcactttctggatgtctgacccagtcctcaccgacggatagttctgctctcactcttaaaccgcagcagagagcctgctgggtggcactgcttgcagagggacgactcattctcagggcaaacactgtcttgacaaaattggttctctctacagcctctcacctgaagggccctgttccttttgcctccctgaaaagggacctccctgagagcgggcaggaatctatgatacacatgccacctcatggtgtagaaagtgcacgctttctgtatgtgcttcccatgtgcaccaagtttgatttgggtcatctctatagttcatccttcctgaggcccagcgtgttcctgacacgccagaatatcccttccagatccttatggtggcagtcgttggaatttcctggcagggaacccttgcagaaaatggtacctgacatgccctccgtcacgacagtgcaaaggatgaaacagattcatgttcaaggcatgttctcattatgcgcagccttcattaaaagtaattaaaacttggcaaatactcatctcggatgattaatagaccatctccacttctccttttgggaggtcggttaccagttatcaaaaatgaaacacctgcctttacatcaacgtgctgctgccgaaacgtagcaggacgcagctttcacaaagctgttacatacatctgttgtgccaaaaaaaaaatggagctctgtgttgacctaagtcctgaataaatatggtggatttggggacacaaatctgattaaaaacttctccctaggccaacatggttaaaaactaagttagctagttagctatgtgtcatttataaggaatataaaattggatggtagcaaatggtcattttggtggtattaaacgtgtcttggggaaagcatgtcccaatctgaattccaattaatgcaattactatttcccg

SEQ ID NO: 478667 - DNA, 583 bp, Homo sapiens
atgtccgcggtggctgctctgcagcgcagccccaggcctgggtggattcatgcgctgcttagagctttggtccccaaacaccttgggcacagatgatgtgcaaagcccggtgctggggacaagccttccccacacctgccctccagaaactggggcccagtcagaggtgtgcccgaacaacaaggccagccctttggacggtttctgcaggccgcctcccggggccgaacgcgcaggacccgctcctgcacgcggcgtggctcaaggcggtggcctcaggtcctcggtgttgacgccctgcgatgcctccctggtagtaccctgtgccttctgctctgaggccgctgcgaaggaaatggcttgcttacgtctatatagcaccctatggaaggacggaaagcaaacagtaattgacaaatccagccatgaatgcaataaattcaactccaaggtaagctgagagacttagacacttctttttgtaaagttctgaaataaaagcccacactccctaaatctagaaaatgatacgcctttctgagcaatctgaagaccgtgtgaacgcaccagagcacctttcccc

SEQ ID NO: 478668 - DNA, 731 bp, Homo sapiens
gaccatcaactttcgattcaccagtttgctctggttggtcagctccaggtgccagcatgggtgctggttctctgcaaggctgcagccagactggcactggggaacatgttggcgcctggaagcttggagacaacagggaccgcagggccccaaagagggagtcacagccttggcttgggaagctcctagctggttgtcccaatgtctgctgctctcagcagagagaaggccatggagtggatagctttcctctaccactggttgtcctgacatctgctcagctctggctgagcctggggcttttatgggcctcagaggggaagaagtacacccttgttggtccatgggtggccatgggtggcccagaaaaggcaccacaaattcccactctggtccatgggactggcagcccggtccccaaccttcaggcccttcctggcctgaaggtggggcctcatcagggacccacccccttttgcagggaagcctgtctgcttcctgctgctgttcatggtgcctaggctgtctttacttgaccaaataaaaagttgttaactctgttaacttctaatattactgacatttcactggccccctcccctgccaaatccaaaacctagagaactcctgctttctctcaactctaaaatacttagatctgtgtctttcacacagcgtataggctttgtgctttatgctttgtagtgattgggttgagaacatgcttctgc

SEQ ID NO: 478669 - DNA, 847 bp, Homo sapiens
ccacccggagaaacggcaagcactccagagatcagccacccgagaactgccacatgcaaccttatgacagaggcagagcaagttggagacagacacagaggaggcagcaaagtgaagacagaagcaaagattggagggatgcggccacaagcccaggaatgccatgctggccgccagaagctaagaaatgttagtatcaccagagggcactggttaaaaacaccacagatttggaagtcgatgtcttataaacttaaacatacatacttgtattgggtgctgtgtccgtgtgttgaccacccagtgttctttggggttccactctttgcacaggcaccacagctggagaaacacagacgcacagacacaagctggatcctgcgtctcttcctgcctccgggcacagggcgccagtcagcctggttgtgcgaatggaggtcgtgttccttagcacagagggactcattccagggcgctcccctcagaggaggaagagaccggaaggtcgttttagggggcacttcctgggacatgggccaagcctcctaaggaggacacatctcacttattcactcagagatgtttgggagaagagctgttcttagctattataaacacagtcttgtactgttgaaagaatcttgtatttcaaataacctgattggaattttctgttaaagcaaaacagaaaattcagtacatagttttaaatatttacctcttaatattaaagcattgttttcttctggcttaaattatagccaaatgtgagaaattttaacttacaaacttgatgtaactcttctaaaaaatgttatgagattttttaatgtttgttaaccattcc

SEQ ID NO: 478670 - DNA, 3170 bp, Homo sapiens
ggaagctgccagacagtggtgcacccctctagtggcaggacaggatggccgcggcccgagtggggccggggcttccaacgtctttgtccagatgaggacagaagtggggcctgtgaagccccctcaggcacagaccttgatcctaactcaggcccccctcgtctggcaggctccaggcaccctctgtggaggtgtcatgtgtccacctcccctactccatggcagctgctcctggggtgaccgttacctctgcccaggtggttgggggctacccaggacctgtcagcgaggctggtcccatggccttcctcttcccccaccaccaccggctgcccaggtggcccccatcgtgtccccagggaacgctaggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaacgcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacagctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcaccttctcctgccagcaagtccaagaagcgacctctctttggaagcccatcccctgctgaaaagacaccgcacccagggcctgggctcagggtctctggggagcaatccctggcttgggggctgggtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatgctctcagggctgctgcctctgcccttggcgttgtgctgctttgtggagggtgtctgtgaggcctcagggctgaggaactgggagaggccaggcactgggaacccacaggggctggccccactcttttctcctgttatagggggccccttcagatgctctggggactgacagatgctgaggaagccctgatccctcccaccatccactcacaaggccccgcctgctttagggaggcttctcggggcctcccatcattatcagtatccctggaaaatcctgggatggagagagctggctggctttttttctgctcggtgggagctgaggagaaggcagctgcctgcaacatggacatggggagaggcggctgctcctgcttaaccctcatcaggaagagcacgggcactgggctgaggggagacgttgaggccatggtccttcctcagagtttcctttgtcttagttcattccaaagatcatgttgtagggacgtttatcacgtatacggtatttgcataaactgtatgagcgattaaaagatattctctgacattaaacacaaacaacatagaaatctcacgggtgacgataggatcacaagattcctaataaatgttaagtggatggttactcaaggtaaatcccttcatccccttgcccttcattagaatagacagaaactgactgtatacaggctttactcctttataatgtgccaaaataaaaccccaaagcacaaatcgcacaaaccaagtcatgccactgggaccatcgtgtgtcatctgagc

SEQ ID NO: 478671 - DNA, 851 bp, Homo sapiens
cgaggaaaggataaaagttacttcaggccatctggatgtatacgtacaagtcacgggatgcgatggcttggcttgggctcagaggcctgacgttcctgccttcttatattaataagaaaaataaaatagtgttgaagtcttggggcggcgaaaatttttggggggtggtatggagagagaatgggcgctgtttctcagggctgcttcaagcgggattaggggcggcgtgggaacctacaagttatctaaatctcagcgtccgtgatggtctacgggacttccgaggtgattgggcagcgtcagtctttagccgctaagccaagaaggagtcagtcagagagccttgggccagagttccaggggctctgggagtggctgccaggcattccttggcctggtggtcagatttctggcacttgtagcaagctccttggggaggaggttctggaggaacgcctggccgctgcagttcaggcaaaagcgggacttgccgctaagggtgaaggagaaggggttgaggggtacttgcctctcccccagaaaagcagagaaggggtagagacaaggagagaaggggttgggggacttgccgctaagggtgaaggaccaaggcaggtgtccctgcatgtcatggcaccaaatttcatgcgcgtccgtgtgaagagaccaccaaagagactttgtgtgagcaacatggctgtttacttcacctgggtgcagtatcttcttctaattgggaaagagaatggtgtctttggataaacagaagttcttaattttcacgttgtgcaatttattaatttttttgttgttaataaatattaatgtaaaaaaatgaattgtctgtcgtg

SEQ ID NO: 478672 - DNA, 1002 bp, Homo sapiens
attcacactgaaaggaatagaagacaggaggaagagtcgggcgatggcagaaggcacaggtgatttggcaaggcttggagtcgggtggttctgcctgtgttccctcggccagcacctcagagtccccacaaccaggagccagccagcatcttcagcaagggtcctgtacagcctcagcaccccatccacaggaatgctagaactctgccagagtccactagggcaatgcaagaggcctgtagaggtgacttctcaggatggccggccaggtggctcccactcctgcctgatcccagtagttttcacacccagggaggtggggccctcttctgctgctcctaccccagagagccctggagggacattgagaagaaaacagtttaggatgcatgaagttaatggtacaaatgagcacagaggctacttaagatggctgaacacacggaggttcctggtgggtaatacatggaaaaggcgtggaaactctgcacctcttcccccgtaccttggcctgcgcgtctcttcaactggatcctttataataacctagtaaatgtaaagatggatccaactctcagggggttggttccccggatgcataagaaaatgcaaactgataagtaaaaagcaaaatattcaatcccttggttattgttatctgtaatagctatgcagaccaaaagttgaaataacacgcactataaacttaaagaaacttacttttatcctgagccaagtttgaggactaatagccaagaaacagaaactcagtgcaaactgagaatgtgtcccgtgcactatttacatgttgggaatgggaggagggggcaaaggcgacattgttccaattctatttacgtgttcttttatatagaagacgggaagagtaaggcaaaggtgacattgttccaattctactggtgctcagttgctttgtacctaagataaagcaaatgagcagttaatgtttatgggttgaaaggcttaggaagtatgcaggca

SEQ ID NO: 478673 - DNA, 1123 bp, Homo sapiens
aggcacaggggagacctgccggagccacggaagatgaggtggcccgcagtgccaagaagatggacaagatggtgcaggagaagaacacggccggagcactgggtttgttaacagagcttcagaatgttctggaattactgcggtccacaggaactggaatgttacttaatgttagtctcaagcagagtgcagatgaagaagttacatctttagcaaagtctctcgtcaaatcctggaaaaagttaccagataagccatcaaatacttgtttcatctgttccttggcacgaagcacttctgattctgtgcggatgaagtacagggagatgcttcctgcagcccttcgaacaggagatgactgcattgaaatgggaactgatgaggaagaattaggatctcgaactgaggaagcaatagatccagaaagagggaatacaggcatgaagtacaaaaatagagtccaaagtaagatatcaaatcttacagatgcaaagaatccagatttaaggaaaaatgcaccgtgtgggaatattcctcctgacttacttgctagaatgacagcagaagaaatggctagtgatgagctcaaagagatgcacaaaaacttgacgaaagaagccatcagagagcatcagatggccaagacaggtggaacccagcctgattcgctcacatgtgccaaatgtaaaaagaagaattgcacttccacacaggtacaagcctgcagtgctggtgaaccaatgacaacgtttgttgactgtaatgaatgtggaaatcaacagaagaatacctctctaaagcactctagtgctcacatgtctgctcctacccactgcactgaacttagagggtccatgtgcctaacgggcagggcaccgagggcagcctcttgtcaagagacagtggaaactgaggccctcagtccttcagcccgtggaactgaaattctgccaacaacagactctttcctcgtgcagcttatcagacacctggattacagcctcaggggggcccctgagcagaggacctgctaagctgtgcctggactcctcaatcgtaaacactgtgtgataagaaattgtgtatttttatgcagcaatagataactatcacagttgtgaaa

SEQ ID NO: 478674 - DNA, 1187 bp, Homo sapiens
tgggacccagtcatggacctgttagtgctgtctcagggacaccaggccaacatcccggacatcatccacatacacaaggaagctctaaccaaagtcacggagagtaggcaacatgtggcagaagggaagacagaggtgcagaggctgatgatgggggaaattcaagaacgcttagagtgtttgcataaaaaagagcccagtgcaaatagccaagacaatggggaaaaggccttgaaggcatttcagagatcttttcagcagccgttgctgtcacaggccctagggatgaggagagaatggtttcctgggccagctccatggcctggctgctgtgtgcatcctcaggacaccgctgcctgcatccctgcagctccagctccagccatggctgaaagatgcacagtgtgggaaagatacagacactcgacaccagcctcgtccatgagggcagctgcggggacttatcactgcaaacccacaggtggagatctgcccaaagccttgggagcccagccctcacacccctgtgccgtggatgtgggacaaggattccaaaaggatgattttggagctgtaggattgaatgacgggcctgctgggttttggacattcatgtatcctgctgtgatgaagataggtgaaaatgtaaaagcaggttcacaagtggctaacagccagagagatgtttgcagcagcccttgctgtcacaggccctgggacctaggagaaaagagtggtttcctgggccagccccatggccctgctgctgtgtgcagcctcaggatacagctgcctgcatccctgcagctccagctcctgcaccagccttgtctcaaagatgcacagattcatagacccaccaagagctttgtaccctccatgggtaaaaactacaggcactcaacaccagcacagcccatgaaggcagctgcatgggctgaacactgcaaagccacaggtgcagagctgcccaaggcctttggagcccagccctcacacccttgtgccctggatgtgggacaaggataaaaaaggggtgactttggagctgtgggtttgaataactggcctgctgggttttggacttttcatggagcttaaaacttacccgatgcctgtaccatcattgtaccttgaaaaaaagaactcccttttaaattcagggactcataggcaaaagggactgt

SEQ ID NO: 478675 - DNA, 483 bp, Homo sapiens
gtgtataatcagagaggcgtctctgcaatgattaaacaccaagggaaggctgccttcctagtccatgaccggcgctggagttttgggttcacggataaaacatgtctcttttgtctctaccagaaaatgaaaggaattgaaattaagagaagggagagattgaagtgtggcgccaagattgaaaggagaaagaggttgagggatagtgagggaggacccgaggtcgtaggtggatctttctcatggagcaaagagcaggaggacaggggattgatctgccaagggaggtcccccgatccgagtcacggcaccaaatttcatgtgtgtccgtgtgaagagaccaccaaacaggctttgtgtgagcaacatggctgtttatttcacctgggtgcaggtgggctgagtccgaaaagagagtcagccaagggagataaaggtggggccgttttgtaagatttagggtacttgtgcacaatgtgcaag

SEQ ID NO: 478676 - DNA, 4665 bp, Homo sapiens
gaaagagcaaagatggttaggtccctctcctcccatgtaattggcgatggggaaagggaacttccctgaccctcatcgcagtattaatcgccagattacaaatgcagacttgtggaagcatcagaaggatgtgtttttgagtgccatatccagtggagctgactctcccaacagcaaaaatggcaacatgcccatgtcgggcaacactggagagaatttcagaaagaacctcacagatgtcatcaaaaagtccatggtggaccatacgagcgctttctccacagaggaactgccacctcctgtccacttatcaaagccaggggaacacatggatgtgtatgtgcctgtggcctgtcacccaggctacttcgtcatccagccttggcaggagatacataagttggaagttctgatggaagagatgattctatattacagcgtgtctgaagagcgccacatagcagtggagaaagaccaagtgtatgctgcaaaagtggaaaataagtaggtccttggacaaagcattttattctactcctaagaaaaatgtgtaaaatgatgccagagtcttaatcttggcggggggacttcgaactgtactaatgggaattttgaatgtgaaacaaacacagtaatttttccgattttctagtatttaaaatgatgtcacttatcaaaaaatctattggccatattcctgttaaaacccaattatataactaaaatgaatgtttaaatattttttctatttttctattagaaaaatatttttattcagaaaataaccagattttttcatttaatgactttttattttaaaaataaaaatattatggaaaaattttaaaatataaaaaaagcataagaaattaaaatcaaccacccacacataacacttgttaaactacttatgtatttcctctaattttatatgtgcatatttatatagttggtatattattagtatgtataattttgtacctgcttttttcacctaacattatgtcatgaacatttttccatgtgataaaatttcttcaggaacctttataatggctattttaatcatgatatacagaattcctttttcccaatgaaatcataatttacttaccattctattttgttatgtaaggttttctctcctgtatttttcactattataaataatagtgaatgtaaatctttgcatttctgattatttatttacgggatagattcctagaagaaaagtcacttgttggaagatggcaagactcttgctttatgttgtcagctgcatcctggcatctgtgccatctttcataaggagcaacaatgcttatttcactactctttggccttggggctgtgagaacatactttctcttacatttctttagcgcttcagtgttttttctaatattttcacatttgggtccacaccctcctccccaaagccctgcaggatgtgctggtttcatccaagtgaagcccagacaccccactgtccactttccactcaggccatgaagccctgggaaatggcacaatgcccatcctgttcctttgccagcttgcttaggagaaatgaacaagcttatttatcaatgctgaacacaaagaacagtcacccctccccaacacacacacacacacacacacaccccaaaactcagtttaaaaggtcaaactgcttattttttatatgaaatgttttaattctttaagatagcaaacataggcatgtataaagttttgtcattttcatgggagaaaaaaactaatttttaactctcagtgaagcgtataaaagctctcatttcgaaaaacatacaatttgtatgtcataagcttttcttctctaaaaaaccatttctactgttgtgttatttataaccacaagcataaataggtttaattcagcttgtgtaggtttgcctcaatcagagctctttgtaagataattcaatcacagttaaaaaccaaactaatgttctggggggcagattgatgattaaaggtgaggagatcctccttggagtaaaggggttgggtaggaaggagaacacatcaactggagagctccaatatgagcccttgcactccccactctgccctccatggctttgaaccattctgccccaggactcttggactttagttaatttgtcccagataatcaagggatgttttgtatataaaaacagataatctgatttttttaaaacttcatgaactgaatcagtataaaatgtttagaacttctgtcttccttaagactcaggactatttactaaactttgttcccaactatggtaagttaagacttagaaattttagatacatatttttattacagcggtttccaaatctatcgcagcataagaacaacttggaaaacctattaaaaatgcagattcttcttccttaccccaggcattctgaatcagaatctttgcaggtggagctccagaatctgttgttaacaaattccaggtgatgccagtactgaattttagtaatctagtcaaaactgaagtcttcccttaagctattagttttgaaagttgaaaactaaatagaaatacaacacatcagttttctgggactctctcttcactgccctataccacttatttatggactaaaaacacagaccaccaccaatttgccctgtacaattttaagatgacgctgttggtggaaaccaagtgtttttacctccttttgtgcttacacaaattagcaacctacaccgaaagtgtttccacctgtgaaaatttctcttcagtttgatctgaagttcttatttatagtagcttgtcttcattttaataataatgatgataactatcatttgccaagtgcctattattagccaagtaatgtcccaggcactttccatgtattatttctgtaagtgaatttacattaaatattaaacatgagatgattgaggctcagagcttaaatgaagagcccaggtgggactctaattcaggtctatttggcccccaaaactcatgtacatactatgtatcctttctgtgtcccagttgtctctgggactcatggagtattgcttgctgcactttgagcctgtctgaaagtttctggagttccctcagaagcccccagttacagtgttgaaagctgacctttttgtttcggggtttctctgtagttcatcctatagcagctgcatgggtttcctatactaggtgtatatgggctggagaaacagtccattccagccagccccagtccagcagtgtgttgtggtacagggcttgctgttctggtgggcttctggctggcaaacctgttccagagaatgactgaccatgccacctgaactagaggccaatttccaccatttagcagcagagaccacctccatagacactttctttcagctgttaggaacaatcttcctttccttcatgtagtaatactttttaatcatgtatttgagactataggactttaaagtgatctttcattattaaccttgaagtctgggtttttctcattttaatgatgttgatgtagcttctgtaggggtaagtagattcctgtggatttccttctggtgccttgagctccagatctgaagccatactccacctccctcatactcctctaccttttccaggttctttattttaggtggtgggttgaatcttgtgttttgttctttttttaatgaccttgtcataattaaaattgcaaactttttttgtacaaaactgatttgatctgtccccagcgtgccttcctagtctgacttctcttccattcttccacacattccactctctaactatactggaaggtttgctctgctccaaaacactatgccctctccagtcctctgtgcttttcttctcaagcatttcttcatccccagctggtcctgcttgcctctctctttccatcgtccaagcatgtaccatatccaaacatgtggccatcttctgtccaccctccttcagtgaagggatcccctggctttgtcctggtcatcctccatggtgtttgtttcttctaattaatgatggttgacagtttatatgtctctttccttcactaactccaggggcttataaaagtctcttgaatgagcaaattctatcaaataagacagtggcaaagcagagaatagtaagctttggaaaaaggagcaggaaatgcttttaaaacttttttgaaaatatagttttaaattttgataaacataatttgcattaatttttctttttatcataaaatatttcttgcccttaaagcaggtactgagtttatgtgttttctcttcctttttaatttaatgtacatctaggtggcacagggtgcttttaaaaggaatcctgaccaatggactggtatctgtgtatgagctggattatggcaaacacgaattagtcaacataagaaaagtacagcccctagtggacatgttccgaaagctgcccttccaagcagtcacagctcaacttgcaggtaatttctgtggaatctgaactcatgctacaacaatgcaatattgtcattttatcctgggtacttagcaagtactgaatcattggcctcttgagtttaggtatgttgggtttttgtttttttgtgctaataatattgcaaccataatggaaataattttaatgatgtcttacagtcgtg

SEQ ID NO: 478677 - DNA, 856 bp, Homo sapiens
ccaaattttgtttctcaagaaaatgaatttctctaaagtcctcacaatgagaacgctcttttcaagggctattacaaatagtgctgctgcgaacattccttgccagaatcctcctgtccacgcgcacagcctgctgttggaagtgctgggtgatagagaaagcctaacctcaacttcggcagagataagcctgaactcttccaaagttatagtaccattgtacagtgcagtttcccatcttcaacaacacttgaagttacaaaaattgaaacactttagaaattctgatatcagctcattgagaacgggccatgatgacgatggcggttttgtcgagtggaagcgggggaagtgtggggaaaggaaagagaaatcagattgttgctgtgtctgtgtagaaagaagtagacatgggagactccattttgttctgtactaagaaaaattcttctgccttgcaaaaaataaataaataaataaataaataaataaataaataaaagtaatggaaacatttctaaagtcagtgaaatagaaaccttttcctaacctgtagacaatttgaggatttttccatttttttattagagaatgaaacaattattaaaaacataccagtttatttcacttaaacatttctgtgttgggatatttttatttcatcataagtgataaatcactggcattcagcactcctgaattttgaatcacttgttgtaaatactgagttttaaaaagctagagataattttgacatgtttaaaatgaaaaacttcaaatatttggtctctaccttcctctttctgttctcatttgtttctggatttttctcaaataaaaacaaacaaatgacatt

SEQ ID NO: 478678 - DNA, 1897 bp, Homo sapiens
tccctgtcttgggagcctttcttcagggagcttgatggttccaacccacccaggagcctgggacatctgtgcccctgggcaatcccctgcagtttcctgattccaagatgagggggtagaatccgaagatctccaaggccttgatgagtgctaccagtctgcaaattcccaagccaagacggctagcacaggccatcatcctggcccacgatgaagtacacagaggaggcgcttggggttcagaggcacgtgtggaactagaccgacgccactcaccccagcaggtggccaagcgggatgggagcgcgggtctccccatccccagcggtgacgggcggcggctctttcctgaagaatggggcggcgtccgcaacgggaaccgctggaggcgctccccgggaccctggcccgccctcgcccccgcgcatgcctggccgctgaggcgtgagagccgccgcccggggcctccccccgcgcgccttgcacaaccggcccaggtaagtgctgcgtctctgggcaattatcgccctcccgccgccggggctggccgcgcacagggcccacggccaaggcactcgcagccacccaaggagagctgcacggtctacgacggccgccagcgcgcgcgatttcacaaggcccgggagcggggacggggcggggcggcgggggcggtgacgtcacgcgcagccacgccccgcggttgccccgcccccgcgctgggccgggcctggggaggaagcgatgcgaggccacctgtccacctgcgccgcttcgtccttcctcctcctcctccctccctctccggcctctgcctggactgggccagtgggcctgtcagcaaggctacggtagaagacagccacgatgatgctgatgggggtgataacttggactgacacaaaacgcgtttctatagacattatctcattcttgttctcacaataatcctaggaggacctctggttcatgggacagttcacattctttgagcaagttctgtttcaatctctttgcaatatgttggtgtggaaataatttttagtatcacaggtaatcgtggaagatagttaatgttcaccaattatccaattctcttttacttctaagtatgtggatgcatatactcttctgtccccttgaaataaagcatggtcatgtgactatttttggctgataaatgtgattaaaaggagttgttcctatcttttggctattgtgaagactgctactatgaacattggtgtataggctttggtttagacacttgttttcaattatttgggatatatacctaggaatggaattgctgggtcatatgtaattgtatgtttaatgttttgaagaaccaccaaactgtcttccatagtggctgcatcttgttacattcccaccagcaaggtacaagggttccaatttctacatatccctgccaacacttgttatatcttcccgttttttggataatagccattctaatcgatatgaagtggtatctcattgtgttgcctttgtttctgaaagatacttttactgtgtgtgaagttctcggttgacatttttacattaaagattttttccccactgtcttctagcttgcattttcttccaataacaaatctgctgtcatctttatctttgttcccactgtatataatatgtgtctttctctgactactttttagatttttcctttatcatttgttttgaaatgtgccttggtgtcattcttttgtttggaattcactgggcttcttagatctttgcatgtatactttccaacttttgggaacttttgaccgttcgtttttaaacacatttgttgagatataatttatctaccatacaattcacccatttaaatgtacaattaactgtatattattatatgtgttga

SEQ ID NO: 478679 - DNA, 814 bp, Homo sapiens
attttggtaggcacactggggatacaatgctgaacaggatagccctcaatgagctcatagagcagtcagtgaagtgggcctggctgcccatcacttctcagtgcctcaccacaaagggaagaaacagtgctgggagaactgagggagagcagggaaggctccctgtaggaggtatctttgcttgcggagtgatcatgtgcaagtcacttatcctctccgaggctcagtctcctcatctggaaaatgcagatcagaatcacatctacttcatagggttgttttgcacattaagtgaagaagtgaatgctaagcccttcatgcagtgcttgctccacgagaagctaaactcggatgccccaaaacaggtgaagaatgaattgcatttaggcaagaattcgtcaatgccttggaatgtcataaagatcctgaagctgggagatgagtttacatttttcgtctgggttcgtatctgcaaatggaagtgaggcacaatggcagttatctgaataaatcagattaaataaaacacacacccacacaagaccaagaaactccttaatcattttcttcaatttgcatgatcttggacaagttccttttttctttttatattgtggtaaaatgcacaagataaaattcgccattttaaccattttaaagtggatgagtcattgtcattgagtacattcacaacgttgttcaaccatcaccactatttagagctgaaacattttcatgctttcttgggcatgaaagcttttgtgctttcgccccaatttgctttgttgggcaagttttttaacctctaagcctc

SEQ ID NO: 478680 - DNA, 978 bp, Homo sapiens
agcaaacggaacaccaggagattatatcccgcacctggctcggagagtcccatgcccacggagcctcgcttattgctagcacagcagtctgagatccaactgcaaggcagcagcgaggctgggggaggagcgcccaccattgatgaggcttgagtaggtaaacaaagtggcagggaagctcaaactgggtggagcccaccgcagcccaaggaggcctgcctgcctctgtagactccacctctgggggcagggcatagccaaacaaaaggcagcagaaacctctgcagacttaaatgtccctgtctgacagctttgaagagagtagtggttctcccagcatggagtttgagatctgagaacaaacacactacctcttcaagagggtccctgacccctgagtagcctacctgggaggcatcccctagtaggggcagactgatgcctcacacggctgggtacccctctgtgacgaagcttccagaggaacgatcaggcagcaacattggctgttcagcaatatttgctgttctgcagcttccgctgctgatatccaggcacacagggtctggagtggacctccagcaaactccaacagacctgcagctgagggtcctgttagaaggagaactaacaaacagaaaggacattcacaccaaaaccccatctgtatgtcaccatcatcaaagaccaaagctaaaggaggatgttcgagcccattgtgaagaagctaaaaatgttgaaaaaaggttggacgaatggctaactagaataaacagtgtagagaagtccttaaataacctgactgagctgaaaaccatggcacgagaactacgtgatgcatgcacaaggttcagtagccgatttgaacaagtgaaagaaagggtatcagtgattgaagatcagatgaatgaaatgaagtgataagagaagtttagagaaaaaagagtaaaaagaaacgaacggaacgtccaagaaata

SEQ ID NO: 478681 - DNA, 1116 bp, Homo sapiens
ggacgccaccaaatctaggacacaacccagcaattgtttactgagggtcaagtaattttctgggtactagcaaagtaccacacagggtctctagtcttcccaaccatgctgcaaaggttcttcctcttctcttggtctagtgtccttctggatgagttgggaaagtagaacactgggcaggaggtggaagacgggagggtactctctcaatgtggtttctgcaatacaagcaggccttccaccctgcccagatccacaacgcttctacgccagcattttgcgttaagaaaaagtctcctctggtatccctgccttgtgtctacagacctcaagaggcaaaaagggaaaaggagaatagaactgtcctaaaacgtacatcaagcacctggcccatagaaggcgctcagcaggtgatagtaggtcttccgcacctaagtcaacaaaaactgttcatcttcaaagtggaatgcagcatttcagaaggcgtgccagccagcaaagggttcaccacacggggcatcccacaaacatccacagtgactgggaatttcagtcctgccttgccaccctattgcctgctgcgaactcttggcccgctcaaatgtgattccattaggggaggatttccagacaccggcatgtaaagaagcaccagttgccgttttctccttaataaccttttcatctcagagaatggctccccatcccctcagtcatctcctgtccaagttaataattgtagttcttttcatgtttctccattagtcctgtttctcaactcttaaaatcactaccttcaaaccatttccaaattccctgcatccctatgaacctgctttatatcttaaaaagtatatagaaatgtactgagtaaacatatggacagggcggctgtgtaggtactaatacactccatctcgtcatggacttcgccaagatttcttctgaaggaaatgttcaaaaatggagagtagtgaaaatagagaaaatgctacttgcattttctcaattatttgctattttggagtcaggggatgagggagacctactaataaatcataatggtaaaattaataataatagtatttgatatgtatgatgttcagggctccagct

SEQ ID NO: 478682 - DNA, 691 bp, Homo sapiens
gaacaactccagatatgccacctaaagagctcttcactcctgaagccagagagaccccgaacccaccgcgaggaacaaacaactccagatgcgctgccttaagagctgtaacactcaccacggtctgcagcttcactactgagccagcaagaccaagaacccgccagaaggaagaaactccgaacacatccgaacatcagaaggaacaaactacggacacgccgcctttaagaactgtaacactcactgtgagggtccgcggcttcattcttgaagtcagtgagaccaggagcccaccaattccggacacaatatcatctaggaaggcaaaatatattgaattaactcaggttgttctgggagaagcattcctatacatcaacagccaaactgagacccaaatgagaaaaacaatcccatttgcaactgccacaaaaagaataaaatacctaggaatatggctaaccaaggaggggaaagatattttcaatgagaactataaaacactcctcaaagaaatcagagaagacaaagacacggaaaaactttccatgctcctggacaggaagaatcaatatcactaaacggctacgttggccaaagcaacttacagattcaatgctattcctatcacactactaacaatattcttcacagaatcagaaaaaaatattttaaaatgcatatggaa

SEQ ID NO: 478683 - DNA, 827 bp, Homo sapiens
acagcagtatctaggacaaatatccacccgttccggcctcacaaagtgccaggattacagcgtgagccaccatgctcggcctctcctctcctctcctctcctctgctctctctcctctcctctcctctcctcccctccactcctctcttctcccctcccctcctctccactcccctctcctctctcctcccctctcctctctcctcccctctccactctcctctcccctcccctcccctctcccctcccctccgctctcctctcctctcccctctcccctctcctttcctctctcctctctcctctcctcccctcccctccccctccttctctctcctttctttcttttcttttcttttttcttttcttttctttttctttttcttttcggctatggcagctggcactgaagtgctcagggatccaagacctgtgggaccctatatgggcttgagcagtgcctctgcacagactccaggtggctctctgtgttgctctggaggctcatggtggccttgggaagcagtgcccctgtggctccactgggtacaggccctgcagctgctttctcaggctggaattaagtacctgcagcttttccaggcacatgatgcaagctgtcagtggatctgcctttctgatggtggccctattctcacaggtccactaggcagtgtctcaatggggactctgtgtggggcctcaaatcccacatttcccttccacattgccctagtagaagttcttcatgagggctccatccctgcagcagacttatgcctggacatccaggtatttccatacattctttgaaatctaggcagagg

SEQ ID NO: 478684 - DNA, 687 bp, Homo sapiens
tgacacatgggaattatgggagctacaattcaggatgagatttggcttgtcaccaaaggtattgtcctaaataagaaaacagtgatgcaaggtggccttagttccaaagaatgttacagatttaaattcttcagcagattaagagagcagacaatcatttatactggaactggcaggcaaggttttatggagggcagtaatgcccctgtgtgcactttggaggcctattttccaggactttactgcatagcagctgctacctgggttacttgtgatcctgatagaagtgagtcccggaaaggaacagacagacgggaaacaggtggacaggttgtgaatgtagcaatgggaagaaagagaaacaacagcagcagcaactacacactgagtacttatgccaatacactaagcccttcatttacattatgttaggtgttcttacaaaaaattacctgaataggtattattattacacctactttacaggtgaagaaaggaaaattcaagatggctaggtaactttctaatgtcataccagattgcaaaatatgtcacttagaaaaacaaaacaaagctaatagtaaaacaaaaaagttaccagtcctagagcctatacatgtacttgcaaatatgaaaaaaagcttaaaaatttaaaatcctgtagaatcaaaatgaaaatgtaaatta

SEQ ID NO: 478685 - DNA, 509 bp, Homo sapiens
gtaaaaccaacaagttttattagtgattttcaaacggggagggagtgtatgaatagggtgtgggtcacagagatcacgtgcttcacaagacatggggagcagcaagtgcgaaacccctgggttgagaatgattctggaatgctggatgaaaagcaggaggcttatgtggcagatggagtaagtgaggtggatccctctagctcaggacccagagaggtggtgactcaccagagtgtgccatcttggtgggcactgtacttcacctgctgctcactgagtccgctgaaagcaaagcatgacctttcagctgcctccagtcaatctgattttgcagagggatctaatgattttgtctgcagcaggaggattgaacagggattggcaaatgatagcccatggaccaaatctagcccaatgtttttataaataaagtgttattgaaaaaaaccacacctatttattaacatactttctatggctacattcatgaacaaccacaaggttgagtc

SEQ ID NO: 478686 - DNA, 753 bp, Homo sapiens
gtgggcgcagcttcagccgatttaaatgtccctgcctgacagccctgaagagagcagcggatctctcagcacagcatttgagggacagactgcctcctcaagtgggtccctggcccccatgtatcctgactgggagacacctcacagcagggttcgacagacacttcataaaaaagagctccagctggcatctggcaggtgcccctctggggtgaagcttccagaggaaggaacaggcagaaatctttgctgttctgcagcctccgctagtgatacccaggcaaaaagggtctggagcggacctccagcaaactccagcagacctgcagcagaggaatgcctcttctcctccaaaggatcacaactcctcaccagcaagggaacaaaactgtggttaataaaaaactcctctgagctaaaggagcatgttctaacccaacgcaagaaagctaagaaccttgaaaaaaggttagacgaattgctaactagaataaccagtttagagaagaacataaatgacctgatggagctgagaaatgcacagtacgagaactttgtgatgcatacacaagtatcaatagctgaatcgaccaagcggaagaaaggatatcaaagatcgaagatcaactcaatgaaagtgagaagattagagaaaaaagagtgaaaagaaacaaacaaagcctccaagaaatatgggactatgtgaaaagaccaaatgtatgtttgattggtgtacctgaaagagatgagagg

SEQ ID NO: 478687 - DNA, 602 bp, Homo sapiens
gcgggtcagccacttctcagccaggtccagccgcaggtgtcgatggtctctagcatttggtatgtttttgcagcagctggtactgattgttcctttccatgtttagtgcttccttcaggagcttttgttggggaagttcttctggatactatcctgaagagtgttttccaacctggttccattctccccttcactatcaggtacaccaatcaaacagatgccctgcccagagaggaggaatctggagaggcagtctggctatggcggctttgcgaagctacattggactccacccagttcaaacttctcagctgctttgtttatactgtgaggggaaaactgcctactcaagcctcagtaatggcggacaaccctccccccaccaagctccagtgccccaggtcaacctcagactgctgtgctggcagtgagaatttcaagccaggggatcttagcttgctggactccatgggggtgggatccactgagctagaccacttggctccctggcttcagccccctttccaggggagtgaatggtttggtctcactggtattccaggtgccactggggtatgaaaaaaaactactggagctagctc

SEQ ID NO: 478688 - DNA, 605 bp, Homo sapiens
tttccgaggctggagtgcaatggcatgattttggctcaccacaacctctgcctcccgggtgttaacgaagttctggcagcttgtctgtgcaggctactcaacaaggcagacaaccttcagaaggaagatactcgctgtcaggttcatccagctataattggagtatatattgactttggagagattgaatttaacaaatgtacactaagaatgatagctgacactaattcaatgagcagaaggttaaatccgatcataattcctgagaaatgtgctctcctgaagaaaaatcagaaatacattgatagtggaagatttatggacagaaaagaggaaattgatgtacagaaaatcgaagtgagggacatcccttttaccaacttggcaaagactaaaaatacagagcatccaggatcaaagcgtattcgtgatgcgaagaactatcccctgacaatcaggctggaagaaggagcatggtttttatttgaatatgccaagaagatacagagtaattgacagtctgatttatttatttatttatttatttatttatttatttatttattatactttaagttctagggtacatgtgtacaacgtgcagg

SEQ ID NO: 478689 - DNA, 517 bp, Homo sapiens
gttcccttttctccacatcctcaccagcattcattagtgcctgtgttttggatataagccattttaactgggcatcaacaatggcggatgcccctcccccagccaggctgcagcctcgcaagttgatctcagactactgtgctagcagtgagcaaggctctgtgggcatgggacccgacgagccaggcatgggagaaaatctcctggtctgctggttgctaagaccatgggaaaagcacagtatttgggcagaagtgtcccatttttccaggatggtgaggtctcccaggccccagggaggtccagaggtaccatccaggagtcggggactagagtcaaaaaccttagaactctacctggtgttctgttatactgccactgagctgacactcaagctaaaagatgatagcactgagttcatggcctcacaatttctgtgctctctgcaccatactgctgctgcaggggtcggggaggggtggcagttcagataaattgttgtccttgtgtagggaac

SEQ ID NO: 478690 - DNA, 784 bp, Homo sapiens
tatcccatctggggcaccgaaatgtgtctggaattggttccttccggtgggttcttggtcttgctgacttcaagaatgaagccgcggaccctcatggctatagctgccatagatagtgattcctctgatggatctgggcaaagtaaattgaaaacctgctggaaaggattcataattctagattccattaagaacatttgtgttaggaatgtggcaagtcatttacttcttccagtgtccttcaaggccatgaaaggactcatactgaagaacctgaggaatgtaagaaatgtggtgaagccttcggttgttccagttccctttgaaagcatgaaatttcttatatgtggttttaaaaaaccctatgaatgtaagaaatgtgttaaagctttcagatgttctaatttcactagaacacatgaaaaaactcacactggagaaaaacccaacaaatataaggaatatgagaatgtatgcaatttccccagttccctttaaaaacagaagaacctatactaggaagaaaacctcataaatgcacaaaagtggtaaagcattccattttccctgttgctttcaggtacatacaagaattcacaatagagatataccttgtaattttcagaaatgtggtaaagcctttagtttttttatttttcttgaaatcatggaaggacttagtggagaaaagccgtatgaatgtaaacatttgaaaaactctcttcaattttcttaatattcaaatagtattttaaaatgtttacgacagatggaactgcccctc

SEQ ID NO: 478691 - DNA, 569 bp, Homo sapiens
ctgctgatagtatcgacaatgttttattcttctataaagcaatttgtggtaaaagccaaaaaaagaatcatacttttttccgtagatgttgcaccatgttacaatctcaccaacagtgtacaagggttccgccttccctacatctctgctaataccggttattttctgtttttaaattgtagtcaccctaatgggtatgaggaaatacctcattgtggtttgatttgcatttctcttatgattagtgatgttgagcatcttttcttattggccatttgtacatcatctttggagaaatgtctccttaagtcttttgcccatttttattttttatttttaaattttatttcaatactttctggggtacaagaggtttttggttacatggattacattaaaatcatagacaagaatttagagataaaaattcacaaggaaaaatagaatgagagggagacaacttatttattaatgttgcaattgttattttgggcatttttgttttaaatttagagttgccatacttagtgagactgggagacaagcattatttttggatgaatttaagc

SEQ ID NO: 478692 - DNA, 474 bp, Homo sapiens
cgggcacctctggcggacacagagcacccaccatcttaaaatgagcttcaatcaagaggaagaaggaaaattgcttaagtcagacccgacagctaaaggacagttactgcccttcaatacccctgccacactccacagcccacagccaatgactgatgaaccctggatgcaaaagggttccctgtctggtgacgagctgacggaggggtgtgggacccgtggaaggtggactggactccttttcttgggtctactgcagcttgttggaggtgtggataaggcatttagggtctttggtccttcatttgtccaagggtggcaagagaagctccactgcagaggcagtggccaagaggctttcagttgcctctggaggctctgtccagggagttgccaagttggtactggcttgatagctctggtagggggtggctggaggcccaagcccggaggccctgcttggtgaggaaatac

SEQ ID NO: 478693 - DNA, 962 bp, Homo sapiens
tgctgagagctgcagaccacagctgcagaagtctgctgcaggggcagagccctcatggagaacctttatgagggcaatgtggaaaggaaacacagggttggagcccctacacagagtccccactggggcagtgcctagtggagttgtgagaagagggccaccatcctctagatcccagaatggtagatccattaacagcttgcacaatgtgcctggaaaagctgcaggcactcaacgccagttcatgaaagcagctgcaagggctgtacccctcaaagccataggggtagagctgcccaaggacttgggagcccaccccttgcatccgtgtgtcctgaatgtgagtcatagagtcaaaggagattatttgggagctttaagatttaatgacagggttttggactttcatggggcctgtagcccctttgtttcagtcaatggagctccttttgggacaggagcacttatccaatgcctgtacttccattgtatcttggaaaagcagaaacctgtacaacccgtggaactgtgaaatttctttgtaaattacccagtctcagatatatctttatagcagtgtgaactaatacataagtgtaaaagaggggaaaagtccatttatattggtatttatggttctgtaaataagaagttacatgaggctaagagctgttgctttctttccttgacgaaagactttttctacccatctatttaagctcatgcatgttaaataaagaaaaataattagcttctgtgtgaatatgttcagcatattaatctaattatgttcggaagaacgtcatgtgagttttgagttaattattagccaacaatatatgtcaattcttaatatttaaactattattcatttgcaaatgattataagcaaaaaagttagttattattgctcaaaaggcaatattaaaaagaaagtacattattatttataaagttctatt

SEQ ID NO: 478694 - DNA, 614 bp, Homo sapiens
agccattctaactgggggtcatgggtgtaggcttgggtaaatgggcaaattcaagaggtattctgaggcacaacagaaatgcttcacagccaatcggctgtggagggtgtatgagaggagaagccaagattatttacactcttttgacaactggccctcctaaaaatcctccaacaacctcagtccgtcatgaacaagtcacagatccacagtgcagagtctggactagtgctgaccttgacagtgatggacaccctgtgatctggacttggctctccatcacaacaatcccaggtctatttactgtaagaccaatttacagactaaagggcttaacttttctgtccacgcaggtagaaatttctgagtattccaggcaggctggtattgaggcttaccacaggagtcagaagttatttttccacctggaatgcacttcaatttttccacatggactactccctgatttcctcaccactgccacaaaggacattgatagttacattcaaactgacatacaaaattaaacatctaagagatgccaggatagttaccaaaactttaacacttgaatcagtaggccaagtaaagatctgctgttaccagtgtgggtg

SEQ ID NO: 478695 - DNA, 660 bp, Homo sapiens
tattagtgataaaaagggatcaaactcgtatggctctttatggtttgggatgcccaatttatcactgatactgtgggttgtaaggctgcttctaagctgattttaattgactgctcctgccctgggacagaccaaaacagttttgattccaacgtggtctctgtggcagccgaacaaagcattcaaaatgctcagtgggagggatcaagtgccatgctagcaagacctgatgcaaaaatcatttccccaacatgccagttggcaaaggcaccagagaggacttgtgccagtgactctggaaatccaacctgctataagcagccctgttttactgcagaagatgattcctgccccaggttgaatgggtacaacctcatggaaatgtcggtgcctttaacccgaaggcacttaaaagctaggaaaatggcaatctaccctgaaatacactgtcctaaacacagcaagagaccacaatgactggtctcatttaaattctttaacactttcttggcattctgtagagatgcttcctaaatctcaaagcactttgctaaatctatattcctatctactattccaacaataattttttaaaagtagaggctagatattgaatgaccacatcatgtcaactgcctgatgagtcagtattatattagc

SEQ ID NO: 478696 - DNA, 681 bp, Homo sapiens
agcacggcaataggcacctgatagatgaagcgaggcaattggtataaaagcataacttcctttttcctattacactggctaatttatgaagaaaaaaggtttgattggctcatcgttctgcaggctgtgcaggaaccatgcctggggagccctcaggaaacttacaatcatggcaatagacaaaggggaagccagcacctcgtatcatatgaccctctccacagagctatgctttcaaggctccaggaaccgttccttacccttgccctatcaggccttgcggtgactgtcccatttcctgccagaatcctgacaatcaccgtctccagaagctcaatggagaggtccattggtatacaaggaaacgaggccctcagtttaatcacctacaaggaactgaggcttgacagcaaccacagtgttgctaaagctcaagagagaataagaaataaaatgccttaaattaaatatacaagttacgtaatatatattagtgttctttgaaagttttaaacttgcagaatattaaaatgtcagtgaacctaatcaaagacttctacaataagatcccttggcagggatttggttttcagtgttttctttctatatctcctaacgagaaaggcacacttctccttattgagttagatctttttaaatttaattgaaaattaaatttcc

SEQ ID NO: 478697 - DNA, 841 bp, Homo sapiens
ctagttgtgctacttccgagcgggtggggcacacggtcatggctgctgtcattccaggagaactctactacgcacgaagagataaagactatctgcaacatattcattggggaacagatgtcacagatcagatgtctctctattatcttcctcctcaagaggggtttggtcataaagaatatcaagaccaggaaaaggggacacaggtgaccatgcacacagtgaggctgattatgtgcatagaaaccaagagccttatgttccagagggcagtgccagctccttttctgctgctgcctcctggagctcctgtctgtcctctgagctcctgcagaagccttcctctatcgccactgccaaaccaccaaccccagactggggcagtacatttgcttttgataccctggagtgtaggaggaccacttagacttggcattgtaagccccatggttgtgtggccctaaacaagtcatggtgatgacaacaccagccctgctcctagttcaccaccttctgcttccacactggaacgccaattattcttaggtttcgtcatttaacataatcccaaacttcttggaggctttgttcattttttaaaaattctttcctctttgtctttgaatggactaagaagttgcttttgttttttatttatgctatctatttcactgaagagttttcccttcacatcttatatcatttttcaaatttctttgagttggactttacctttctctggtgactacctgattagcataataattgacatttttgaattctctttctggcaattcagatttcttctcggtttggatccattgctgatcttttgggggtg

SEQ ID NO: 478698 - DNA, 3376 bp, Homo sapiens
ctgcttccgctatcaccatcatcatcatcatcatcatcatcatcccagttcttgttatctatagtatgatgccaacttcaggccactccaccgcatggctgctgccgtttgctgggggtctgctacagagcccagttgcctcagtttctcccatacctggagagagagatcaaagctctgtctgtagaatcctggctggactggctgaagcccctgcagggaggtcttgccaagtgaggaggaatggatcagggtcctccttaaagaggcagtctggtgatgatctggcaaggcagctgtgctgtgttgtgagggagccttcctcatccagaccatctgtgttatccacagccagcaggctggagcagaaattggtagagtttcaaaatagccaataccacagacccacaaaggagcattatgtagactgtttatcctacaaagttaccataaccactgccatcattgcttggtatagatctgcagaaccgaaagaaaagaaaaatgggtagcctgctatgttaactctttgctgcacaataatccactcgcgttactttttgtacacggtatgagataaagttctgatttaatctttttgcatgaggatatctaactgttccagaattattcattgaaaaaagtatccttacctactgaactgcttaagcacctttgagaaaatcaattgaccataaatttaaggattttttcggaattccaattctaggccattgatatatatgtttacacttttgtcagtatcatatttgattactgcattatattttcttaatcatctcttactgagagaagtcactttctctgttgtaagctcccaatgccccatgttgctttatcatagaatttgtctccacttgtaattatataatttgggaataattaattcaaacaaacactttgttattacttcacattgtatcactaatatctagtaaagtacccacaatgtgatgggcattcagtaaacattgtaaaatgtatgaatatatgagtcatggaccaagaagcgaaagatactttagcagtattttgaggtatctgataagttctaagagatgtgataaggcatattctggaaacttccagtattttcacatgtctgtgccattaagtttaggttggactgttgccagaaataaagctataattttagataggtattccttaatgaacctactatgtcatagtaagtagtattattgtatcctggttatttccagttattcaagcttggatattttagtcattactattttctctcttttaaatttcaaacttaactatttagcagtctttcaattatttttgctctacaatgttccttctataattatagtttatatttgcattattatagtcttctgctgttgtttcaaatttattgtctttacctttagattcttctacatcaatccttgtgtcatatgtaaaggtaaaagatttttttaaaaagggcaaaaacacttcagaaaacactaatagcatggtttgattgttgggtgagatgcatacaatggaaagtgtgaggcctgacagagatccaagtgacaacttaatcttgtcctccttagaagtttttatgaatcatacaaactatgaaggaaaaagtgaaatattttaggcaaaataactgtagtaaaaaatttttcactttcaggtataggaatattccaacagtataagtaattaatttaaaatagtgaagttaatagagaagtctgacgggaattattataacctgcctcggtttccttatctttcctgaattaatgtttgcagaatgctttaaacagagtttgatgctcaggaaagccttgacaatatcttctattattattcctatatgatatttgtattactgaagataatgtaaattactcaaagtttcttcctcaacaatgagtatggtgcattataagtaatgagctaatattagtgtctattccactttagctgcaattcaaaaccccaaatgttgtgaaaaccaaagagtaatttttgtcattcatttgatagccaaatttgacctaaaccaatatctggctacttccagtctttacttatccctctcagtgtaaaaattcatgtgtttcactgtaggaatataaattttaaaaataaaagatggtgtcacattatctgtcaaattaaactcatgattgtgtttttattttaaattatgtacataaactatatcttaagaaaaacagtcatttcctttttgttatttttatgttattttccttctctttgcaaataccttgaatacaaggaagatcatgtttagcataaaaatcccaagtttaacacccaaaaagcaaaatactcattaaatataccagcagtaataggcttatatgcattgctactttctggatttcaatggaagggttttggatgacgtttttaaacatgaagtgatttgattagaaagtcaatgaatatagctcttgaattctataaaatgcatgtatatgcagctataaattttactctgagcatgggttttactaaaactctacatttttacaagttgtttattccttttactttgtctgaagacattttctaaaatcttttgtgagttctcacatatgttaatccttcttttacacatttgcctaggtagtcaacattttggtcaacaacagattgcatataagatagtgttcccataaaaataaacaaggttacttcaaaaagtgtgtagataaatggaattaaaatataagcatataaatataaactttatttcttaatgtaagcttcaccaagataaagacacttatgtaagggatgatacagaccatttagtccaattctaaagaagtgaagatctttggaatttaaacatatcaatgaagtctttcttcattattaactgaagaaaaacaggtgggctttaaagatttttttaacattaggaaaagaaaataatacagaaggagccaaatcaggaccttaagttggatttctggtgttttctcatagaaactcacacaaaattgctttatttcataagttgaataagcaggaacattgttattgttgagaaggactctggttaagcgttcctggacatttgttttttactaaagctttagctaactttttcataataagtacatattatcattctttgaccctccagaaattcaacagtaaaatgtctagcacatcagcaaaactgttgccatgatctttgcttttgacccatctgatatgctttgattggaccatttccatctcttggtagccattgctttgattgtgctttgttttcaggatcacactaataaagccatgtttcatctcctgttataatctttaaaaaagtttttcagtcttgatt

SEQ ID NO: 478699 - DNA, 905 bp, Homo sapiens
tttgttttgttatgatttagcgaagggactggtagcattttgcctctgccctagagatgtgtggaacttggaactttgaacttgagagggatgatttagggtatcagaggagctgtgagaagagggccaccatcctccagtccccagaatgtagatccaccaacagcttgcactgtgtaactgaaaaagcctcaggtactcaatgccagcccatgattgtggcagtagggcctgaatcctgcaaagccacaggaatggagctgctcaaggccgtgggagcccactctttgcgtcagcatgccctggatgtgagacatggagttaaagaagattattttggtgctttaagatttaatgactaccctgctggattttggacttgcatggggcttgtagcctctttgtttcggccaacttctctcattcggaatgggaacatttgtctaatgcctacacatacacatccagagaaaagcaatggaaagaaatacaccgaagaagttgtgagtggttatcactagataatgagaaaacggaacatttctgagtatggctttatactttattttctaattttatcctgtgtacataagcaatgaaatttgcttaaaatattatttatcctttggcttaaatattcttaatagagttgttatttctgaataaactaaggaaaattttctttatgtttgatagcactgagacggcaagcatctttatttgattgtaagagccaagggcaaagaccagtctctgtattctcagtaaaaggcctcaggcatatcagcccgttggctcttgcctatgaccaatcccaataagctcagatttcatctttgttttcaggcaccttgttctgataccaactcatgagattagttgtataattgttatttctacctctc

SEQ ID NO: 478700 - DNA, 728 bp, Homo sapiens
tgtgaactcagtgaactgcagcttctgcctccttatgacatgggtggattaaaatttaagcttcaccaacttcttgcttttgtgatggcaaaagatcttaactacagtgaaccctgttttctttatttgcaaaatttacatattacccactttacaagagaggaagaagacattacaactgataccacagaaattcaaagaataattcgatactattatcagcaactatatgacaataaattgaaaaacctagaagaaatggatacatttctagacatatccaatctacctagattgaaccatgaagaaatccaaaacctgaatagacaaatagaaactaacaagatagaagctgtaataaaaagtcttcaatcaaagaaaagtcaaggacctgatggaaccacagctgaaaaataattaatatcaatcatactcaaactattataaaaaaatgaggaggtgggaatacttccaaattcattctatgaggccagtatcactttgattttaaaaccagacaggcacaacaaaaaagaaaactatgggtcaatatctcctgaacatagatgcaaacatctttaataaaatactagtaaatcaaattcaacaatacattaagatgatcattcattgtaatcaagtgggatgcattccagtttctaatcatgaacatgcttgataaatgtttgttgcatgattaaaccaagtaaagaagcttcatcctagtc

SEQ ID NO: 478701 - DNA, 567 bp, Homo sapiens
ggatgcttcagagctatttcatacttaacaggtcccaacatgaaggctgcatatttcttgccaaacctgcccgtcccctgtgtcttcctcatctcagtaaaagaactattttcctccagttgttcaggagagaaaacttggaggcatcttcagctcatccgttcctgtcagacattgccaatttctatcagctcaggattcaaaacacagcagatgctgaccatgctctgtgcccatggtggtgatgccttggttgaagaaaagaccaaatatgcactcctgcagtcagtggtctgtgttgcttccatgtcgtctctctctctctgcatacacccaacaggcccccactcattacacacaatcaggctaaaacgagatggcaaaatcattccaggctctgggcttgtcctgccagtgacctccgtagttgcattccagcaggaggtaactgaaggctctgccccgaggccagcgatggtccttggttactgtccagcactgttggcctcttactcccaaagagcagtcatgtgcctgctacggatttgaatcatctcccatgatgca

SEQ ID NO: 478702 - DNA, 897 bp, Homo sapiens
tttttttttttatggcgttagcaaaatggagaagtactgtctgaaaaataacataactttcaaaattttacttactgctgataatgctcttgcacatgctcctcttattggtgatctttattccaatatcaaaggtgatgtcaccaaggagtatataaatggtacctggaagaagacattcaaaagtttcaaccatgatgtcaaaggatttgtaaaggatgaggaggttacaaaaatcaacaaggctgtggttgagatgacaaacaacttaaacctgggtgtgtgtgaggatgatattgaagagctcctagagatgattcatgaggaactgactaacaagaagttgttggaactgcaagaggaacagatagctgaagaagaggcaagaggaaagataattacaggagaagcagctgctgccatcctagatcctgatccagatccttcccctgctcacattatgcctcctccttacaatcctgattcttgggaaccatcccatgagcctgttacttctcagccccagtacccttccctaaaaggactccaacatgatatagaacaatggagaaatgctatccaaaatttcccatttccctctacatctaaggagtcagccccaactctcttccccttaaaggaggtgccacaagaatggggagctattggctttgtgaatgctcccttaaccagtttggagatccaaactttgacgaaggaacttaagccattgtttgatgacccttatgggtggcagatcaagttgatcaattcttgggacctcaattatacacttgcgttgagttaatgtccatcctaggcatcctcttttcgggggaagaaagaagcatgatccataagcctgctatggtaatttgggaacatgaacaccctccc

SEQ ID NO: 478703 - DNA, 668 bp, Homo sapiens
agacctactttgagccgcttctacagcatgggagccaacttggctggcacagacctcatagggacttttgaaatgcattttattaatccctcatcctcttcaccccctttcctctcttctccttctaagccttcttctaatcaaactgctatcccctctatacccaatgataagactaaggtagatattgtagaagtaaatgatttaaggcaaactttagcaattgaaacaggatatcaagatgcaaattcctggttggaatggatcaaatattctgtccacatgttaaacaaaagcaattgttatgcttgtgtgcacggccagccagaggcccagattgtcctctttccacttggatggattctacagcttgggacaataaataatgccaagctctctttctgctctatcctgaaatccaacaccctgcgggtcagcccccgaaggccatccagcttccatctcccaacgtcaatttcaccttgtgtctctcacaacaaggggaaaacttggcattccttggaagcttaacaggatgcaaatttctcagggtctttagtatttgaatatgcaaggtttattctgattggtgctctggttggccagcaatcattactttactttaaggaggattttagtcagttccatggatgctctggcaaactcac

SEQ ID NO: 478704 - DNA, 1029 bp, Homo sapiens
ctgacatgccctggagacattttccccattgcctcacaatcatggcagaaggcaaggaggagcaagtcacatcatatgtggatggtggcaggcaaagacagagagcttgtgcaggaaaactccaccttacaataaccatcagatacatgagatgtattcactaccatgagaacagcacagaaaacacctgccctcgtggagggacagacccgattctcccactgggtccctcccacaacacatgcgaattcaagatgagatttgactggggaaacagccaaaccttatcacctccaaattataaagggaaattttccaactgtggaataagaaaagatgatagaaagaaaggtgtcttaagaaaaatagacttcctagtggcactttgccagacatgtttctatctgattcagttttcaatagctagacaaacagtcctttcctggatcctgagaagagggattgtcaatacccaaagatcaaaaacagcttgcccataaatctatataaagtatagtcagtgtggctacaaggcagtatagttaaattagaaagccctgaaaagtattttgtatattaagatagaaatttttaactagtaaccaaaacagcagattttaaaacagtatgcatacaatgattaaatttttatgacatgtattagtgtgtgaatatgtatatttataaaaaggaaaaagtcttcaaatctatactccaaaatatgtacaaaggttacttctgtgtgagaggtgtatgttatttttatgttctttcctgcttatctgaatattctactttttcttcactaatcatggttttaaataatttttaaaactaaatcaatcgaagggttccctttataattttagtgcagggtaaaggattgtgccagaccatctttgtctgtacttgtgtttccagaaagtgaattagcctgcagcatattcaaatgcataccaggtgagtagtgccataacaggattcctctctaattcctgatgttttattttcccctatttaattttccag

SEQ ID NO: 478705 - DNA, 3891 bp, Homo sapiens
gttgtcgttactgataagaaactacatttcccagaatgcagtgagggtagcgaccgggctacacaggtgatgaaggggggaactgcatcctgggatccgcagtttcgcctgtccacccgccaaatcctaagagtggctgagcgcagttattggggagtggtagtagaaacagggtttcaccatgttggccatgctggtctcgaactccagaactcaagtgatccgtccgcctcggtcttccaaactgctgggattacaggcgtgagccaccgcgcccagcctttggggaagttctttttaccgtccatcatccattgccaccacaccttctgcttacgagttatttataataagtttaactaaaagagaacgagagaacatcccctgaaacccaaagtttgtcattctatacagctttcctgcctgcaaaagaggaggagcagactcatccagcaaatcacctaaaaagtttgaagatcaaaaagcctagctccagtttcagatccttcccctacctttctgaacactagtttcttcctctgaaaaacgaaagagggaacgggaccgtagagtggagtgggcacaagaatcgcaagtcccttctggctatgacgctgcaagactctaggtacagtttaggactccgggcattcagatccccgggacttgtcaagttctcctcattgacatttttgatatttcgtgacaacacaaattcatcacatttttgtgctgtgtgttatatgtgggaaggagattttaaaaagattgccttttgaagttattggatagctgtgttacagaagaaaacattgccttcaagaagttattggatagatatgttacagaagaaaagacgtttgtttcatttttgactttgcaggaaaagaatatgtaacacatcagaattcttctctcctccctggccttagtcgagtacctgaggggcattaaagcacttcctccttgcaatcacttacccagcatagtccttaatacagatatcttcattctctagcaaaagtcttggtcactcgttgacctgacttgactcatgcaatctactctgaaaatgtcactagagtcaggcccagaggatccggacttaagggacaactgtaggattcgtgtggctcatctcacttccaggcacaaagaagccacaccagatatcccagataatgccctcccagtgactcctctcagaaggcccgtgcctcctccccagtgccgagcctcctcagcagggctttgtcctattgatgacattcttctctttcacatttatttactctccttggatgacatcatcatcactcatagctactacattcacactgatgaccaccaaatccaaatttccagtccaacatgtaaacgaattccccgagtcatgagaagtagaagagagttgggctatgacagccttctgtgtcatgagcaagaatccagatatgtcttcagggggtgataacgagcaagtcaaagcttttaagcatagaattaacacaatcatgtttgtgtattagaaaaatcactctgaaagttgtggaaggaggaagtttggcctgcagaatagtactgattaagagcttttaatctttcaatcagtggacaagcaaaagtttccatttgttctatttcaaaagaaattattgctttgcaaagtagatttacatcttaataagactgtcggtggataaggttaatctgctctaaaaacaagtttttgggatcaggttctaggttttggtcagctttgtcaccccgatggactgccatgcctacagcagatccccaacaaatattgctcaattgaaatacttcatcaaatagattatttgtgtgaagatagatagtgttaaccataaatgaacctcatctttttattgcatcaagctaaaaatacttatttaatagttccagctaccaaatacggagtacttgaaagacacgatatcatactgaaattatttctacaatttaggtttattgctagtcagactgactctccttaataaaataatttttctataagtcttaaagaagggtgtcaaattaatatttaaaataatttcactcattcttttttaaaaaaggttcatgaaataacgcttttcttgttgaaagagaagagagctgtcagctctgttagagtcagtaagaaggaacaatcctttcttggtattgttgttgatgttggtattgagttgtcactgccttacagacttacctaaggattgtaatagtaaaaaaaggattataagaaaacttacattacttggttatattatttgtatatggtctggtggctcaaatatatatcagtcattaatgataaccaaaaacctatggctcaaatatacgtcagtcattaatgacaacaaaaatctaactcactctgacacagatataaatggatatggacttttggggggctgtgagtacaatgtggtcggaactattcttggtcaaaattaaatctcattaaaaatgtgagaaaaattattaaaccatcttaactgaattttaaatatttcatttaaactttcttgtaaagaacatattcattagcagaagattaaatttgcccaagtaacacaaagtcattttaactagagtttatgaaatacaggaattttaaagctaataattaccatgagtctgtacgattttgtagcattcattatttcttgtgcattaaaaagttctgtaagccagctttccaccttacattaaaaatataagatacatctgaacagactagcttatatttttagttcaatatacgtttctttgctaagcagcagtaaaaaaagtggaagcaagattttttttgaagtcatactatattcaatattcatgattcctattcattataactaaactgtagaagctgaatgatttttcagaatcttttccccaaaagtattctatactcccatgagaggttttttgtctactctttttctctttcattagagaacaatgttgacaccattttcatgatgccattttcaccagttcaccatatgacaagctaagcttcactacatacattctttgtagcatggagaaaccacaaatgcagaattcaatttatcatggtgaaaatatagcctgttataaaatttaaaaatataatgttaagtaagtcttcgtaagtctatcatacaggaaattttatatacagtggctccctataaaataagaaaagttggataaattaacgaaacaaaatgtgatttaaaaatctgagcaacattgcatgtattgatggtaattttgtcactcagtctaaaatggaataagggaataagaacttcagaattctatattacagttttctttacagtaattcactatatcattaataaaatatttcactgtagtttaagcatataagtaaattaacatccctcattataatacctcaccaatagttaatagttacttaagctaaaaactctatagttcctaaatcattgcttatatgtattaaattattgagcaaagaaacacctctattattttattgcccaagattttttcagaatttcctatattgctaagaatgaaacatcttttctgcaaataaagtacactgttataatgcatacacaaaaatcgacttgtgtttaattaggaattagtgaatgacatgaaacaaataaaaaacgcctcagtaaggtcattgggtaagttctggatagaaatctctgctgtcttaatgtgctgtatggtaagttttcttaaatgcctctctttttttaagctaaaaatccatcaactagtgatttgcgactttgtgacaaatttcctttttatgtgtacttcaaatgaaccattgtacccaatgacaatatgacttcacaaacttggcaaacatat

SEQ ID NO: 478706 - DNA, 562 bp, Homo sapiens
gagaacgggccatgatgactatggcggttttgagacgtggatccaccctcaagccatgattcagacaatcgggcataaaataatgcagggaatgacagcagctaggacacccgacagctatcaagtgacagccaacagcagcagaaggagccagagtgtagaaatgcagcctggctctgcagtacagcagtctaaaggcatttcacttgggggccactgtcccaagcacctagcatccccaggagacactctctcatcacttagtgcaatggctgatgaagtgaaagaatgcaaccaaaccattgttaaagtggatgttgatgggattcttgcattgaggagactggaccagatgatccctaaggtccctcccaatgaatttcttatgaatttccatatctcattcacactacatcccactgccagaaagtttgggaaccccagtatactcaatgccaaacagattgtcattccaagcatcaagatattgggggtcatgtagatctaacatatcaacaaatgaccaacctcttcacattgtatggagagagcccataattcc

SEQ ID NO: 478707 - DNA, 717 bp, Homo sapiens
ctgattcgtggagggtcaggatccagggcggagagagtctgagcttatcctacttaaacatgtacccaaggcaaagccaagaaacagaaccctgtcagcgtcccacaagttcttcatctttttcctgtccctggcatggttccactccccaactagatgcaaccactatcctgatctttgcaataattttttctttaatgattatttttaaactttacatgaatggactcatattgtgtatgtgtactttattctcattcaccaaaaatttttttctgtttataattctagattaccactgtcttctgactcaatgttgctgtcaagaagtaagttatcagtttaatcttttgtctttagctctttttgatttcttttttctactggcattctacagttttggtatgatgttttttagtttatctgctttgaataaaattttaatatattttccaacatttttagttgtgctcagtaagaaggttggtcctgctatgattagaaatgggatttaaataaaaaaaaaaagttagaatcttatttacatactgctttgtaacctacttttaaaaactaaacttattatgaggctttttccttgtaattataagttctatttttatgagtgcatagtatacctctacaggaaaacactaatttactcaatctattgttgcacattgtagttcttggtgattttctagtataataaatgct

SEQ ID NO: 478708 - DNA, 622 bp, Homo sapiens
gaatcctgcaggatgactgaaaactcctctgttgatcagggcattcagcaagcaacctcacccctaggctccgggattgtcacaaaggtgttcctgtctcaatttgagtgtggtgttctatttctaatgcctaaacatggcaacctttgctgtgccatttccattacagatttatacccaaggacttcactttttgatgataataaaaacaatattgtgtttttaatattcaatttcagtgttcattgttgctataaaattatttaccacttctctatgacaaggtactgtgggaggctatggatgaaggattcctaccctggagaggtgaatagcaccataggcattgctaacgtcaagtttgcgcacgctatcagaggggaagagaaagaatttccagggcagaacattaaaaattgttttcctccaatatatatttttatggaagacaaagatcagaattataatgaccagaagagatggtgaattagaatgaatctcatcttcagtgctattgattttgttcaggaagctaacctccagataagggtcacagtatgccttggatagagagaaagggctttatttgaaaactactaatctgaaaatcatggaggaggat

SEQ ID NO: 478709 - DNA, 1586 bp, Homo sapiens
acagctcattgagaacgggccatgatgacaatggcggttttttctgattttcacaagcccgaactatgcaactggacaaatatgtatggctgtcctccagcactgcagagcctgtcatgggaggccatggaggaacgtccctgcataccgagctggggagagcacgaggtctggggcaggagacagttggccgagtctggaggcctggccgagggcctagtgggctggcaggacacgaggcgtgatgagctctcctttccggggcgcttcggccgttgcaggctgctcgcaggcctgagagtatttttgtatctggaccaccacttgctttcctcctctgtgatgtctgcagctgtggactcactgcctgcagtgcccaggctcctgccctgcgtcctgtccacccaaccaacagaggctgtgtgtgcatctctgttggttgtatgagatacccagtgttcttaggataagccccaacttttgtcatgtttaagttaatcagagttggtttccactgccccactccccccatccaaaaatcctaaatgaaaaaagtgagatagaaaagagtgtctatttaaagtgagttcttctttttcctaaacagctgttattaaattgatgccgtgttctgcatttcagagtgaggaaacatattggtagacacccattaagctctcagctgttgaccacgttttcagatgcattcagtagctccctgcctctgccctctctcctgtagacctgtcctccgttctgctgcctggagggtggctctgaggtgagcgtctgagtatctcgctccagtgagaattccagccagggatccctgaggtgagtaagagcgctcttatcctcatatcgcagaaggtccacagaggggctcctgggctccatggaccctcagaattgtagatacaattgtatcggtgtgcactattgcaacagctgtgaccagagctttgtcagattctcaaagaggcttgttacttggccctcaaaggaggcctgctgcctagagaaaagaatccatgctcctgcactcgtcagctcagccacactttcggaccttttcctgcctcacttttgcctttgtgttctataaaactagcatctccaaagcacttgcaactgtttccatatgcgggggtgttttatgggtttatgttcttgcatatgctgtaccttctgaaatgttctctccatgcgacctctctgccccttgtcagtgtccttttcatccgtccgcaccccctcagagcatgactcccacggtagatccttgattaccccctgcagagaattgtcttctcacgatgacagctttattccaacccacctagatctgttccggcctaaaggtcacgtgttgtgctgctgatccgtgcagatctagttccttcccagggggctgtggtttttctcctgtgttccagcacactgctgggcccataacaggtctaaacaaacaagggtaggaaaaatgcatcttcccaattaataaataactgatttagttatgaactattaattttaataataaaaaggtgtttttttcctctggaattcttagattattttgtttt

SEQ ID NO: 478710 - DNA, 635 bp, Homo sapiens
ccacaacccctgagggaaaacctaagtgttatcacacgtggaccttaataagggcatagtcccaaatgcttttattgagaggtccacgggtcgtctttttctctccccttacctgcaggctgggctcccttccacctcttctcactggcctcctgtttgtacccctgacctctccgggatctgccccagcgtgtgttgttcccctctatgagtccatgtattctaatcgtttagctcccacttataaggacaggctttctgaactagtcacattgaggcctgagtccttacagatgagaagcagaaagccacgcaaagcactgagcattctggacaaaaggatcagcaaaagtaaaaaccctgaagcaaggaagaaatggtctgtccatggagctgtaactgaaatcacggaaagtgaaaccgcagttataaagggactactataactaccgccataatcaacaaccgcacttgttcatcactgtaaaagaaaatgcttgtgctactcgtttgcatatgcgccttccccatcttcccacccctgaaatccagtctctatcccctggcatccattaatttgttcatctcttagttttataatttcaagaatattatataaacaaaatcaacagtgc

SEQ ID NO: 478711 - DNA, 648 bp, Homo sapiens
tccttttgctatcaccttcttggatgcccagtgtgtctggggtctgccaacgtcgtcataataaatgctctaacaactgctcttttaatgaggaacatttcacatctgtgtctgctgtaccctgggcctgttccaccccaggagtcgtaaaagttgggctagattctgtcatctgtggaggctggcttaacctgccattcttcatctttccactcagatatgaaaggcaagattcaaggatcacaccaactagagggatcacattacatcgaacagaaactgttttaccttgcttgcaaggaggtggaggcctccttgcccccaagtgtggtgccacttccgggttccttgagcacttccaggttatcagcccagctctcctccagtttctggggctgctgaagaagctgttggggaaacctgtgatggtaaaaatataggctccaaatattacagaatgaataggagaaaaaggctttttaaaatgctatcatctgtcattcggtatcactttttgaagagcagtactgacaagatttaaaaaaaattttattctagcaatgcagaaatggctacactgtgctacactaatcagagaatgtcagatgagaaatgcttacaactgtggccttttatattacctttatt

SEQ ID NO: 478712 - DNA, 568 bp, Homo sapiens
caagtcactggctagccaaatgtttttttcacaagatgctgccaaacagttatccaaaagtttgtagcaatttatacttctaccagcagtgcatgaaagtgtcagatgttctacatccttgccaacagttggtactgtcagtcttttacgttttagccattttggggcgctgctccttagcctggaagcatgggaatctgctaagcccctgggtagcccagcttgaggcgtttgatccaagcccacagcaaaagctgttaacgtgtttcttgaccacagcgaaacagtgggtagaagttttggtttggtttagattagccagcggttctgtggcttttggggagaataaaagcccaattacttccttaaaaaaacaagtgggcaactagattattacctcttatttctgattttgaagaagaggagccccttctccctggctcgacctgccccatcaaataaaaaatgccattgggcatcatgatataggcggcgtccactgtccacttgttgtttctgctttgggacagtgcctgagttcacggaacagtagggtggggtggggtgg

SEQ ID NO: 478713 - DNA, 654 bp, Homo sapiens
agtggaggtaaatgcgtgaagtcggcgttttccctccttccgtttcccggagccgcctgcgtgaatgttcttcccggctctgctgccccctggaggctagtggaggtaaatgcgtgaagtcggcgttttccctccttccgtttcccggagccgcctgcgtgaatgttcttcccggctctgctgccccctggaggctagtggaggaggaggaggaagagaggaagaaaggagaagtgaagacggagactctctttgggcaaagcggggctttcagcacgttcggtggtacagctctgaccctggccaatcatggcactgacctatgccaccatatgggggtggatcgaggtgggtggtggcatctgggatctctgcttggcttcccggttgaaaggaatatcctctgcagctccaccggggagcagggcggacaagggtctgtctcctcgaatcagcaaaagcattgagttgtaataaagcatgtaggctgaaatatcatcactgaaatctcagcacattcctttcgccccaaagccaaacaccacttagttggatgatatttggataatatgttgcaatgactctcagttgtgtacactttagtaagaattaatgcaaccagcttgctttccatttcacagattaggttgatgc

SEQ ID NO: 478714 - DNA, 569 bp, Homo sapiens
gtgttcgcttcaaggtgccggcgtgctgctctaacctctagctcgtatgcccacttcacaaaaccagctttattctttacctttctgttggagcagggaagatctccagcttgtccctaaagcaggcggtgctcctgtctgcccaggccctcttcctgcttacgttatccttcctgctgtcctcgcctcgcaccacatccagtctctgcccatccctcagggtcatagtctcttgggggaggccttgccaccggctgtccacagtgagggtgctgctgatcccagtagaacatggcagcagagggcagaaacccacaatgatgatgaaattagaaaggaagacaagaacaacaaggttgtggaattcagaagccatagagacaagagaaaattattctctggggtatctgaccacttccagaggaaagacataaagatgctgatgtcaagaatgacccaactaaacggcccagccacatgacccagttgaagctggtggacaagaagtttcattcatggaatcagaacttccaataaggtcttttagtacctcactcctaaatttgaat

SEQ ID NO: 478715 - DNA, 1230 bp, Homo sapiens
gtgggcactgtccgcaccgggatggggctcccctccgcggcgcctcccggccggtcctgctgcggctccggggccggagggaatccgcagccggccgggggcctccgccagcctggctgcgcgccgggactccgcctcgcgcccggccccctctccagcagggattgcttctgcctcgctgccaggttttctcccgcccaccttctccgctgccagaccgcccgagctgccctcagtttctccccaagtgggactcactgtcggggtgtcccacaagcccgatcccagagcctgctggcccgaccccggcgacgcctccacccgcgctcgccgccctccggggcgcaccctccgccagaaaacagccggcgggcggcgagacttcgtgcagagtgcgggctcctctccggcgccaggcccaacaaggacggggagggatttgcgagggggctgaaaccttttgccatcagcgaacagcctcagccaaaaacaaccctggaaaggcgagctaagaatggttatctcctgccagcgctgaaatcggaggccgggcgctgcggaatcaccactgtcagacttcaatccaacaggacccactcgagccatccacacttgccccagcctcctccaaaacagcacactttccggctgaagaaaagaagaatggtattcacgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtcagttgaaacctgctgggactttttagccattctcttcaacataaagaatgggtgtttttggagggggtgagaggaatggggaaatgttgtcaaagagtacaacgttttagttgagacaggaagaatatattttgttgagatctacagcacagcatggtgactgtagttaacaatgaagtattgtctatttccaaattgctaagacaataaatttcaaatgttctcaccacaaaaaagataggttttgaggtgatgaatctattaattctctggatttaattattccacaatgtatacatatatcataatatcacattatacctccgtaaatacatacaattttaatttgtcaattaacatttttttaatagaatagtgtggccagtcggggaggtagtgttg

SEQ ID NO: 478716 - DNA, 767 bp, Homo sapiens
tactacttctaagagggggtccactttgcccccttttccgcgtgggagttgaaggaaatgccccttaatggcagtagcatccacttgggtgtgtgcaccttctggaggactgggtgaggttgcccttcttccagccaaagccagaccctatggtgtgggacgttcagcggggagcaacagaatgccatggcttggtcctccctgggctgtgattggacgactgattattggacagaatggcgtcttgtcgacacctgcggtctcctgcattatcaggaagatcaaggcagctggtggaatcattctaacagccagccactgccctggaggaccagggggagagtttggagtgaagtttaatgttgccaatggaggacaaggcggcatgcacaggagcagaggagccacatgtgatgtgtgtggccgccgttccctgccgccccattcacataatcttctccatgcccctggggagccatgctgtgggatgtgcaggaaactcagcatgctggcagacttcttggaggaagtgaaatttgaactgcgatgtgaagaatgagcaggagttagtgaggtgaagatgagagaaggagtgttgcaaacacaggtcagtctgtgcaaaggccctgagacacaaggagcctagaaccacggctcgaagacaaccgtctggctggggcatggctcgtcttacagatcacattaaggaacaaataattatgttaagagttatgggctgccattaaggatttggataagagagtctt

SEQ ID NO: 478717 - DNA, 858 bp, Homo sapiens
gaggcaccccccgcgatatggggagtaagagccacctcctctccccccccgagttattacgatccacggtggactcacagcctgtttactatattgggggtaatatctccccctctggaaattatgtgctgtttgacagatgggtgtacaccctcggtgtgcaggttgtacacccgtctgtattgagagtaatatcatcctcttccaccctgaatattaagaaccgtatcacaggagcaatatcaccgggtggctgtacattaattgctatgttgggagtcatgtcatgctctatcccctggatattaggatcagtgtcacagggtgagtgtacacctactgagatattaaaactaatatcatgctctccatccctggatattaggaacaatatcacaggtaggtgtacaccccctacggtattaggagaaataatatgattaattattaagcatcagtcttaataatattactaattattaaacatcagtcttaataattatcaatggtaatattaattaatagtataacgttattaatcattaatgattattttaaatatgattatgcatggttaaaattaattattagtattgtcatttttcaatattcgttattaaccttaatattaattattgttttattaccaacatcacttattgatttaattaagtaacattaattaccgatatcattatgttattattaatagtgaggttgctgttaattattaatagtaaacattaatatttttaatccgtattaacttttactatctttatagtaattatttatatcgatgatttctattaattgttattatatttatgaatattaatacttaatacaattgttccc

SEQ ID NO: 478718 - DNA, 467 bp, Homo sapiens
tatcctggagtctcagtgtcaggatgactgcagtgaggtccatgctgttgggggtgacagagcagccctggaggccctctgctcttaccctggcaggaggtggccaaaaagaagcaggcagaggaagcttctccaacaagcttggaaagaaatttccgcatatcactcacgtcactcttgccactagaaggacaatttctacaacggagtggaagaaaatgactatgctgtgggagagaatggatgcatccagaagagcaagatatcctgatgctaatcagagccacacaagaatgcaagcatttgcttcactgcctaccttcagtctcacgggagttctctggagttcttgtatcagcatgtggacctctttagcaagattgaggacagtttcctgaattatatcctcaaaaacgttttccaagttgctcactttctattcttctctgttagaaatgccaggtatg

SEQ ID NO: 478719 - DNA, 2007 bp, Homo sapiens
gcagcaagccaccatgacgccgtcaatcacagacttctacgcatgcaagggctcaaacacaaatgggcttcccggggtcatcctgctcctctcataactcgtcaggctctgagccctgcaccatcaggggaggactgcatggtgctgatggtgctgctagaagctctaataatggcagcagtgaagatacagacaacgagttccagtattttagcagaaatggtagactggccatgatgctacgcgcaaaggttttcagagtttgctccatcaaatcccaaggttttgcagaggagttatctatgacagaattgggaaagggtttgggagggacaataagtgagaagaggggcaaggagaagctggccttacaacgatgttatgaggaaagtgtcatcatcatcatcaccatcatcatcatcatcatcatcatggacatggatgaagctggaaaccatcattctcagcaaactaacacaggaacaggaaaccaaacactgcatgttctcactcataagtaggagttgaacagtaagaacacatggacacagggaggggaacatcacacaccacgggctgttgaggggtgggggctaggggagggatagcattaggagaaatacctagtgtggatgacaggttgatgggtgcagcaaaccaccatggcacgtgtatacctatgtaacaaacctgtacgttctgcacatatatcccagaatttaaagtataataataaaaaaagaagaatgtcagatggctttaggaggataatagaggagattgatgcaattattgttaaataataataataattagtgatcagataataatcactgataatgaagcccaatatactaaaatcccaagcttttgctattgaacaaaaatggtgtttgtactcctcacttaaaaaaaagtgttgcaataaaatcattgtcttcttttccttttcctgcaattgctgaatgagttcagttggtagtaatgtctttgtctatttttaaactgtgtgagaatgtgctttggagacatgagcttttttttcttcttcaaatattcttgtaataatctacattgatgtactaatactctgtttgtctgattttctgacattataaaaatggtactataaccagcaatgtgccatagcaatgagagatatgccatatcccttaaggtttttctaattagctacttaatgagaaaatttggtaattgtattgagttaaaggactaggtgtatttatttggacaacattcgattttgagcgaagacttttttaagagaataaaaatgcaactgtagcattgtataactaatgtgcacagctcactgttttttaagataacaatttaaatctattaacaaagatctgatttcagagtttcataatattgaggatttatttagcttgtaaaacctgtagcaacctattcatatgttctgagatagaaaatacatcaaggaaatttttgtcacttatcccgtaaagaagaattaattagtcagtttgttaatctgtaagaatgtatgaatttccatgtttcatgtttccaattccagattagagtaagtaggactagaataattttagtaaatattcttttgaaatgcggagttttcaatgtggctctccaatgttaataagcttgttgtggctgtcaatatctgaaatggtccataatttatatttgaaaagctgccatcaggcaaagttttctgaagtctctttctttcatataacaatattgcttgagtatctgtatgatttcctcctgtagcaagtttgtgcaaatcctgtcaggggagaaagcacaagctatatccttgcttttcagagagaaaactagttttacggagaaatatcttgcccagagtactcaatcaagtgacagagctaaaaggagagtctgtttatatgattaagtgatacaagtcatgctttatttcttcctatcactaattcttattccagtcagtcagctcatctatgcagtcagtgtaac

SEQ ID NO: 478720 - DNA, 752 bp, Homo sapiens
tggaatacgacccttgtggagcgcctataaacgacgcacgggggggcgcttggatgaagcccacttgatcatggttggaccctcagctgcaggtctgttggagtttgctggaggtccattccagaccctgtttgcctgggtatcagcagtggaggctgcagaacagcgaatattgctgaacagaaaatgttgctgcctgattgttcctctggaagcttcatctcagaggagtacccagccgttaaactccattgttacagacaagagtaattcaaattgctgttcccccattatttaccgaccatctcctgctccacatttatggaaaattgttcctgaggacattcactccctggtgcttctagcctgccttgactatgggctgagcctatttctgaaccagaagcttccatgcaaagaggcacagaaacatatgctaaaatgtcattggcacgaatgggaagcatccaccaagctgcaagtaattgctgggcatagtgtggaggactgatggcatgtgatacacaaagtgaaggagataaatactcaatagttactgtcatacccacgttctgtaactcgttaagattacagactttttcaaaaaataacagatgctggggaggttgtggagaaaaaagaatgcttatatactgttggtgggagtataaattagttcagccattgtggaagacactgtggtgattccccaaagacctaaaaccagaaatatgatttgacccaggaatccc

SEQ ID NO: 478721 - DNA, 1661 bp, Homo sapiens
gtgttcatccagaagcagcatgtttcatttaaaattgcacaggtaccccccatctcagcccacatttttcaaatggatgattatctgtgtgtattcagatgtacatagttttactgaaggagcccgtgggaatctctatgtgtgcacactcaaggtgataactcactggctggcactcagctgctcagtactatgcctgggtatcagacataaagaagcttccagattcagccaaactgtgccagaatcagaataccgccaaaccccacaatctgctattgaacccacgctcctggtccagactctccctttcctcatggtgaatttctcagtggagaattcactggcttttcctgtcaaaggaatctgcccaccttcgtgcagcaaatcattatggaatcctcctgtgatcttaaagtgtgcctccaaaatactgactactgatacatagggctaccattacagaccatatcgaaaagccaattttttttggatcaagatttgtgaagaatctgagattttatcctatttgcaagctaagataaaatgatatttgtagtataagatattccatagtatacctctcttaataattcaattgcgacaagcctcacaccttgaaaaattatgcccccaccaacctggttatagagaagtaggtgcttcagtcattcaagatatcctgaaaactacagagaaacaacactgaatgaggataaataccagcctcagggcttttcacttatttgaggggaccagatatccattagataaaaataatttaagtaggcttgagacagaaatacaaccagtcattcaacaaatacttattgagagtcagttatgtgccaagtacttctttatgtgctgaagatacagcactgaagaaatagaagttcttacaattacaaagctgacattttcaggaagggacacagacaataagcaaataaacatatagtgggttacgtgcgataagtgtggaaaagacaaaccagaataagaaacagagaatagctgggaattaagtcaatgtactacatataggtaattttggagggggtagcctcataataagatgacatctgagtagaaaactacaatggggatggggaggagccgtgtgcatctgtgctaagggtggtccagacagagggagcagaactacaaggcccttgaagcaagatgtgttcaaaggatggaggagaaggcaggagacaggatcagattgctagaggcctggtcaggtgagacactagggaccataatgaggactttagctatgttttgagggagatgagaagctttggagaacttgtagcaggggcttgacatggtctgggaatgatatcatttttatatactttttaaagcaaagacactaaggctcacaaatattaagaaaattgcctaggtgacaaaaataaaatacaaggccccttctctttctatgtcctccagacttccccttcacctttcattgcattggctgctgccctaggtgctctagtacaatgtacaatgttgtatagaagagagtgagcatccttgcctctttcatgaactcgagagtatttactttccctcgtgttagctacttaactaggggaaactgtttatactgtctgttactcagtttaagaaatatttattcagtgttt

SEQ ID NO: 478722 - DNA, 503 bp, Homo sapiens
tgctggcacctggagctgcctgtccggcagcagcagttggcatgcctggctatgcgcagagaccagaccccatgcttgctcacacaccccttgccactccgcacctggcttgcccttggcatcctgggatccaggctggtagtacaccagaagccagtcctaataatccactggatgtcactttaaagcttggtcatcatgatggcctgcagtcaatgaggtggagatttcagaacttctgctgcattgaggaaggagtcagaaggctcagggacatggaaattctagatggattgactatggaatacctaagaacattcaacctgactattttctcggagcacaggaaactttccttttacaagcatctggaagaaccctacaccatgggtaacctggcccatgaagaaagggcttttatggtagaaaagtacaagcagaggacccatccctgaaatttcatcatctccaggagataattctcatcaccttgattaatgggg

SEQ ID NO: 478723 - DNA, 531 bp, Homo sapiens
cccgagcgcccacggcagcaccatgcccgcagagcataagcgacaggagaaagaagaggtggacaagatgacggaacagaagatgaaggaagaacaggagagaaggaagaaaaaggagatggaggagagaatgtcactagaggagaccaaggaacaaattctgaagttgcaggagaagcttttggccctacaggaagagaagcaccagcttttcctgcagctcaaggaagttttacatgaggaagaaaaacggaggcgaaaggaacagagtgacctgaccaccctgacatcagctgcataccagcagagcctgactgttcacacaggtacattactcctcagcacgcaggggagccctggaggacacaatcgcccaggcaccctcatggcagctgacagagccaaacaaatgtttggacccaaattgcttacgatccggcactacgttggcccagcaactgcttttgcggagacaccagagcatggacaattccaaggcagtcctggtggtgcctatgggactgcttagcc

SEQ ID NO: 478724 - DNA, 746 bp, Homo sapiens
tggcatactgcctcctgcatcctgactggtcctgtttcagccatggctcaaagtgctccagctacagctggggctaccactcctgagagcacaagctatttcagatgtatcaaagtctgggtgcctaggcagaagcctgctacagtggtggaaccctgcaaagagcctctactggggcagtgccaaggggaaaggtggggttggagccctcacacagagtccccaccagggtattgcctagtggagctgtggaaacaagtctctcactctccagacaccaggatggtagagccactggcagcttgcaccctcagcatggaaaggcttcaggaacaccgatccttctcagatcgaggatctggcaagagctatcaaaatactcagtttcagcagctcttatttagaccccatcctgtattcctaattaggcttcagatctttgctctgtttttggcttgccagagagaaaagtggccaagccttctcacctgtcactggctgtacctttcgccatacgtggctgtggcaaatttgcccccgaagaagattaaatagtattactagtagttaggatcctttctttgtccttgacctttggaagtttgattattaaatgacttaaggtaatcttttttgggttaaatctgcttagtgttctataaccttcctgtacttgaatattgatatctttctctagttttgggaagttttttgttattatctctgaatgaactttttacccatat

SEQ ID NO: 478725 - DNA, 660 bp, Homo sapiens
tcattgaagtgcaacagggctacaatgatacagtgtgaacatacagagccctggccctattcacaagctgtgcctcacaccccatcacctttttcccatacccggatctccagatctcatcctgacctcctggacctagggctcattgccttagcctctgaaaattctcatactttcccactggatctggcaaatggtgatgctctttcactcctcattcttgactttccccttttggctgcaattggctcttcttatgttctcctcttcttcccactctgtaaaacagctccacccgggagctctgcctttggttttaagaatgaccttgattacaaatgcctgctcaggcaggcccagcctcccagacagaaaacctgccgtggccttggcggcatcttcagtggtacctcgagcagtgccggagaagctaggaatctgcttcagctcttgtttcttgattaggccccggagccaaggcttccaagaggagcctcacttgtcagctgtcagtcaggaggcagcctgttcctcccaggcactgcccctgccacaggggggtgaccagactgtaaaaatgaaatagacttcagtaggatgcctgaaattcattttctccctcggatgctttcatctcactcatttcactgtgtttacagg

SEQ ID NO: 478726 - DNA, 612 bp, Homo sapiens
ctccaacagacctgcagctgagggtcctgactgttagaaggaaaactaacaaacagaaaagacatccacaccaaaaccccacatgtacatcaccatcaccaaagaccaaaggaacatagcctcttgccagcaacaaagctggacagggaatgactttgatgagttgagacaagaaggcttcagacgatcagtaataacaaacttctccgagctaaaggaggatgttcaaacccatcacaaagaagctaaaaaccttgaaaaaagattacacgaatggataactagaataaacaatctagagaagtccttaaatgacctgattgagctgaaaaccatggcacgaggactacatgatgcatgcacaagcttgagtagccgatttgatcaagtggaagaaagggtatcagtgattgcagatcaaatgaatgaaatgaaaaaaaagagtaaaaagaaacgaacaaagcctccaagaaatatggggctgtgtgaaaataccaaatctgcatctgatcggtgtacctgaaagtgacggggagaatggagccaagttggaaaacactctgcaggatactatccaggagaacttccccaacctagtgaggcaggccaaca

SEQ ID NO: 478727 - DNA, 1943 bp, Homo sapiens
ccccagccgtgcttccctgctgcagccagcatgatggcagcagccactgccatcattcccccctctgaagagggtccccagtacaaaggagccaatgtccgagtctccatttttatgaccatttggagtattgggagatccacagctgagacgctaggaccccctggaagcctagaaatgggagtgttgacatttagggatgtggccatagaattctctctggaggagtggcattgtctggacactgcacagcagaatttatataggaatgtgatgttagagaactacagaaacctggtcttcctgggtattgctgcctctaagccagacctgatcacctgtctggagcaaggaaaagaaccttggaatgtgaagagacatgagatggtagctgaacccccagttgtatgttcttattttgcccaagacctttggccaaaccagggcataaaaaattgtttccaaaaagtgatactgagaagatataaaaaatgtggacatgaaaatttacagttaggaaaataccgtaaaagcatggatgagtgtaaggtgcatgaagaatgttgcaatggatttaaccagtgttcgagaactacccagagcaaaatattacaatgtgacaaatatgtgaaagtctttcataaattttcaaattcaaacagatataagataagacatactggaaagaaacctttcaaatgtaaagaatgcgaaaagtcatttttcatgctttcacactcagctcaacataaaagaattcatagtggagagaaaccctacaaatgtaaagaatgtgggaaagcctataatgaggcctcaaacctttctacacataaaagaattcatactggaaagaaaccctacaaatgcgaagattgtggaaaagcctttaactggctttcacatcttactacacaaaaaataattcataccggaaagaaaccctacaaatgtgaggactgtggcaaagcttttaaccaatctgcaaaccttactacacataagagaattcatactggagagaaaccctacaaatgtgaagaatgtggcaaagcttttagccagtcctcaaccctcactacacataagataattcatgctggagagaaaccctacaaatgtgaagaatgtggcaaatcttttaaccaatcctcaataattcatactggagagaaattctacaaatgtgaagaacgtggcaaagcctttagccagttctcacaccttactacacgtaagagaattcattctggagagaaaccctacaaatgtgaagaatgtggcaaagcttttaaacaatcctcaacccttactacacataagagaattcattctggagagaaattctacaaatgtgaagtatgtagcaaagcctttagccggttctcacaccttactacacataagagaattcatactggagagaagccctacaaatgtgaagaatgtggcaaagcttttaacctatcctcacaccttactacacataagataattcatactggagagaaaccctacaaatgtgaagaatgtggcaaagcttttaaccagtcctcaactctttctaaacacaaggttattcatactggagagaaaccctacaaatgtggagaatgtggcaaagcctttaaccagtcctcacaccttactacacataagataattcatactggtgagaaaccctacaagtgcgaagaatgtggcaaagcctttaacaactcctctattcttaacagacataagatgattcatacgggagagaaactctacaaacttgaaagttgtaacaatgcttgtgacaacatctcaaacatttccaaacataaaagaaattgtgctggtgagaaaacatagaaatatgaataatgtgacaaagcctttaaatggttatcacacttgcttgtaggtaaggaaaacagaggtttttcccaaaaacaggtcag

SEQ ID NO: 478728 - DNA, 630 bp, Homo sapiens
gacttaggagagttagagtcccttctaagatttaaggggttagaggcccctctcgcttggccccagggcaatggtgtcgcaagctaaatcactaaggccgctcagggaaagggaatccagaagcctggcgtgccggcaaaagggaaagaaagtggtcactgccgctttatgtagctcagtggtcaagattttgcactttcacatgtggcgatccgggttcgattccccacctaggaagcccccaactgaaaaacgttggaagatcagggatccctggaggaaagaagtcccagacttcagcaatcgtcctatcagtttgggctataaggtgcccaagccagtaccaagcaccaataggcaagctgctacaggccgggtcaccttcactcaggatccctctgtggctaccagatgtcaatcgagaataatgcaagggccagcaaaaatggtcaacagtcaagaggaatcaagctccttctcaatcctagaattcacaaaaggatctatgatgacactggacttcccatttaatgtgaggtaaaacattacatgcaattttatttaatctcaaaaagaaaggagcttcctgtatgcctcaagtatttcataaagaagttctaaaaatcttgt

SEQ ID NO: 478729 - DNA, 2830 bp, Homo sapiens
aggtgacttaatacaagctgtcctacagcaagtgggattaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaagaccaacattgttgctccagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgagttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggtgatctaaactttcagttttcctcttacctcctggaagtggtagtggtggaagtgggttccctttaatgtgtcccagcccaccaggagacttaagagaaagggactgtggacacaagaagaaatagaggaggatttggggttttggtgactgtgaggctgggaagacacttcttgactttgggagtggtccccaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtatgtatacttgcatgacgtcggctatgcatagatgtgcaaggacagagaggcccatgggaaatacttgggcacacaaagaccatgactctgctgttgtgggttgcacaggagtagggggcagatgatggacactgggatgggaatggttgtgaatgatctgcccccgcttccatatgtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctcgtctgcctactacatatacttgcgtgggaaggcttgtgacc

SEQ ID NO: 478730 - DNA, 709 bp, Homo sapiens
tcttgagagctctgccctcataaattaattgacattatctctggaatggccctacctgtgatgatgaattcagatctaacactctatcaccagactgagatcctggaagggcctgtttgctctcgcctggtagagtttccagggcaggagatgctcccagcttggcagggtgttcatgagtccttgaacacccaaggactcatgaacacccaaatccaagttcatgagtccaagaacacccaagtcatgtccaaggaagacataatttatccctctcaactgaatctttcccgtcaacatccggcgtgctatgtatctcatatttttcaaaaaccctctctgaatcccatgttctctttctgctatttcctcatttttctgcacctctctggaacaaacctccttgaatacgtgattatacttgctatcaccaattgctctccttctgttgtatcttgaatccactcccatcacaccttcatcactcatctaaatctgtttttcttaatgtcacagaggatctctatgtttttaaattgaatgccattcatcttgcttgactagttggcaactggttatgcagtttatcattttctctttgaaatactttcctctctttgctttcagtacaccacactcttctgtttttcttcctacctcactggctactgcttctttgttcctctatttactggctcctccttttatt

SEQ ID NO: 478731 - DNA, 852 bp, Homo sapiens
agatacggagtgccgattggtgtattaacaatccctgagctagacataaaggttctccatgtccccaccagactcaggagcccggctgtcttcacccagtggattccgcaccggggctgcgggtggagctgtctgccagtccccggccgtgcgcccgcactcctcagcccttgggcaagaaatcgagcgcagcgccggtgggcgggcactgctgggggacccagtacaccctccacagccgctggcctgggtgctaagcccctcattgcccggggccggcagggccagccggctgctccgagtgcagggcccgccaagcccacgcccacctggaactccagctggcccgcaagcacctcgcgcagccccggttcccgctggcgcctctccctccacacctccctgcaagctgagggagctgtctccagccttggtcagcccagaaaggggttcccacagtgcagtggtgggctgaagggctcctcaattatttagaatagtgaagcagtggaaacaacctaagcatgaggctcattaaataaattattatatatccttacaatggaatattatgctaccattaaaaaggatgaggtagatacatatggtctcgtatatataaatgctgtataaaggcttttcctttataaaaaatcatgtcttttagaaacattttaatcctaacctacctgatatgtggtgttacaatttgacaaagtagtaaactctataaagcacctttaggtgaggaccagttttctactgaaaggggacacaatttaatacagaatgagaaaatttggacttgaagcacagaaagggttaacccctctagagcgtcttcttccattt

SEQ ID NO: 478732 - DNA, 1496 bp, Homo sapiens
ccaccgcatccaaaaacacgaagcatgagggacagaagagggccccttggcacctgcctggctcaagtacagtgggccggaggaggtgactcggacaaactatcatacagccttaagaaaagaatgccgacggagggcccttggcctgcagatgcaccctcctggatgaataagcctgcggttgatggaaattcacagagtgaggcattatcactggaaatggctggcctctcgcttcccagtggcggcccagttcttccatatgtgaaagaatcagcaagaagaaatccagcctcagcagctactccgagcgcagccgtgggtttgttccctgctccaacagagtattttgctcgggtgtcctgcagtggtgttgaagctctggggcgggactggctgggaggagggcccagggccacccacggccacagaggacagtgccccaaaggagagcctcgggtgtcacgactgacacgccatcaaaaactgccggaaatgggaagtttttgggatgacccaccaagtgcttttcccagtggtctgggctctgagttggaaccctcttgcctgcattccatcctgtctgcaacactgcacgcgtgccccgaagtgctcctgaaagatgagacgaaacgcattttccttgaccttttaaaccccatgttttcaaagcaaacaatagaattcaagaaaatgtttaaaagcacctcagatggtctgcagataacactggggttactggcgctgcaacattttgaattagcaaattcattatgccatagtttaaagtacaagcagaacaatgcaagtagattaattttaagagttgtcttagaatgatttctttcgcattaagtctggatgcaaactatgcagcccttaggttcctggtgtggtttgtacgacctggcagacttagttgagtttgaattcaaagccggttgatgcggaaggaaattttttagcatgtgttaaattgtgctttaaaagacatataaaaaattgggaaacatttcaggagacgatcatagcctgtataaatatcagattagaacatacggatttaccatgaagttctgtcttcaacacccaacactgtctaaagggctactgtcccaaatcctgtgtgtcccttcggcttgtctgatcacccaatggaagtggatacttgtgaagtctacactgctgtacttggcgttaaatcttgctgaattcatggtgactcctttggttgtctgttgataactttgataaaggtcatttaagggcataaggttttaaagactcccaaagtgagacttaaccattttcgggattagtgattgcatataccagtttatgttgtgtgctgaattactatgccatgtgctattttagtgtttggggaaaatgaaaaataaaatttgttctttagcgtaataaatatgtcttattaaaaatacaatgaactgaatgacaatgaaaatgcaacacatcaacatttgtgggcatgtata

SEQ ID NO: 478733 - DNA, 898 bp, Homo sapiens
cgcggagcatttcgggctcgcccagatcagtgcgccactggccgatgaaggtggccgcactgtcgcgggccacgaagaagcgcagcgccagccaccctgtgggcctggaaggtcacacttcgggatatgcagacagcctcatgggttcccatagacgggccagccgagccactgtgggcgggggtacaaaccaggatcgctgtgaggatccggcaggcgctcagagcagactaagccgcagagcactgcaccggcctgtcactcaggccgaatggctggtttacctgctggctctgagaaacctcagtgcctcagtttcctcatctgagaaatggggcagtgccatcaaaaaacgacatagcagcagtaatggtatcagtaacagcaatgaagtggttagggctgagtgcgtggtgatattatctccattttacaggctgcgccgcgcggcctatctcggcgatccagcagccaagccgcgaaagccagacccccctcagcaagcagcgccccagaaccgcaggccgtcgtttgtggggccagaactgatggcccaggcccagagggggtgcagggccgctcaaggagccaggcccagcccgcagcagggaggcgcctgcaagccacagctggatctgtcgggccgctgcggcctcctaacggcgggccgggatgataacgatattgagggcttgacatcagggagtcctgtcatcagggctgactccatactgaactgctggggaactctgaggcccacaaaggaactgtgagaaacactttcttcaccagcagctgtgctcttaacagtatacaacacattatacaaggcctccaacgggccactgtaactccaaactctggttagtgaaattgtgtcatttagataaaacgaaca

SEQ ID NO: 478734 - DNA, 1018 bp, Homo sapiens
gaagcgcttctaattctgtgcggatgaagtacagggagatgcttgctgcagctcttcgaacaggagatgactgcattgaaatgggagctgatgaggaagaattaggatctcgaattgaggaagctgtagatccagaaagagggaatacaggcatgaagtacaaaaatagagtccaaagtaagatatcaaatcttacagatgcaaagaatccaaatttaaggaaaaatgcatcgtgtgggaatattcctcctgacttacttgctagaatgtccgcagaagaaatggctagcgatgagctcaaagagatgcacaaaaacttgacgaaagaagccatcagagagcatcagatggccaagacaggtggaacccagcctgattcgctcacatgtggcaaatgtaaaaagaattgcacttccacacagaagaacacttgtagattagaaggcttttcataaatcccctcacaggcgaagaggaaaacttcccgctattttatttccctcataggaagacatactggaaagaaaacgcttagcatcttagtatagaatagctattgtgaacagttcatgacttgatcttgatatggaaatctgtactgaccagtgattaagcttaaggattgtaaaaatcattaaagctgtggtcttttcgtgtggaggttgatagaaaatatttttgtcctaagtcttatttgctgactttttctgtcaatgaaggaggttgttgaacaaactgaatctgtgggctatagcaagtagctttacagcagatcttaccatgaagttttactttgtgcttatttaagtgggtaccactttttctgtttagaataattaaaaaatgattttcacaggttccttggggtaggaaaagaaggggcccaagcattcccaaaggtgaatttcaggtggacctaaaatgctaaaagtttgtgctgttctcttctacaaaaagttaaattaggtactagggctggggcaaagcattagataaactggaaaaaagaaaaacttct

SEQ ID NO: 478735 - DNA, 1116 bp, Homo sapiens
tggctttgggtgcagtaagaacctcctcctggctggtgcctgggctgtgatgggataagtgggggccattgagagccaagtctggagccatagatcatgccaagatcatgaaaggcctgaagtgccttgctaaggagtttggatcttgtacctgtgttcagcagttcttgagctcttgtctcacatccaagaagaatgaggacatgctgacagtagaaggcaagaaagggagaaggcagtcatctgaaaacgaggaagacagccctcaccagaaactgacactgttggacctgaatgtctccattcaggttccacataaccatctggatggtctgtgtgaccaacagcatatggtagatgtagcggtggtgtgcccggaattggtgggttctttgctcactgacttcaagaatgaagccgtggaccctcacgagagccgattggtccattttacagaaagctgcttggtccgttttgacagggtgctgattggtgcctttacaatctctgagctagacacaaaagttctccacctccccactagattagctagatacagagtgtccacacgaaggttctccaagtccccaccagagagcccagttggcttcacccagtggatcccactcatactggtgccgcaggtggagctgcctgccagtcccagccgtgcgcccgcactcctcagcccttgggtggtcgatgggactgggcgctgtggagcagggggcgttgctcgtcagggaggctccggctgcgcaggagcccatggaggggtggaggaggctcacgcatggtgggctgcaggtccacagccctgccccgaggggaggcagctaaggccaggcgagaagtcgagcgcagctgctggcccaggtgctaagcccctcactgcccggggcttgcgggccacggggcctccgagtgcggggcccgccgagcccacgcccacccggaactcccgctggcccgcaagcgcgcagcacgcagccccggttctcacccgcgcctcttcctccacacctccctgcaagctgagggagccggctctggccttggccagcccagaagggggctcccacggtgcagcggcgggctgaagggctcctcaagggc

SEQ ID NO: 478736 - DNA, 686 bp, Homo sapiens
aaaggtggggaaaagattgagaaatcggatgccaaaatatggaatcaacctaagtgtccatcaatggataaagaagatgtggtatatatacacaatagaatactatttagcctttaaaaagaaagaaatcctatcatttgtgatgacatggatggacctggtgggctttgtgttaagtgaaataagccaggcacagaaagacaaataccacgtgatctcacttacatggggcaatctgcaacaagttgaactcatagacgcagagagcagaataatggttacaagtgtccagggatacgggtgggggaatgcggagatgttgatgaaaacacagaacatttcagttaggatgaataagttcaggaggtctattctacagcagtgtgactatatttactaatagtgtattatatacttgaaaattgctaagacagtagtacaaaataatctgaatatgaagtgataatttcagtctgatatgtttaggattaaaaaaaatcctgtttggtacttgtgcttatagaatctgaaaattcttacttttcatcaatttgggaatatccttagtcattagagatttcatgcctctcatcaattatcaaatattctcagccattctcccttctaatggtgcctctcccaattcctttcagctctaaccataccaaaacctattaaatgtatat

SEQ ID NO: 478737 - DNA, 1032 bp, Homo sapiens
ctgtcccatctgggttctaatcccagcattactggaggttccaatttggcgtggccagatcctgactgtgtgactttgggctggtcaccttattgccctaatgttttactacaaatgcatttaaggagatgtcaaggggattttcaaaaggaattaatgcacttcagtatggcttctcctggctgcctgcagcaggtacccctaccctgtgctctcgcaggttcctatgctgaccctgttatgacattcatcacactgcattacaagggttacatcaacagtgtaatagctcattgttacagcaataacaatggcttttggaaaaaggaggagaacactccagacaacaggaacagtaggaaaaaaggcctggtggttccagggggcatagaatgtttggagaacatcatatctggaaataagcagctgaaacagcagagaggcagaggccaggacactgaaggccttgtatgctacgctttggggatgggaaaccatggaagggtttcaaatggagcagttagatcagacctgaatttcatgaaggactctggtttgggtcactggaagccaatatgaaaatgactagaaagaaattcactaaatgttaacagtagttttccctgggtagaggaattatgggtgattgatattctgttcttttgtacttgatattctgtaaattttttctaacaggacattttacttcagtaataagaaaaataaccagaatttacgtacacccccaccccaccaccttcagtggccactcattacctgcaggctaaaatggaaatcccttggcatagctttcaagggttttcctgctccctgaatctaccctccatttgtgccattgggccctccctgtgctccgcctccccttcccatgcctggccattcatccctcaagactcaactctgaaatgccctcccccaaagaaatgtctcctccttgcccacttccaatgtggctcttagtaccctgtgttttaatgcctatgtccagccacgtctgtcccccccaaccag

SEQ ID NO: 478738 - DNA, 1095 bp, Homo sapiens
tctccagttttaagctcctttagatagacacgtccactgcctcacacttcagtctcctctggaagcaccctcacagacacacccagaaacaatgcttcaccagccatctgggtatccgtcaatccagtcaagttgacacctaaaattaatcataggttgcaatgacaaaataccatcgattgggtggcttaaacaacagacacttacttctcacagttctggatgctgggaagtccaagatcaaggtgctggctgattctattcctggagaaggccctcttcctggcttgcagatggctgcattcttgatcaactctatcaagtcccgagtctggttttatggcaaagacaatgatgcaggtctgacacctgtggaaggagaatgggaaggaaagattgtcaggaaggaagagtatcagataccatgcaactcgagaaaggtcttggccagggaaagttaccaaagacagaagaagaattgcaaagacactgctgagtggagaaggaagcccagcctgcgtgactctggctgtctttgtgtatctgctggccatgacagccccagaagtctgtagatggtcctcccaggtctgagttgcagctttttgcctgcaatgtcactgtcttcctcaccagcccagcctgctttgttgttgttctttgaacctttttaaaaattttattgatgcataatagatgtacatagtctggggatcacatagaatagaaacaaagaaaaaatgaaaataaaagtttacattgtaactccatcgcctccacattttgactgttagttgtttcaatttacatatttttatattacctgtctcttaacaggttgttgtagctattattgtttttgacagatttatattttgggtttcatactagagttataagtgcatttcataccacaattacaatattagagtattctgcatttgtgcatgtacttaattttaccagtgtgttttataccttcaaatattttaaattttgttttgtttttgcatattagtgtttttttctttcagattgaataactccctttagcatttctttctttcttttttttccttacagtagatattatcc

SEQ ID NO: 478739 - DNA, 698 bp, Homo sapiens
ccatctgccatggggcagaagaagggtatatttctgcacctgtgccaatccccctttgatcaaaggttgctgccctgtgagaggttaactcccttgtacttcaaagtttgcacatttgtcagaatgccgtatgtggccacagcagaaaagccccagaagccaaaaacaagagggttgaggagggaacaggggcgactgagtgagctgctctcagacaccaaagttatttgcaagacagaaagctctcaggtcttacaatggaaatctttccctcttattcctttccctaacaagtatgcgtggatgctgtggggagtgttacacatcacccccttcatgcagccatacccactccacactgatagggccatccacaccttctgtcagaggcttgtgaaccagagcaactccatcttaaataggagctggactgggtattatgaacggatattttggctcatggttctggaggctgggaagtccaagatcaaggggccacatctggagaaggcctttttgctgcgtcatcccatggcagaaggcaaagtgaagagccctcacggcctaagcacctcccattaggccccacctcccaatactgttgtgttggggattaaatttccaacacacgaattttgggggacacccttaaaccatagcacctactatgttctaggtcattctgttttacctgtgtt

SEQ ID NO: 478740 - DNA, 591 bp, Homo sapiens
gcagggcgatggctgggcactgtgctctctattcctttccccatgaagaacatgaatactcgccatgaggatgcgtgcctgctgtggggcagcttcctgatgatgaagaagaaggctgacctgtatgactaccagcacaggctgcctggtccttgggttttcaactgggttcccagtgggagctgtgagaggagacccaagggagagaagcaatggcttctccgaaaagacccaccccctgattacctggtgggtgttggccaagatagggcttccacctatgaacctttaggcaaggatgtaccgcccagtagacaacatcccaaatatgaaaccgtttccctcaatttccccgcacagggcagtgagacagtgttattcaaaatacttactgtccctcccccaacacacacaaaacaccgtgggaggactgtatgtccccaccctttgaactctggagtggccatgtgacttgctttggttagtaaaacgtagaaagaaatgacagcatcacttccaagcagagaattcagggccagcttgtggtcctctatgtctcttttctgccctttgtgaggacgctggaatggg

SEQ ID NO: 478741 - DNA, 570 bp, Homo sapiens
gcagtgccaaagtcaaccccgaccaagggccgtgggctagttggagagggagtcgctgtccaggcatcagacacaagagacaaatggccacaaaggactctctgctctgctcacacgtggccagactgggccattgtaggaagaacatgaatactcgccatgaggatgcgtgcctgctgtggggcagcttcctgatgatgaagaaggcaaggatgtaccgcccagtagacaacatcccaaatatgaaaccgtttccctcaatttccccgcacagggcagtgagggaaagcctggacctggcctctggccgtggcttcaccctgactccctgtgtaaccacagcttggtccctgtactcttggtttctctctgtgtgcaccgtggaaatctgccctccagccccaagattgctggactgctggaaggactggctcatccctgggaatgacgcctctgccttcactttctctcagcttgcaaagtgcacaactcaagcctcttctgcagctgggaggcagggaaggaaaggcccctgcagcggggcctcctgtccctctgagaattagagca

SEQ ID NO: 478742 - DNA, 634 bp, Homo sapiens
attcagcatgctcagttgtgtttcacactcagcaagacgagaatactcagagaatctaattgttcatgctgccagaagagatacccttgaccagtgtggttttatattcccaaaatcaagttgcccatttgctccccctattcaatcaataaatgaccaacatcttatggatgctacaagcccagaaggactgggcctgcaacagaccaccaattccaagacactctcagccccgatggcacatgaaaggggtccagaattcctgtccccattagaaggatacaggggtgaacaaatgggaatattagccacatcttcaggggtccattgtatcagcagtgtcaaagcaggcccaagccagttgggcgttgatgtttctggagcaactggatagtcatacgggggaagaaatgaaccttgacctttacttcacaccattcacaaaacttcatttgaaatcaatcatagacataaatgcttaagctagaactacggaaagtctagaagaaaacacaggagaaaatctttgtgacctcagaataggcaaaagtttcttaagatgcaaaaaagcatgaaccctaaaggaaataagtgccaaattggacttcaccaaagtttaaaacttatgctcttc

SEQ ID NO: 478743 - DNA, 1217 bp, Homo sapiens
tgttgagtttggacctcttaagtatttccttcagttgacagaggagatacactatggtaagtgccaatcagacagcctctgtgaccgagtttattctcctgggcctctctgcccacccaaagctggagaaaacgttctttgtgctcatcctgctgatgtacctggtgatcctactgggcaatggggtcctcatcctgatgactgtgtccaactcccacctgcacatgcccatgtacttcttcctggggaacctctccttcctggacatctgctatacaacatcctcagtccccctcatccttgacagcttcttgacccccaggaaaaccatctccttctcagcctgtgcagtgcagatgttcctctcctttgccatgggagccacagagtgtgttctcctgagcatgatggcgtttgatcgctacgtggccatctgcaacccccttaggctgcccttctgtggagacaacatcatcaaccacttcacctgtgagattctggctgtcctgaagttggcctgtgctgatatctctgtcaatgtgatcagtatgggagtgaccaatgtgatcttcctgggggtcccggttctgttcatctctttctcctatgtcttcatcattgccaccatcctgaggatcccctcagctgaggggaggaaaaaggccttctccacctgctctgcccacctcacagtcgtggtcatcttctatgggaccatcctcttcatgtatgggaagcccaagtctaaggacccgctgggggcagacaagcaagaccttgcagacaaactcatttcccttttctatggggtggtgacccccatgctcaaccccatcatctacagcctgaggaacaaggatgtaaaggctgctacctgaaacaactattttgtctaacgagctcttttttcgtttaatggggaatggtatttagaagtcataatctgggtgctaggtttactattgagtttcccatggtttctaaatgtttcagtggaaagagctatgaaaaaatatatataattgaattatatgtatgtatgatatataaatatatatttagatttagatcaaatatataaatcatacatacagacagacaattcaaattaagagctatggattttttacctaatctcattgattttatacctgtatctccttcttctatgtactgtctcctcattccagaaatgtttggagatggcttgaagttat

SEQ ID NO: 478744 - DNA, 958 bp, Homo sapiens
tgacagcttcctgacccccaggaaaaccatctccttctcagcctgtgcagtacagatgttcctctcccttgccatgggagccacagagtgtgttctcctgagcatgatggcgtttgatcgctacgtggccatctgcaaccccctttggtaccctgaagtcatgaacaaagctacttatgtgcccatggctgctggctcctgggtagctggaagcctcactgccatggtgcagacaccccttgcattgaggctgcccttctgtggagacaacatcatcaatcacttcacctgtgagattctggctgtcctgaagttggcctgtgctgatatctctgtcaatgtgatcagtatgggagtggccaatgtgatcttcctgggggtccctgttctgttcatctctttctcctatgtcttcatcattgccaccatcctgaggatcccctcagctgaggggaggaaaaaggccttctccacctgctctgcccacctcactgtcgtgatcgtcttctacgggaccatcctcttcatgtacgggaagcccaagtctaaggacccactgggagcagacaaacaggaccttgcagacaaactcatttcccttttctatggggtggtgacccccatgctcaaccccatcatctacagcctgaggaacaaggaagtgaaggctgctgtgaggaacctggtatttcagaaacgcttcctgcagtgatggtggaggggtcctgatggctctgtgcttcctgactgctcccacctgagagtcccagaggacaagatgaaagaccaagttgatcaaaggttacatggggtaattcctgctagatatgtacaaattattgatttttaaagttagtcgggataattcctctcttatagttatttggtttatatacttcatttgcttttgaattttgcttttttccatcttctaattataaaaatgcatggctctaaa

SEQ ID NO: 478745 - DNA, 2449 bp, Homo sapiens
agctttcactcttttcttcaaatcagaggtggccatctcaacctgagtctttcaagctagtgctgctatttcttgcccacacactgttcctacgccatggccacatcttctcagtaggttcctgacaaagttgacagaggagatacactatggtaagtgccaatcagacagcctctgtgaccgagtttattctcctgggcctctctgcccacccaaagctggagaaaacgttctttgtgctcatcctgctgatgtacctggtgatcctactgggcaatggggtcctcatcctgatgactgtgtccaactcccacctgcacatgcccatgtacttcttcctggggaacctctccttcctggacatctgctatacaacatcctcagtccccctcatccttgacagcttcttgacccccaggaaaaccatctccttctcagcctgtgcagtgcagatgttcctctcctttgccatgggagccacagagtgtgttctcctgagcatgatggcgtttgatcgctacgtggccatctgcaacccccttaggtaccctgtggtcatgagcaaggctgcctacatgcccataaggctgccggctcctgggctgcccttctgtggagacaacatcatcaaccacttcacctgtgagattctggctgtcctgaagttggcctgtgctgatatctctgtcaatgtgatcagtatgggagtgaccaatgtgatcttcctgggggtcccggttctgttcatctctttctcctatgtcttcatcattgccaccatcctgaggatcccctcagctgaggggaggaaaaaggccttctccacctgctctgcccacctcacagtcgtggtcatcttctatgggaccatcctcttcatgtatgggaagcccaagtctaaggacccgctgggggcagacaagcaagaccttgcagacaaactcatttcccttttctatggggtggtgacccccatgctcaaccccatcatctacagcctgaggaacaaggatgtaaaggctgctgtgagggacttgatatttcagaaatgctttgcctagtgatgtttgggggaacagatgtcctcatagctctttgcctcttggttgctttcacccacaaatctcagaagagcatgctccctaaagaagatacatgtgaagaatgactaccagaaaattgaaatactcatgtaatagagcactttagctgtgattggacccaattaaaatgttgaaacctagaacccagggggagtgtgtcttgaggggatggaagcagaatgctgctggatacacaaggaatgacttttctgtttctccactgttcaagtctgaattcacctttgtgagcagatggttcctctgtttcgggaaaaacaccctcgggtacctttctgttacaaaaatgtaaagccaagattctactcttgaaaggaggcactgaagacaccatgggacagaacttcatgaccctgcccacctccctagcacagtgcttcccaacctgtgtcttgccatggagcacgtagaaaaccatgggatgtgtaggcaccctgggggccttttccccctttttcttggcacttctccttgttgctgccatgtgaagaagagtatgtttgcttccccttctgccatgattgtaagtttcctgaagcctccccagccatgctgaactgtgagtcaattaaacctctttcctttataaatcacccagtctcaggctagattttttttttggaaggaatagtttctcaatatggaaaactataaagtttaccacagtctgattttgctgattgcaattctgtggtgtctgtctttgtgtttcccatacattgatgcctagatctagttacttaatttttttttttttactggagttatgagctcatggctcctgagaccttttgcatgacgctagtatctttgatgacttcctgctatctgatatgtcaagatattacaagctcaatattcactcttccttcccagacctgaaacaactattttgtctaacgagctcttttttcgtttaatggggaatggtatttagaagtcataatctgggtgctaggtttactattgagtttcccatggtttctaaatgtttcagtggaaagagctatgaaaaaatatatataattgaattatatgtatgtatgatatataaatatatatttagatttagatcaaatatataaatcatacatacagacagacaattcaaattaagagctatggattttttacctaatctcattgattttatacctgtatctccttcttctatgtactgtctcctcattccagaaatgtttggagatggcttgaagttatacacacataatgatgtcaggagttaacattgagcacaccttctgtaaagagcagaattcaatcaagtcatccagtggtgtgtgtctgggagtactggggctgaccat

SEQ ID NO: 478746 - DNA, 1655 bp, Homo sapiens
aactcatctggctgctgctttctgaccagattggctatttttggcttctggactactcccagatcccagagaagtaatttgaatcaacacatttgttgaaaagcaagtctgggcttcctcactggctgtctgggcactttaggcatcagagaatcatggagctggccctctgagtttgtacaagtgacatagaaacaccatggtcagttccaatcagacctcccctgtgctggggttccttctcctggggctctctgcccatccaaagctggagaagacattcttcgtgctcatcctgctgatgtacctggtgatcctactgggcaatggggtcctcatcctggtgaccatccttgactcccgcctggacacacccatcttcctgacccccaggaaaaccatctccttctcagcctgtgcagtacagatgttcctctcccttgccatgggagccacagagtgtgttctcctgagcatgatggcgtttgatcgctacgtggccatctgcaaccccctttggtaccctgaagtcatgaacaaagctacttatgtgcccatggctgctggctcctgggtagctggaagcctcactgccatggtgcagacaccccttgcattgaggctgcccttctgtggagacaacatcatcaatcacttcacctgtgagattctggctgtcctgaagttggcctgtgctgatatctctgtcaatgtgatcagtatgggagtggccaatgtgatcttcctgggggtccctgttctgttcatctctttctcctatgtcttcatcattgccaccatcctgaggatcccctcagctgaggggaggaaaaaggccttctccacctgctctgcccacctcactgtcgtgatcgtcttctacgggaccatcctcttcatgtacgggaagcccaagtctaaggacccactgggagcagacaaacaggaccttgcagacaaactcatttcccttttctatggggtggtgacccccatgctcaaccccatcatctacagcctgaggaacaaggaagtgaaggctgctgtgaggaacctggtatttcagaaacgcttcctgcagtgatggtggaggggtcctgatggctctgtgcttcctgactgctcccacctgagagtcccagaggacaagatgaaagaccaagttgatcaaaggttacatgggtaaatctcattacacagaatctcattacatagaagggctctgtaggaacaggacacatttaatgcaactccaccaaagtatgttcttgtttgtctagcctcgtagttctcattctccatgatggatactgaatgaattgatgtcaaggaaaagtaactcttcacatttttattgttggatgaatgaaaagctctagtctgtaggtctttgattcaattgctccacggcttctttctttgaacatatttggctgctgctttctgaccagattggctatttttggcttctggactactcccagatcccagagaagtaatttgaatcaacacatttgttgaaaaggtaagcgagcacttttaaaagaatatagaaactcttgtgggtccttacttttatgttacctttcaagatcttcctactccatattacataatagttagttttatttttctcctcattgttttttttctgg

SEQ ID NO: 478747 - DNA, 704 bp, Homo sapiens
ccagaaagaagaataaccccaggaagtaccttcgcagtgtaggagatggagagactgtggagtttgatgttgttgaaggagaaaagggtgcggaggcagcaaatgttacagggcctggtggtgttccagttcaaggcagtacatatgcagcagaccggtcctccacgcaattaccagcaaaattaccagaatagtgagagtggggaaaagaacgagggatcggagagtgctcccgcaggccaagcccaacaacgccggccctaccgcaggcgaaggttcccaccttactacatgcggagaccctatgggcgtcgaccacagtattccaaccctcctgtgcagggtgaagtgatggagggtgctgacaaccagggtgcaggagaacaaggtagaccagtgaggcagaatacgtatcggggatatagaccacgattccgcaggggccctccacgccaaagacagcctagagaggacggcaatgatgaagataaagaaaatcaaggagatgagacccaaggtcagcagccacctcaacgtcggtaccgccgcaacttcaattgccgacgcagacacccagaaaaccctaaaccacaagatggcaaagagacaaaagcagccgatccaccagctgagaattcgtccactcctgaggctgagcggggcaggactgagtaaatgccagcttaccatctctaccatcatcc

SEQ ID NO: 478748 - DNA, 1385 bp, Homo sapiens
ttttctctggcagcactttgctaggatctgcccaccgccatggtcacctacaagctagtactgatcagatgtggtgagagcacgtggaacctggagaatcacttcagcagctggtacaatgccaatctaatcctggtaggccacaaggaggcaaagcgcggcaggcaggctctgcgagatgctggctatgatgcagaagagagcgatcggatcctctggacagtgctagatgccattgatcagatgcggctgccagtagtgaggacttggtgcctcaaggagtggcattacgggagtctggctggcctcaataaagcagaaacttctgcgaagcatggtgaggcccagatcaaggaggggaaatgggtactgactgcagcccatggcaacagccttcggggcattgtcaagcatctggagggtctctctgaagaggctatcatggagctgaacctgccgactggtattcccatcgtctatgaattggacaagaacttgaagcccatcaagcccatgcagttcctgggggatgaagtgactctgtgtaaagccatggaagctgtggctgcccagagcaaggctaagaagcgaaggccagcaggcatgctactgtcccccggaacaccctccctggccatcccttcctctgcccctgccccctgcacatgtcacactgaccacatctgtaggcatcttatgttgtagctgcagatggggaccagtggctcacattttcgttttagccatttgtctcctgcacccactcccttcatacagtctagtcagaatagcagttctaggtcacaggttctcagtccaagctgaggaaaagattcccttgtccaagagagttgaaaggtagtgacttgggtttttgccagtgttttctttactaaggatttgtggagaggaaccatgctaagccatgaccaatgaggagaagcaagagcacctatctggccccaggagccagttctctgctcttctgcagtcaggccactgcctgggggctctagtcattccagtggaagatgaatgtaacctgcatgatgatgtgacaaacaacatttcctccccaaccccagaagagctggctctagaaggttgggatcaatcctgaatttagtttatgtgttacatttacttttaccgaaaaaaaaagtatagtatatgtaaataatactaaacagtaacctttctggtgtttcttgtagtgattgaaatagtcccacatgtggtcatcagaatataagccattcctcataccaagatgagataagctctgaggggtaggagtgcctcctgctgtgtgttttagaatccttcacctgccttgtttcatggtggtgaaatgcctcttcgtcctgtccaagtatgtctttcac

SEQ ID NO: 478749 - DNA, 1161 bp, Homo sapiens
tgggtgtgaagtggtatctcattgtggctttgatttgcaaccagatgcttaatgacgttgaacatcttatcatctgctgcctcatctctctcttcgcctgcactggcaagttcctcaaaaagttactcctgcctgttttaccacacgggcaaaagaacttgaaagcttctctccttttcctctttattatcctcttatgcctgtgtcctgattttcctctcctgtggattctcggagacatgacttctctttcccatcagagagcaagctttctgagtgaagcatcatactcggttacatctctcagcctagcacaatattgttctgggttagagagcagttttaggttcacaggaaatttgagtggaggctacagagatttcccatatgaatccccccttcgctattatcagcgttccacaacacagaggtacatttgttgtaatctactctatgttgacacatcatcacccaagggccatcgttcacgttagggttcactcttggtgttgtacattctatggattttgacaaattttgaaataacacgtatccaccatcatagtgttttatagaatagtttcactgccctaaaaaattccctgtgctctacctcctgcctccttccagcccctggcaaccactgatctttctactatctccatagttttgccttttccagaatgttaaatagtcggaatcacacatatgtagccttttcagattggcttctttcacttagcaatatgcatttaagtttcctccatgttctttcatggcttgagagttcatttctttttagtgctaaatgatgttccattgtctggtgtaccacagtttatttatccattcacctgctgaagggcatttcagttgcttccaagttttgtcaattatgaataaagttgctataaacatgctataagcatgcagatttttgtgtgaacacaagttttcagctaatttgggtaaattccaaggagtgtgattgctggtaaacagtcggaatcagtaaacagctggtagagtgtgtttagttttatatgaaaattcaaagtgttttccatgatggttgtaccatttggtttctctttattgttttaaagttaaaatttcacctggatataactagatgatctggcctctttaaatagtttcttt

SEQ ID NO: 478750 - DNA, 1563 bp, Homo sapiens
gccggccctctatttccaacctaatgaagcctgtaccctgttctaccactagatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggcaagaagaagaagaagaaaggagttagctgtaattgtacctgtcctctcccctgtcctgttctcactactattcactgtccttgacttgccccaggaggaggagactgggttactcttggacatggccccttctcttagttttagggccttctcacttccccctggttactcatcctctcccatcctaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacaggagacttgctgttctgacatgacaaagaccttagtccctttggtggaactccattaaaaggctgtcacccctgcatgccaggcccatgctgggtacccaaaagctttgagttctgttaccaaaggggagacctgtgtcctctggccctgctgtttccaagcctcagcctgtgattagtactcttgacagtcctgttagtggcatgctgcgtacagatgaacttgcaaaaacatgccatcctatgcatgagcatgcctacctgtgttatggaaattcatgtctatagggattaccttcagtaagagggccaccctgacctgctataaggattctggtctttctagactgaattcaatagatgttatgacatttattttggtccttcatacttcctttccctttatgatgggaatagagctacgatgacaggcctaaaacataaagacaagcaggtaattctaaatgcttatccctcctccatgaaatttactttcccctttcccatgcagggaccctccacctccccacccttgccctcccgccccaccaccaactttgtttgcttatgttaacatattc

SEQ ID NO: 478751 - DNA, 620 bp, Homo sapiens
cggctttagcagcctcctacctttacactccccagcatatgaagaatcatacttaaagccatgagattagagaaaaccacctatggaatgaacagcagaaagaagcaaggagaaaaggcttgtaaggaggatggagcaatcagtgtgaccagtgctcatgagactaagaaggagcctaagggtggagaatttaccattggaatctggcaatgtgaaggctgccctattcaacccctcatgggagacaggcaggaacatatgagtgagcaagtacaggaaccggccactttggcactggcaggagcaaactctttgtgggccctgcagcagcatctaggtggggtgcctgcaatcccaaggccccagagggtgtgttacaatgttgtcttagctctgtcatccacagacagcagctcagtgggccctctgcctcattgcatggagcagctgccttctgccagtgagggcaaagggccagtgtgacagcctgtttggatacctgcacctgatgtgttccaaattcttgtccagtgcccaagaggaatgaggtcatgtagttaaattgaaggatggtgaatgtggagaatttcactgagtgatgaaagcggctctcagcaaac

SEQ ID NO: 478752 - DNA, 558 bp, Homo sapiens
ttctgcctcatatgaggaccaccattctcatggccccaagacaaactctttgtctctccctagtggagatagatattaacccagaaagacaatatcccctgaaactagaagttagaaaaggactggaagccatcattgataacttaaggtttcaggacctcctcaaactctgcaacagcccttgtaataccccgatattggagatacaagaacctaacagggaatggagactagttcaggacctctgcctcgttaatgagactgtggttccagttcacccagaaaccccattaaagaacacagactggattctctttatggacacaagttcttctacagaacaagggatccataaagcagggtatgcaatagttaccttgaatgatattgctgagagtgcatctctccttgggcacaagtgctcaactagccaagaaatagaatgggccacttcttgaggatatatctttcagttctcaggatggctacaattggaggatggcaagcttcatctaccagctgccaaccaatggaaagttccttaaagccttcagcagg

SEQ ID NO: 478753 - DNA, 709 bp, Homo sapiens
agggtagtaaggttgaaggtggttgcacaaattcaaactgctaccggaagcatacgagagttcctgttgctctatgtccttgccaatccttggcatcatcagttttactaattttagccattctggtggagtatggagcaatagctccttttctaagaccagtcgtgggggagtttctcctcctccccccacaggaaatggctgtggcttgttacttggtgagaagccccaactcactccaccccagaatagcagatgtggctgctccacacagggctgcctttcccttcgtctcccttgcagctgtgacccctttgtacagtgtctgtccctggcgacttctgagcagacctcagctgctctgaatcttaagatcaagtctcacatgacccaaacatttaaggggattccagctccctgtgaccagtccctgatgaaaacactggaaatctcaaaatcctcatacactgggagcagtggaggtgcggagaggcagccctgtgcagagcaggcacctttcctgccacgtcccccggctgctgctggagccacggagagctccgtttcagcatgcctcttgccttctgttgtcttttcttctctccacagagtgggtgaatgacatgttgttgttatggtgcaatcattgctgccaaagtcaaggagcaatgacagatattggcttgattttttatgtaatttaaggtac

SEQ ID NO: 478754 - DNA, 645 bp, Homo sapiens
agcgagcgagggctgcaagggcggccagcatgctgtcacctctcaatacaaaatgggtcaatgtccaacacatcatcagcctcaatccttggagccatcttttccaccaaacaggagttttttgcctctctattagacgaaaatgtgcaagtgatcctgtgtccctaccgagctgtagaaaagctcttgtcaatagagggccaaacccagcactgcatgatggaatatacagcatcctcatttgcctatttccaaaaatatgtccagacaaagccctctcggttccagatccctgtagatgttatgtcaagtgccgtgggcctgggctctgttcagtgttgtgatttgacatgttgggaatatggatgccttcactgtcccacaaaacccttagcaaactgtcaacaagtacaaagggaaattcccagcagcagctgcagtggaaatgctatatgtggaatgccaacagaacagactctcattttatccggctgaaatgagggggaagtggctcttgatatgacctttcttctatgtggggttgccttttgggcttggaaaatttgtctcagaaacaaaatgccaagtgaaaggatagatccagaacatcagaagatagtagtttctccaagatcattcttcttc

SEQ ID NO: 478755 - DNA, 1267 bp, Homo sapiens
agcaaacggcacaccaggagattatatcccgtgcctggctcggagagtcctacgcccacgaagcctcgctcactgctagcacagcagtctgagatcaaactgcaaggtggcagcaaggctgggggaggggcgcctgccattgctgaggcttgagtaggtaaacaaagcagccaggaagctccaactggggggaggccactgcacctcaaggaggcttgcctgcatctgtagactccaactctgggggcaaggcatagcccaacaaaaggcagcagaatcctctgcagacttaaatgtccctgtcagacacctttgacgagagtagtggttctcccaagcatgcagctggagatctgagaacggacagactgcctcctcaagtgggtccctgacccccgagtagcctaactgggaggcaccccccagtaggggcagactggtacctcacacggccaggtactcctctgagaaaaaacttccagaggaacgatcaggcagcaacatttactgttcaccaatatccactgttctgcagccctccgctgctgatacccaggcaaacagggtctggagtggacttccagcaaactccaatagacctgcagctgagggtcctgactgttagaaggaaaactaacaaacagaaagcacatccacaccaaaaccccatctgtacgtcaccatcatcaaagacaaaaggtagataaaaccacaaagatggggaaaaaacagagcagaaaaactggaaactctaaaaatcagagcacctctccccctccaaaggaatgtagctcctcaccagcaatggaacaaagctggacggagaatgactttgacgagctgagagaagaaggcttcagacaatcaaactactctgagctaaaggaggaaggtcaaacccatggcaaagaagttaaaaaccttgaaaaaaaattacacgaatggctaactacaataaccaatgcagagaagtccttaaaggacctgatgcagctgaaaaccaaggctcgagaactacatgacaaatgcacaagcctcaggagccgacttgatcaagtggaagaaaggcagaaactctacaagccagaagagagtgggggccaatattcaacattcttaaagaaaagaattttcaacccagaatttcacatccagccaaactaagcttcataagtgaaggagaaacaaaatactttacagacaagcaaatgctgagagattttgtcaccaccaggcctgccctaaaagagctcctgaaggaagcact

SEQ ID NO: 478756 - DNA, 1274 bp, Homo sapiens
gccaagtggtgggtttgagcactgttaccccacccgctttgaaggaaggctctcaggaatccagaagggctcagaatgaccaaactagatgaacaggtgaaattgtcaaagccacattttacagatggtgacacaaactcaaagagagaaaatgagctctgctccaggttttgggaaaagctctttggcacttgtatggagcagcttgctcttcctggactggattttcctctgcatgtgagtgatctgaccaccatctccctgaccatcaagatctggactctgactcctgttcagtcccatgtgtcagcccctgtgcacttctttgcacttgacattctcatcacaacacaagatggagagttcccacagcaggcttttggacagaacactgtgggaaagtgcagtatagagtcaggccctggggcctggggggactcgggcaggcctgggcagctctctgtggccctcatggcatccaggcagccagatctcaggctctgtcatttctacatttactgtgatggagagagacagtatttccctcgagaaagactctgctgttctcatggtgctccatcccatctcacatagttctttttcttaaatatatatatttttctatggtactatcgtgcatctgatcattcagactagagatttcaatgctgtttattcttacgtcttcagtttgatttgattcaaccaaaatttgctgaacatttcttgggtatatggaactctgattcaggggacacagaagggagtacagtatagtcactgctgtcaagattttgtgctataaattgtggcaaaagcataattgtaaaatcatatgtactttggagtaaaacagaaatgtatatgaatggaggaagtggacaggtgttctcctaggtactgggaatacaggaataaataaaatattttcagtattctccgggagctccaagattagcaggaatcacaaaattattcatcataataaacattaatataacaattataatatatattaatatgttaatatattaatgtattaatacattaatgtgttgttaaattaatacactaataatgtactgatattattataatattgtatatcaaaatacattgtcatgaaattatttgtgattgagactataactatatatttttatattagtaaatgtatatttataatcttgtaaatataatacttgtatttatatataatctcataaatataatacttgtattcatatatatttatatgaaactctatatataac

SEQ ID NO: 478757 - DNA, 717 bp, Homo sapiens
atctgctcacacacgctgctctccctccatgataaacaagaccagcacagagagggagccactcctttctaatgcagacatctaaattctgccagagggtaaaagagaaagtagcatatacggtttcggtgtggtggaaagacatagtggcacaatgccttcgaaggtgggctccacctttgctgcctcctagatgtgaccttgggagagtccccagttgggaaacactcctacagagggaagccagtaacatcaggagaaggcaagctcggagttttctaagaagctccgttgcggccaagccttttcatttcatgacctcagccgaaagctggaggaaaacaaccccaaacacagctcaaactgggtctgcacacaggaaggcaattgctctagtaggaggaaatcttccctggttcccccacacaggatcacaaatcatcccctttgctcccaagtcaaagcgtttgtcttttgtagtatctacttatcacatgtaagattattattctatgtttacttatctatctttcccagttgactgtgagcttcttgaagataacaatgacatgatttttttctgtatatatgtaaatatttcttatttttctgtctaagctattcaagtctcctagagtattgagacattgtgtttgcaatattttactctggcaatatcttcacaatggctctaagacttttcaggccctcccttca

SEQ ID NO: 478758 - DNA, 954 bp, Homo sapiens
caaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaatggaaatgaaaggaatcgtaatgattggaatcgtcatagaatggaatcgaatggattcattgaatggaatcagatggaatcatcgaatggactggaatggaatcattgaatggactcaaaagggatcattattgaatggaattgaatggaatcatcgaatggtctcgattggaatcattatcaaatggaatcgaatggaatcaccgaatagaatcgaatggagcaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacagtcaatgaacgcgaatggaatcaacactgaatggaatcgaatgcaatcatcgagtggaatcggatggaattatgatcaaatggtatcgaatgtaatcatcatcaaatggaatcaaaaataaccatcatcaattggtattgaatggaattgtcatcaaatggaattcaaaggaatcatcatcaaatggaaccgaatggaatcctcattgaatggaaatgaaaggagtcctcatctaatggaatcgcatggaatcatcatcaaatgaaatcgaatggaatcatcatcaaatggaaatctaatggaatcattgaacagaaattgaatgggaatcgtcatcggaataaaattgaatgcccatcatcg

SEQ ID NO: 478759 - DNA, 599 bp, Homo sapiens
ccagcagggtgggagccaagtgtcagctctgagctccaaaggcaaatgttgcagccacaaaggcagaagccccctccaatccctattcctgatcttgatgacctagcctcagaagtcactcatgtgcctgaagccagtccaaccgtactcacatttcctcctgtagtgctcacaggtaccagcaccgatggcattccctttgccctgagcctgcagggcatctcttttgtgcttccttcccctgaggaagaacttaatggaggctttcaaaggttattgaggaccgaacgtcctgggccaaaaagctgtaaactagaatacaacattcatttcaagtcattcatcctaggaatgtatgctgagcaccaactggtgctagattcgggaccaaaagaggagtgggcagagctgaccaggtgggcctgcaatagggaagcagcagacaggaagacgctacaaattggagcactccagcatgagctgcctggagttggttctaatgtggcctgactgccccatcaaaagatgatgaggggagttggtgaaatgtctgcatgaagagtttaaaattgtaaagcacatttttaagttacctacaa

SEQ ID NO: 478760 - DNA, 574 bp, Homo sapiens
gtaggcaatggtcacgcagggtggatggcgagagatggtctgaaggtccagttgatgggctccacctttggagtggcttccgctctgacactgacagccacctccaccctcggctctgacccgagcccccaccacagatctaacaggctcttcactcagcagccagcggggccctttatcaatggcagggcagggcactcctctgcccaaaccatttggtggggtcttcaaggatctggtcccacactgcactcacagcagctgctctctggaaagcctcaaccagccagaaaacagggagctcagttctactggtgcaaggaactgaattctgccgaccaatgcaagaccttggaagacgacctgagctctgaaagaagatgcagcccggctgacaccttgactgcatttcaacagctgatccatgtgcatgccaagttggcccagtgatggcttagggcatcgatctttcctgaagctccttttcatttggaaagctttattgatgtgtaacttacacatcatacaaaataggccaattttaagtgtacaattcaagttggttctggagcct

SEQ ID NO: 478761 - DNA, 669 bp, Homo sapiens
gtaccaccctgctggtaccatagagtagtgctacactctcaaaagttttatagttttaggttttacatttaggcctatgatccattttgagttaagttttgcatcaagtgtgagtccttgatcccgttttctgaacaccagcgtgctccatgagggccgttaaccaaggagaaagagctgagaaaccaggtgctgatgggcccgttttgtcactcaacaaactggtcaaggaggtccatgaggagcaggccctgtcctgggccccaaaacccacagtctctcctcttacttcctgcagcagcagcagcagcagcagcagctttgggcctctcctctgcccagcgggcacccctcctagcagctctcgtctcatctcagctatttccaaaccctacaatagacacagggaggcacggagcacctgcatggggacagggaacagccaatcagagcccagctgcaggatcctggaggccatggtgaggcaggtgcagcaggacccagtggttcaaactgagctccctggaatcctcagagccccactggcacctggaggaaggtgaaccagagggagggaacggacgagatgatgcaggttctgcacccagccccaccccaggtctcagggaagctgcactttcattggttgttcatttagattttcagtgt

SEQ ID NO: 478762 - DNA, 522 bp, Homo sapiens
gtcaacagcatggaggacaacgcagcaatggccctgctcctcaagagatcctttcttcttgatgatctcttccttcttggtctggaggtgctcttcacggagcttgcgtgcttccttggtcttagacccgcgggcctcagcctggtcagccaggggcttcttgcgggctttgtctgccttcagcttgtggctgtgttccgtgagaatccgcttgtgtttgaacacattccccttcaacttcagccggcgcagaatcctcagtctcctcatccacgtgaccttctctggcattcaggcattggctgtacccctccgcttacctatgcccaagtgcctgcccttccggcgggccaaggtgcttttccagcattgagcccgggaatggaccgtcacaggcttgcggtgacgcaagatcagcccatctttgatcagcttccggatctgctgacggaagttggcattggggatttcattgtgagtgagttctcatgatatctgatggtttgaaagtgtgtggcattt

SEQ ID NO: 478763 - DNA, 1076 bp, Homo sapiens
ggtggcaggttgcccccagctgcccagggcctctgcggcctgggtgcccacagccatctttcaggcacttgccctgctatgctcggaccctttctgtacccttggcgcttacctgctggcagcctggccccaccggcatcactgggagtgggctgtgccaccatacaagccacatctgactggcggtatcaggctgtcgcagcgacgtggaagtggggtgaggaggtcacgtcccgtgcttcttgctggctgagggcaaatccctccccacgtgcgcctgttctctctccacctttccgccctaagcccccaggtgcccttactcactcatgttccttgagccaggtgtcttaggtctttgtgtggatgaggaggagcggaggtgtgaggtgtgctgggccttcagggcctgggaaggccatcccagactgagccccaccgccctttcccagctcagtccccaccgagctgacagcttggaaaggggcggttgggaagtgagtagcaccctctgataatgatactgatcaggccagcaggtttgtcaggggtgcacatcctgctcagcagagcatatgaagatcacagcttggtgaagctccactcgagagacctggagcgagactgctgtgcggtgggtgacaggtggaactccagccgggccggggctggtggagcccactgcgagcagtctgaacgaagacataggacaactctggtgacagccacagctggtggccgcttcctcgtgtcagatgtggacggtcaccccgccctcccagcgctaagcgctgagactgcgtgtccagagtcggctcctgcacgtgaggccaattggtcacactgggccagtgtggaggaagacgcctctcatctcccaaatggggatctttcatgggtgtcacctgagcttatagagcttagtttagtctagccattccaagacagtggtttcttaaccttttctaggtcacaaaacctcctgagaacctaatgaaaactggatcccagccccagaaaaatgcacctgtgtgcacacacccagcagtttccaggtcatttcaagtcctgccttc

SEQ ID NO: 478764 - DNA, 1009 bp, Homo sapiens
gtttgaaaagcgttgcaatatgatgcacacgttgtgcggccactgtggctctaaggcctgtcaccttccgaagtctacctgtggcaaatgtggctaccccgccaagcgcaagaggaagtatgactggtgtgccaaggctaaaagactaaaggccacagggactgggcgaatgaagcggctgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcctttcttgggttgccagctgagtcccggatttaggaataagttcagctctttcaaagtgcacagtgttacagtcgaatgggctcccatcctggaataatatggagaatcctttgtcttccactcactgtcattcacaaggcacagtgccccatgaaattgccccaatagaaaacatggcatccctgacctccaaatg

SEQ ID NO: 478765 - DNA, 3804 bp, Homo sapiens
ggcttcgtggagctcactcggtctgagaggtcggaggctgcgagtgtcgctgctgaaggctgtggtggaccaggctggatcgcggattctgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtctgaaaagtcgccaccatgaggaagctcttcagcttcgggagacgcctgggccaggcgctcctggactccatggaccaagagtacgctggtcgggggtaccacatccgggactgggaactgcggaagatccacagggctgccatcaagggcgacgccgcggaggtggagcactgcctgacgcgcaggttccgggacttggacgcccgcgacagaaaagacaggtatcgggggctcagcctgcggtgggagggggccccaggcccggcttccctgcagcccctggggcgggggccttggagggccccgggcaccctcggagccgcggagccaaatggagcctcagactgctttccatcgctggcaattccccatttacataaaccaaataaaaatatcaaggttttatcatttttgcatgacactgtctatcttactattgtgatgatatttaaaaatgttcataatggagtgaaaaaagacttgctcctctagatatcaaaatgtgctattaattctcacaattaattatttactaacagctgaaaacacagataaataaatgcaacagaataggaaatccaaaaacactgaaatatatgtaagatatatacatagggattgataatggtaacatttcagatgagtaggaaaggatgagttattaataacatgcctgctgtgtgaagaaaactaatggaattttatgtcgcaaaaatgagttcctgatggaatttagactgaaatttttacatatgcaaaatgagaaaagtaccagaagaaaatacaaagacttatatatacaggtacattttatgttaataaaggccttcctaagaatgacctcgcaagcaggcattctgaaagttgatttagcaaactaaaaattaaaatcccctgtgtatcagaaaaaaattaacaaaagaagtaaaaagggaatctttttacctgtgcttgcagattttattatgtacatattatgtatatatgtttttcttatgtatagattcattacatatatgcaatgatagattaatcatttcattatagttgtagtcttataaaaataacaaatagcaaatagtattactatcacaaaaatactggtttataaaagttgtatttaaaaatattgagctccccaactgtattctatcaatccatttattcatcaaacataacctgaatacctgttatgtagcaaacattttacctgttatgtagcaaacattttgcactatctctcaggacccttccatacttaaaaactttgtttacctgttctgcctgagcaagatgagagatttaaaatgggaatagtaggacttaatctccttgaagcttttcctcccacctttcaagcaaaagcatttctgaaggtagaaaacagtaagagataacctttaactgcccttttgaaaatctgtcagtcttaaatactaatatgaataattggaaagtctgatttgcatatattctgtaaatctaagtgttgactaaaatgagccatacctgttcatctcaatcattagtttcctttagcttcatatttttaaaaatcaaagaagtaatttgtttaaaaaatatgttgttatttcagtgctctttccccatggtacttttaggaattaaaatgtatttaagtgtcaattagatgcctagaactgccctagacctgctgtctataccgtatttgcttaatgtaaggcctcatggattgtgtgataccctactgttttctatattaataagatgattttttaaacgctaccaattgtagttataaaaaattatgaattataaatgccattccaatatcagatatactaaaatgtgacctaatctttaaatcatcctgcaaaatggcaataattgtatcattttacttaattaaaatgtttttgttaagtagtagtaatagtaataattgtaacatctggctgggactgttctacatttgacctgtgcccatggccgtgtggaagtggtcaccctcttgctgagcagaagatgccagatcaacatatatgatagactaaacaggacacctttaatgaaggtatatagtagccaactttttcagcatgaaatggatttgatttaaatacatagaattaaaatgaatttatctcatttaaatataactagttggtgaaacctgtggaatatgtattttgaattcttagaatttatagtctagttttttcatctgacactaataggctgtacactgccaggaagaggcttgtgccattattctcctggaacatggcgccaatccaaacattaaggatatctacagcaacactgctctccattatgctgtgtataataaggggacttcactggcagaaaaactgctttcccaccatgcaaatattgaagcactaaacgaggtacagatcaatcaactttcttttcaaaatacttgttttaacattgacataggtaagagtcagtttttcatatttggaactcaagtgttcccgaataaaaatattttgaaataaattaattgtctaaaattttaccttaaatattgatacttttaaagaagcttttttagtgcacttatgggaaatatttgtgaatttgttaagctaaaacttcttcaagtatttgtttcctaccccaggtgtaggaaaatactaattatttttctaattagtattaaaaaaaatcacaggaaaaaagttaccctggaaataggctttatcttaaaaccagcaatagctggtacgtgaccgagtccaaagtagaactcaagccctagtttaactgaatccaaacatcaagctcattctatccaaaacagcaacttaaaataaatggaagtcttgctgctgctgacggttttctaacaaaagggatgtatctttcattggcaaggtttaagagggaaaaatgggaagggaaaagggaagcaatcaaaaacatgcaggtcagttgaaaattaggtaatgagagaaaataccaagaagaggttttgttttttagtttgttgtttttccagtttatgtattgagacaaagcactcttcagctttggggtaatcatttttggtttggtaaaagagggattgaaacttgcctaaagattaatttttagaggactctgaggaaaccagattggcagtgaatatatggtgatgaagtgagaaacacttcagcaaagggtggaacaaattagtaactgacttattacccatcctggcaaaaacagccacttagataagagtctaaactctcctttcaaatctagaatgtcttggtgggaaggtgggagataaggagcttataaatagcaaaatcaactgggattttgagtttacttatccctgttataaccacacccaggaaaattcactggcgttttaataaataactctatctcatactcttttctctttctggccacatcccaagctgataaaggatattggccatgtgggtgagagatgaaactgaagcgatcgtctgccacagtaattctcagctagaattgtgcattacagtgacctggggaaattttgttaaaag

SEQ ID NO: 478766 - DNA, 708 bp, Homo sapiens
ggcacaccccacctctctaggcccagagcagggtgctggctgcagcctggcagacctggagaagatgaatgagcctccaggagggcctgctgcaagcccagtactccccagctgcctgagaggagaattatgactgagaaggcaggccagagcccaggccttcgggtggtcccagccctgccctccctgcagccatgggggcctccagaactctgtcttatcaccagctgccccaggagcatctcccacttcccagaatccaagcccctctgagcagccagttctggcaggacatccagggagagctttgggcccagccggtgcctgggggtggctgcatcatgaccccacagcccattccttcaggcacccaccccaagacaccgtactttctgggcctcagtaggcagggccagcggcggttggctctgaagctgaaacactatgtccatgcaggcagcgcctggcactgggcaggtatggtccaggcccctccacccttcccctcaggacctccctctcgcgccagattgaagcagtcatggttccccaggggcacctggtggtccctgcagcagctggctgcgacaagaggccaggctgctccctgcccacaacatcattcacatcgttactatgggtgaaggattcctctccatttactggggagaaaactgaggttggggaaagggagccactggaagccac

SEQ ID NO: 478767 - DNA, 861 bp, Homo sapiens
ggcccacagagatggacggcgatggcggccgccgagacgtccccggcacgctgatggagcccgggcgcggcgcggggcccgcgggcatggcggagcctcgggcgaaggcggcacggccggggccccagcgctttctgcggcgcagcgtggtagagtcggaccaggaggagcgccgggcttggaggcagccgaggcgccgggcccgcagcccccgcagcccctgcagcgccgggtgcttctgtctgaagacgcgccgcctctcgcggagcgcgcccgcggacgcccgccgcccccgcgcccgcagcgctgcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcagcaagccgtggctgccccagcagggatacctgcagagacttcttctgacccagggcctgtgacccagaggtggtgcctggtagagctctggggacagctgggcaaggcctggaagtgtgccgctggcagccccgccagtgccagtgctgagctggcccgtcatcccgtgcagatctgaaggtagagaaggtaggaatcgt

SEQ ID NO: 478768 - DNA, 789 bp, Homo sapiens
taggttttttcctaatcttatccagcttcacccaatcacaggcacacgtgagtaaccacagcccctgaaatgacagaatacgatgactatgtcttagatagcccatacaaggttatttccatatttcctgatttaaaatactttccttctcttgacggttgtttggatcctgccagtcactgggaagccagtgctgtcatggaaatccctgcacacgacacacgggtttccttcggtttggcgagacattcccagatgaccgcagagcttgtctgccatcacatctccgtgatttccaggtacaaatttgccgtagtaagttatgtctggcttgttctgcaaaaaaaacaccaagtgctagtagatggattcaattgcagccactatgtcagtgacatggttaagaaacagtgtgcagagcacgtgcttacagaggtctatgcacatagagcttccccaaattttcatgtcatcaattttccagtcatgtgccttccaggtatctgatcatccagccaaaccattggctacagcccatgaatcagtttgtaattgcatatcatgccatttcttcttccaggcaaagtggacaaccagagaagaaaagaaattccatgatttgagggagacaaagaataaaaataaaaataaatcagcaaaaatttgactagacatctgacaaaagaaggtaggctaacggccaataagcataagaaaaaatatagaatatgactcctcatcaggaaaatgtgaattaaaccacataatttaaccacccaggtctcagat

SEQ ID NO: 478769 - DNA, 537 bp, Homo sapiens
gagctccctgagccagaactgccatctttcagtaattcgccaaaatgacgaacacaaagggaaaggggagaggcacccgatatgtgttctctaggccttttggaaaacatggagttgttcctttggccacgtatatgcacatctataaggaaggtgataatgtagacaccaagggaatgggtactgctcaaaaaggaatggcccacaagtgttaccttgacaaaactggaagagtctacaatattacccagcatgctcttggcactgtcgtaaacaaacaagttaagggcaagattcttgcccagagaattaatgtgtgtattgagtacattaagcactctaagagccgagatagcttcctgaaacactggatgccagagaggcctgaaacctccaataggcatagacaaacaatcagacagacaaacaaaagtctggctggagaactgggtaaaggggaagcacaacagagaccaaatggggagctctaactcctgtttcacaactggccacaaacaggtggcctgattttcctcc

SEQ ID NO: 478770 - DNA, 1555 bp, Homo sapiens
tccgtccccagcatagagaggaggcagctgatcccagaggctctgtgtggccaggcaaggaggagctctgcaaccatgccaccaccccttactacaaaaagcctatgtatggcacctcacacaagttcatggagaagaagaaccgtccctcaggggacctgctaaacatatatgagctcttccagaaggtaaatgccagcaacagaccctcgtcacttaggctcctgaatgagccacagaagtgggactatggcagcactggggtggccaccaacagtgaccctaacatctacttcctgatccagaagatattctacatgttcaacaccctcaagtctaacaggtcccagctgcacagcacaatggacatactctccctgaaggtgaaccccactgagatggtggccaaattccagctgcccccaccaccgcatagcagctcatgggccgcagagctcaagcagatggtggaccagagcctgtcgggtggggtcttggcaggctgcccactggtgcagctcttccccaagctcttcagctgcagccgagcagtggaccccggccacttcctggaccacaaagacgaggaggacggcctgtctctggaccggagcagcaccatggcctcagaccacgtggtggacatgcaggacctcaccgagttcctggatgaagcctcttcgcccagcgaatatgctgtcttcctcctccactggctcttccctgagctctttgaccactgcaagctgggcgagtactacagctgctatggggatggcagcaagcaggagctggagccgcagaggctgcagatcatctgcaactacacagaggtctacttctcccatatgcaggaggaggaggcctggctgcagcagtgtgcccagcgcatcaacgacaagctccagggcctgaggctggatgcgggcagtgaagacgagccccccacggtggaggatagctccaagggcgagcagcgccgctccaagaagatctggctggtactcatcaacctggacaaattggagatcccccagcccaatttggaggtgcctggcaccgactgcctgctcagcaaggagcatctgcacagcatctatgagagcagcctgtccattggcaacttcgccttgcacctgctggtgcccctgttccccaagctcttcacccatgagaacctgcacaagcagtacagctccagcggttccctgggcaagaagcagctggacctgtcctgcatcaagctcattcgccagtatgtgtgtctgctctacctccatgccaaaaacgaccgcttctggaccctggagttcatgggcaacctgcgccgggacacgagcagaggcgctcctaccagcagcagtgcaaggtccacgtgctggcccccagtgcagagacatgaggagctatgcaatcaaccctgagaggtttgaggaggagtttgagggtcccccgctgcccccaagaggagcaggaaggacttttgcaagatccccttggacaaggtggtggtccctcgcccagcttcccggtgccctctccctacctgctgtcc

SEQ ID NO: 478771 - DNA, 1432 bp, Homo sapiens
tacaggaggcatggctggggagggctcaggaaatttacaatcatggccgaaggtgaaggggaagcaagcacatcttcacatggtgacgggagagagaaagcgaagagggaagacatgggctactgccagggtgtgagccaggtcgctgttgtcctgctgatgttccccaaggagaaagaggccttcttggcactagctcagctgctgaccagcaaaaacctgccagacactgtagatggacagctgcctatggggcctcacagccgggccagagcccagccggggcccctgctctggtctctgctgccgctgctgctcctgagcccagaggccgcccctgccccacagtcccgcgccgccagcccctcgcaggctccgggggaggccagagagagcttgggggcgcagcagggccgggagcccgcagccagagcccaagtgtgtgggaagcctaaggtggtggggaagatctatggtggccgggacgcagcagctggccagtggccatggcaggccagcctgctctactggggctcgcacctctgtggagctgtcctcatcgactcctgctggctggtatcaactacccactgctttctcaaaacctcctcatccttcatcctcagctctggcagggagttccctggcccctgtgtctgtctgctcaacccagacatgcgtgagagcattggcagtgtctgtgctggccacctgcagggcttctcttcagtgtgcaccatgctcctcaaatcccaggccccgaagaactatcaggttctgttgggaaacatccaactgtatcatcaaacccagcacacccagaagatgtctgtgcaccggatcatcacccatccagactttgagaagctccacccctttgggagtgacattgccatgttgcagctgcacctgcctatgaacttcacttcctacattgtccctgtctgcctcccatcccgggacatgcagctgcccagtaacgtgtcctgttggataaccggctggggaatgctcaccgaagaccataagaggggtgtgggagaggcgggaggatgagggaggggaaggagagggaggcagaggggaagaaggaaggatggcttagccaggcaaagaggaagccactggacttggccctctgtgcctcatttccatgaccggtaagacaagctatgggagtgaaatgaaatgaaccaagatcaattaaagacttccagtttccagtctggagtataagaagcttggaagtcatcactcccattctcaaaacaagaaaaaaaaaagctgaacaaactgaaagtcaacaactcttcttagatctgtcagagaattgaggtcacagggcagattactaccctcaaaactggagacaggcagatacagagaatcacggttaatctgaagggaagctcagatgtaaaagctggctatt

SEQ ID NO: 478772 - DNA, 582 bp, Homo sapiens
tgtttgttttgtgctaatgctgtttaattttgtagcaaaccctgacaatgcaactgaggcccttttaagattgtctgccaaggctgtgcagttccatggatctgagccaatgtgtagagtctcccatccaccactccagcaacaaaaggagcagttcctacatccgcaaggtctcccatgcatcccctttggagccaacctctccccactccatcagctcctggcaaccacggatctgttctccatccctatggttcagcattgtccaaaatgttctatgaatggaatcatatcaccacagaggcaattgcaggtctctggtcggagtgacacgctggtgagactgaaaggtgtctgtgtggaagcatctaaccaccactgcccattcagtgatagaagttctttatatattctggatacaagtccttagtcagaaataagttgaatgtttagaaataaaaaatgcatggcctgaaattaatatttattatgggcaataaatggcagaataaaagattagtgagcttgaagacacaggattagaaattacctaaaatgagaaatgacacagagggaagaaaa

SEQ ID NO: 478773 - DNA, 2248 bp, Homo sapiens
agacagtggttgcctaatgatctttgagacatggtgccctgtctcccagatgcttcagctccagccacagttaaaaggggccaaggtacagctcaggccattgcttcagagggtccaagctccaagccttggaggcttccatgtggtgttgagcctgtgggttcacagaagtcaagaattgaggtttgggaaccttcacctggatttcagaggatgtatggaaatgcctggatacccaggcagaagtttgctgcaggggcaaagccctcatggagaacctctgctaggacagtgcagaatggaaatgtggggttggagcccccacacagagtcctcactggggtactacctagtggagctgtgagaagagggtcactgtcctccagaccccagcatggtagatccactgacaactttcactgtgcccctggaaaagccacagacactcaatgccagcccatgaaagcagccaggagggggttgtaccctgcaaagccacaggggtggagctgcccatggccatgggagcttacttcttgcatcagtgtgacctggattttaccattgccatggcaacactcaggcattaccacccctttcagcggcaatgacctgatgacccaaaaattaccaccattttcctaacaatttctgcacaaaccatccctgaatctgcatgtaattaaaatgtttcacgtgtgtaaagtagcaagcatgtatatactgcttagaggcatctacacttacatactacactcatatccaacacttgcatcgtacaaagtacacatagtaggtgtggcatgtaataagttaccctcctatattttcttctaaaagatttttaaatatttgcatctcaaatttaagtcctttgtccatttagatctggcctttgtgtgatagggatccatttttgggatagagatgcattctgatattttcccatatggataccaattgctcataccatggttcatatagaccctttctgactgttctgtaatgttagccagggcatacatcaagatttcacacaagcatacactttcacaatagcaattcctgctgtggtaattataacttcacagcaaatctgattattagtgtaacattggaactactggtgacatcatctaggcatcatgttttctttgtagaattattaattattaactcaattactttaatgtattagtgcaaaatatatttctctttatgattgtactcagattaactagtttgcaggactgtgtccagagttggttccttccggtgggttcgtggtctccctgacttcaagaatgcagctgtggaccttcctgaaaatgtgaaactccgaccaagtgcagtggctcatgcctgtaatcccagctcgttgggaggccgaggcaggtggatcacaagtcgcaggtggcgtgatttgatttgtgtgaaggcaatgaaatgatacacagatacaccgaagcctcccaaaagaatcctggttccaagactcaagaagatggattaatgtttttccattaattgttggaatttatgccattttttactatgtgccatcaattttaaagcacttctgaaaagacataacaatctaaatgagatggcattttaaattcataaaaatatatttttaattggagcctttagaattttctctatatgagatcatgtcatcttcaaatagagacactttcacttcttttccagtttggatgccttttatttctttttcttacttaattgctctggctaggacttacagactttttcagaaaccccccaaaataatctaagggagtccattgtcactagacctgctttataagaaattctaaagggagttcttcaaactgaaatgcaataagactaattagcatcacgaaaacatatgtagttataaaaagtcaccagtaaaagtaactatacagtcaaattcaaaatattcctaatactgtaatgatggagtataatcactttaacttttaaaaggttaaaagacaaaaaatattacaaataaatataactacaaaataaacaaagaaataaacgctgacatcaaaaaaacataaaaagtggaggggagtaaagtgtagggttttgtatatgcttgaagttaagttgttatcaacttaaaatagaccattataactataatcatacatttcttaatgtggatatgttctgaataatgcctcattatgcaattttgtcatggtgtgaatatcatagagtatacttacac

SEQ ID NO: 478774 - DNA, 1160 bp, Homo sapiens
agtcaccatatctggtcaagattgtcattcttaaaggcattgatattaaaagggttattgaagattaaggttttgctatgagtgctgttagtaactgtactgttgctaagaaagctgttgttaagggcatttttgataagggtactattggaaagagtgttgaatttaaagaaattgttgttatgggctattttcttagagtcattgttcttaaaggccttgatagtaagagtgttgaaaataaaacagattttgctacgagtgatgttgataagggagctgctgctatgagcactatgctaatgtttttgctaaaagtcattgttacaaaagctgtggttactaatgatgttgctgccatggaacacgtgcctaaggatgatatttcaattggcatcgatagtaaggtcactgttgctaaggaagttatttctaagtgcattgttcctggagccattgactggggcacttgctcttccaaattcttcatgactccctcttcattgagccctgagggaaatggagagagagaaaaatggctatggttcgctttgtttgtgtatctccccaatgccaatgtgactgcttcaatagactatgtcacagatatgttgcttgtaatatttgacatgatgtgaatttttattcaagttaagcaacagccatgagagacaatcacagagagcctatccatgtgtttctgacaaaggttccttttttattgttttatgtttatcaagagatttcttttgacacatgtactttttaaatttttttattttgaaataattgtagattcacatgaagttgcaaaaagaaaaaaagtattttacaattgcacatatttaaggtgtacagagtatgacacgtgtaaaacacaggaactatcattaaaagtagaattaacaccccaaaatgtcctgttgtggcaagcttctcttccatcttcaaacatagggctttagataaaagctttcaaccaattgccaatcaggaaatcttttaatccacttatgacttgcaggccacaacccccccactgccccttcctcccccttcacattgctccatgtgatggttaatattgagtgtcaacttgattggaatgaagggtgcgaagtgttgttcctggatgtatctgtgaggatgttgccaaagac

SEQ ID NO: 478775 - DNA, 713 bp, Homo sapiens
tctctcccacaaaatatgggaattcaagatgagatttcggtggggacacagccaaaccatatcaagtccctagagcccaggtttccacgttccttctctcgcgagaattgtgcagacacgccctttctggctgcaaactgtggagatgtgtggcaggcatctccacctcagaaaaatccagagttcttaaaggctgctgatcacacagctacccaaccagccaagttgcagatgccaaacaggcaccagccatcattttaccttattgcaataccaatccaaaaagaggagaataagaggccatgtagttccacatcagcccagaaaaggcgtcccctctttctggtcatgacagattatgagaatgaaaaggggatgaaggcagaaagttcaggagaaatgctactcaatgccagcaatcaggtaggccttacaatcagagtttggagtgcctatagcatcagcagaaatgatgtggcactcatcagcaaagggcgatgtacttgtttctgggagtatggcctataccaactgaatggccagtgggacaagaatggttaccaagtcctggggaaagggttggaggaatgcggagttattgtttaatgtgcagttttgggatgacacgaaagttctgaaggtggatagttatgataattgcacaataatgtgaatacacttaatgtcactgaattgaatatttaaaaatcgtc

SEQ ID NO: 478776 - DNA, 630 bp, Homo sapiens
aaaccacccgtttatgatttcaaacaggtaatacttgtttctcaataactggatgggggctggatggctaaggggcctcatattttagggacaggaggagctcatcgtcagctgggtgatgggaatgcgaccacaagtctcattatccaggagagcttgaacataggggttgagtttcaaaagcagcataagggcagcaacacaagaacttcccatgtctcacttctgtcatatttgctattctcccattggccaaagcaggtcacaagggcatggccagccggtatggaaggggacaaccaaaggggtagacacagggaaggatattgtttcacaagtgcggtccctaaaatggagcagggaaccctcttggggcctgcaccccctccattccaccaccctgcacccccatccatggaaataaaggaaaatattgagttccttcaagggaaattccaggcacctagctagccctgagaagcaagcaacttgataagcaagaaagtaatcacagcttaaaacaacagccaaggaagttctagccataagatatttgaaactaaaggcaacattttaacatatgtccctgagttgtttttcagaaacccagactccctaccgagccgatcc

SEQ ID NO: 478777 - DNA, 1731 bp, Homo sapiens
attggtcaatctctcgtaacctccgcgcggtcagcgccgtagtgtccggcctgccgcatgccctgcaggtagcgcccccgcctgcggcccagagtgcactcgcgcctgcgccatctcccggaaaaatttcgcgccacgcagagatgacagccaaggagatgaaggcgaccgagagtgcggcgcagccggcgccgctgcccaagaaggaagtggacgtcagccccaaacaggatgaaggagtgctgaaggtcatcaagagagagggcacaggtacagagatgcccatgactggggacctagtctttgtccactacactggctggctgttagagggcacaaagtttgactccagcgtggatcgcaaggacaaattctcctttgacctgggaaaaggggaggtcatcaaggcttgggacattgccgtagcaaccatgaaggtgggggaggaagaagatctgacggaagaggaagatgggggaatcatccgcagaatagggactcgcggtgaaggctatgtcaagcccgatgagggcgctatggtggaggttgcgctggaagggtgctgcaaggaccagctctttgaccaacgggcgctccactttgaggttagcgagggggagaacctggatctgccttatgatctggagagggccattcagcacttggagaaaggagaacattccactgtgtacctcaagcccagctatgcttttggcagtgttgggaaggaaaagttccaaatcccaccaaatgccgagctgaaatatgaattacatctcaagagttttgaaaaggccaaggaatcttgggagatgatttcagaagagaagctggaacagaacaccatagtgaaagagcagggcagtgtgtacttcaaggaaggcaaatacaagcaagctttactacagtgtaagaagattgtgtcctggctggaatatgagtctagtttttccaatgaggaagcacagaaggcacaggcccttcgactggcctctcacctcgacctggtcatgtgtcagctgaaactacaggccttctctgctgccattgaaagttgtaacaatgccctagaactgggcagcaacaacgagaagggccccttccgccggggagaggcccacctggcggtgaatgactttgaactggcatgggctgacttccagaaggtcctgcagctctaccccaacgacaaagccgccagggcccagctggctgtgggtcagcagcggatccacaggcagcttgcctgggagaagttctatgccaaaatgtttgagaggctggctgaggaggagaacaaggccaaggcagaggcttgctcaggagaccatcccactgacacagagatgaaggcggagtgcaagagcaacacggcgggagccagaaatcggtattatgggctgcactgtagaaataaccaggaagccaacttttataatgtgacacaagcagataagccaagctgtctgcgtatgcttgctaaggagcacatgcatggagctgtgggtatattgggtattagggctcagcatttactgagaacactgtgctcagtgaagtatgagcttcgtatatgagtaagggtagttagtctaagttaaaaggtgagaaggcagactctgtgggtgtaggtactggtgggtaagtgtctttgttcattttgtgctgctgtgacagatgaccacagattgcgtgattaattttttcacaggtataaaagctgtgaagccc

SEQ ID NO: 478778 - DNA, 1659 bp, Homo sapiens
cggaagagcaggccaacagacacctgcaggccatcaggccatcgatggaggcctcttagataagggtgttgttgctaagaaatgttccccacacatactgccaccaaggacatagttgttactgccactgtagctaaatgcatggctgatatagccattattgctctggtcacaattacagtagccactcttgcagaaggagcaattcctatgaccaccgttgctaaagacattgttattaagatgcatttgctaaatcaaggttggatggtcactactgccacgaaaactgttgctaaaggcaacattgctaggggcaaaggtgctaaggaaatttttgctatgaaatgtgctgttactaagaacattgtggccatggccactattgcagaggctactgttgctaagatcattggtgctaaaggtgctgttcctaaggaaagagtgttgaatttaaagaaattgttgttatgggctattttcttagagtcattgttcttaaaggccttgatagtaagagtgttgaaaataaaacagattttgctacgagtgatgttgataagggagctgctgctatgagtactgtttccaaatgtgatgttgctaagagccaattgctaagggtactctagctaaatacattgttaataaggacattgctgcaaatagtgctgctcacagagttgttgttaatggtgctgtttctaaggacactgttgatactgcaccaatgctaagggcctggttgttcatggcatttttattaaaggcagttataataatgaggttgtttttaaggtgttgatgccaagagtattgtttctaaagatatttttgctaagcatgctcttgctgatggccttgttttatagccactgtttctatgggaaatgatactaaaggtgttattgcttagggcattgttgctatggttggtagccaagaaaggttttgctaaattggcttttttccaagggtgctgtgcaaaggttgttaagtactgtggtaaggaaaatattattatgaatattattgttaaggccattgcctataagagttgctaaaggacattgtgagtcctttatcctatataaatataaaggatatttatattaagcacattgtcactgaggaacttgctgctaggtgttttgttgatgtggcctattgttgctaaggatattgtcactctgacaatgatattaggggcattgtagctaaggacattgacattaaggctctgttactaagactcatttttgctaagggtatttttgctaaggatgttgttattaagtacatttttgctagagcattcttgttcagtgtgttgttgctaaagggctagttgctagaagcacttttcctagaataattgttgcaaagagcattcatgctaaaatgttgatcctaagaccactgtttctaagaaactcatttgaagggcactgtcactggctttagataaaagctttcaaccaattgccaatcaggaaatcttttaatccacttatgacttgcaggccacaacccccccactgccccttcctcccccttcacattgctccatgtgatggttaatattgagtgtcaacttgattggaatgaagggtgcgaagtgttgttcctggatgtatctgtgaggatgttgccaaagac

SEQ ID NO: 478779 - DNA, 1029 bp, Homo sapiens
cagcctgcagagccctgagtcaaatacacgtcttttctttataagtttcccagcttcagatattcctttatagcaatgcaaaaatggactgaggcatcgagaaatacgatttttgtattacatgttctcactcaggtggatgctaaagaggttctcactcatgtggatgctaaagatgctcacggaggagatgaaggcacttcaaaagacagcttgttactcacagttgagggggtggttactcacagttatggttgggggagtggggtagaggaactccatgccacacagggccacctggggaagcaccagatgacttggggcagaggaatattgattggatgtctgcgcgtgataaaagaaagagttgagggctctgggctgtgggtcgtctggtttgcatatgaaaggcgtgcttctgggccatgtttgctatttctaggagtgagctttaccctctacagtcagtaccaatgtaatattgggttttcattgcataacccatttattcatttatttactctcaccgattattctttcttttctccataacccatgtttcaactgcccatcccaattctctatgaacttattactctgagaataatagctctataaaatgtgttccataggctgaagaaatgtgactcaatggctgaaatcggtgaatttattaagttataataaataaaagtgtatggctaacatgttgaaagaaatgttaatgacttcactgaaaaagacccacataaatgacggcaacagacttagatcttgccacatattttatttaatgttttatctgccagcacacacagctacagataaaacttggatgcagtaagatataacgtcatgaaatcgtatgaaaaggaagacagaaattagtcacataaatgatactcaacaatgggttgtatgattaactggtttagagtgggtcttaggactttcaaaaagagttgaaaaataggtagaaaactgaaggaaaaaatgtaaatatattttgtgggcaaagctatcgaggtc

SEQ ID NO: 478780 - DNA, 1037 bp, Homo sapiens
agaagtccaagatcaaggtgccagcaggattggtgtctggtgagggcctggtctctgcatccaagatggtaccttgtgcactgtgtcttcaggaggagaggcactgtgtcctcacatggcagaaggcggaagggcaaaacaggggaagcccactccctccagtccttgtagacttgctgaatgactttgacaaaaatgctgatagtgttttgaacaataaggtccaggcagaggtggtctcagatggagatgaggaacttgttgtgaactggagcaaagagcccctatacagagtccttactggggcacttcctagtggagctgtgaggagagggccactctcctccagaccccagaattgtagattcactgacagcttgcaccatgagcctggaaaagctgtggacactcaacgtcagcccatgaaaacagccacgaggtgggctataccctgcaaagccacagaggcagaactgcccaaggctgtgggagcccacctcttggatcagcatgaccttgatgtgaaacatggagtcaaaggagatcatttcggaactttaaaatttgactaccttgctggattttggacttgcatggggcctgctgttactgccacaggtcatgattcctttgatggatctgggcaaagtcaattcgaaaccttctggaaaggattcattatgatagatgccactaagaacattcatgattcaccagaggaggtaaaaatagcagcattaataggagtctggaagaagttgattctgaccctcataaatgactttgaggggttcaagaccttagcagaggaagtaaccacagttgtggtgaagatagcaagaaaactagaattacaagtggagcctgaagatgaccttccgagaggctccggaaagttatccagaaatgtccacctgaaacatgagcctggagcatttgtccacctgtcccacactggttgaggtcttcccctgaggctgttaacctgcaagtgtttctgggctgtatttgtgctcaggcaaaatcctacaataatg

SEQ ID NO: 478781 - DNA, 600 bp, Homo sapiens
tgaaagccatgcaatttaagggatggtgttaatctcagtccaaataggtgtcctcaaggtggcgtgcaagtgggttgtggcttcgagtggcaggcgccaatgggaggtacctctgggctgtgagaggctggtggagttgggacctccagacctagagattctgggtacagaagcctattactgccagacgctgaggcgttgccatgggatccaagggcgtttcgggtcagctcagagcctttctcagataattgtttcggtaactggggagctgctgtccagcgcacgcctctatgaaggcttaatgttctctcagattcctaagcctgtgactttgagtatcggtgtcttccttgcaatgtttcaatctgaggttattggggagagtgcagaattggagcccgatggaagactggtggggagagggcttgaccttgggaagggtggagacggagaaactaatgtcatccaaatgggtgctcttgtccatgtgaccaacctccagtaaaatgctcaacaccaaggctcagaagttggttaatggacacaaaaatacagttagatggaaggaacagaaaaatttttagtgttcaatagcac

SEQ ID NO: 478782 - DNA, 1117 bp, Homo sapiens
ccgcagacccctcctcatccttcccagggttgctctgaggccattcctcgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcatgccagaagtccccaggcaggagtgtggtgggacatccggctgggtctggataaagtgcttcatgcctgtaatccaagcactttgagaggctgaggcgggtggatggcttgagcccaggagtttgagaccagcatggaaaacatagagaaaccccatctcaatataagaagaagaagaaaaagaaaaaaaaaatcaaaaacgaaaacaacacaaattttagaaagaacacaatttaccctccggtgtgggaaggggaaggaggcagaggaagaaagaccccaagtccccctcatccccactgaccttcctgctggcttcatcctgcgtttgagtacttgcggtcatgatgacagggccaacctcctgaccagggctgttagcacctcccctgctgcccagagtccctgctccaaaccactttcttcatcttccgtacccccagccaatatttccctgcccagtgtcaacccaggcccagaaccagaccacaagggacagccccggaacccagaatcagacaaatcagcccgtcccaagctgtctcccctgctctgcccggctttcacagggaagccaacacaggctgtggcttggcctttccctagctcctttctgcctcctggtctgcctgcggcttccccctgccgccctgcggggcctgccacgtctctcatttctagcgaatgtttcaagagcgatgttagactttcctttcaatagcgttgacctctgttaggcacctttatggattaagacctgggcatagatgggttcttc

SEQ ID NO: 478783 - DNA, 1554 bp, Homo sapiens
ttctgctctctgcttcttacaattaactagtttgcaggactgtgtccagagttggttccttccggtgggttcgtggtctccctgacttcaagaatgcagctgtggaccttcctgtcgcaggtggcgtgatttgatttgtctgaaggcaatgaaaggatacacagatacaccgaagcctcccaaaagaatcctggttccaagactcaagaagatggattaatgtttttccattaattgttggaatttatgccattttttactatatgccatcaattttaaagcacttctgaaaagacataacaatctaaatgagatggcattttaaattcataaaaatatattttaaaaggaaacagcataaaactttggaaaatttgcagccaaacgatgtgatagaaaagaaaagccaattttctgaggagaaattcaagccagctgcagaaatttgcataagcaacaaggacccaaatgttcatcaccaagacaatggggaaaatatctccaggacatgtcagagacctttgcagcagtccctcccattacaggccaagaggcctaaaaggaaaaaatggtttcctgggctggattcaggggccccctgctgtttgccacctagtgacttgatgccctgcatcccagctactctagccatggctaaaagggtccaaggtacagcttgggctgtggattcaggtggtgcaagccccaaaccttggcagtttcacatggtgttgagcctgacagtgcagaagggaaatatggggttgaagcccccacacagagtccccactgaggtactgcctactggagctgtgagaagaaggccactgtcctccggaccccagaatggtacagccaccaaaagcttgatcatgcacacaggaaggctacagacaatgccagtccatgaaagcaaccaagaggggggctatgtcctgcaaagccacaggggtggagctgcccaaggccatgggagcccacttcttgcataagtgtgacctgtgacctgcattttttaattggagcctttagaattttctctatatgagatcatgtcatcttcaaatagagacactttcacttcttttccagtttggataccttttatttctttttcttacctaattgctctggctaggacttacagactttttcagaaaccccccaaaataatctaagggagtccattgtcagtaggcctgctttataagaaattctaaagggagttcttcaaactgaaatgcaataagactaattagcatcacgaaaacatatgtagttataaaaagtcaccagtaaaagtaactaaacagtcaaattcaaaatattcctaatactgtaatgatggagtataatcactttaacttttaaaaggttaaaagacataaaatattacaaataaatataactacaaaataaacaaagaaataaacgctgacatcaaaaaaacataaaaagtggaggggagtaaagtgtagggttttgtatatgcttgaagttaagttgctatcaacttaaaatagaccattataactataatcatacatttcttaa

SEQ ID NO: 478784 - DNA, 827 bp, Homo sapiens
ttttttttttttttttaggtttgctgtggcatcttccctcacctgaggccgggctggcctccaccatgttgcaaccagaagagcccacttccgtggggacagatcttccgtgctctccacagccacgtcacgctgccgctgtgcaaatgatgccaactgtaaatcccagaaaactgcaaaataatgctgcgccaggcacagtcggagacccagagaagatgtggagggagctcagaggctgtcctggaggagacgtggagacagttcagaggctgtcccggagaagacgtggaaagagctcagaggctgtcccagagaagacgtggagagctcagaggatgtcccaaacaagagagagctcagaggctgtcccagagaagacgtggagagagttcagaggctgtcctggagaagacgtggaaagagctcagagactcagagactgtcccggagaagacatggaaacagctcagaggctgtctgcaagaagacgtgcagagagttcagaggctgtcccagagaagacatggagagagctcaaaggctgtccacaagaagatgtggagagagttcagaggctgtgctcttctgaaggcaggtctcctgtccatgccttcccctttgctgtccggatggagattggagacgcagcatcatatacagctgacaggtgttaaccttattagctaattctgtttcacgggacacgatttatacattccatggaaatgcttctcactgcctttttttaccacttcaagtacttttggtcatattaatcagttgctctaaaatttcaacatggacattttgaaggtgcacagttg

SEQ ID NO: 478785 - DNA, 1087 bp, Homo sapiens
ctacaagctgagcagataaagaatctcagagagttcattctaaacaagaggcatgatctgattcgatcccacaatgggctgatgccagagctcaatttgattggatcctggatccttccatactgcgtctgcttcttaagtcagtccctgctccttggtcttctccttgatgtggaacttaaagtcaacaaatctgaaaccaacgttaatgtgttcctcaatacttcagtgaatacaattactgatagcaagtgtgcttccaaaccagaacagtcaacgactttgccttcatctggagaggacaacaaatatacccggatagtcataccccaggggctcactaaagccccctcttactttccacaagtcctcaatcaagacttaaaagttctaaatttcacttgtgattcagttttgatgcagtatatgcaggatcagatgatctccactgctttcttcagagaacgaggaagctggattcagataggccattataaaatatcagtgggtcaaccccagtttccaaacggaagtctggaaattccacctcagactggagcttccaaatgcggccacccttgattattcaggcagtctacctgggggagttactgactcactgtgtgaataatcagagtgagaattgtacaaatagaaaaaaactgtaagaaaaccatcaccaatagtttcatcaccaataactctggcagaagttattaatgacattgtctctattattacaagtaataataaccatatttctctagatttcttcttggctactcatggtagctctgtgttattgctaatacttctcactatatttgaatcaacgaaacaggcaaagtaaaacaggctctacatctcacatttccttatggaaaaaagataattgccattctaaggcagatcttcatggtctgtggcctatatgttctcttggtctggggtggaaaattagaatttctgcttctgtaacattttatagggactagtgattatttttgtttttgaaacccgacctttaagccaaagacagcctgacccctgaaaacccaactgccagttctaggtagagtccacaacc

SEQ ID NO: 478786 - DNA, 1477 bp, Homo sapiens
agcgcccccgcctgcggcccagagtgcactcgcgcctgcgccatctcccggaaaaatttcgcgccacgcagagatgacagccaaggagatgaaggcgaccgagagtgcggcgcagccggtgccgctgcccaagaaggaagtggatgtcagccccaaacaggatgaaggagtgctgaaagtcatcaagacagagggcacaggtacagagatgcccatgactggggacctagtctttgtccactacactggctggctgttagagggcacaaagtttgactccagtgtggatcgcaaggacaaattctcctttgacctgggaaaaggggaggtcatcaaggcttgggacattgccgtagcaaccatgaagtcctccaacgatctccccataacgccacgcttgtgtttgaaagatgggggaatcatccgcagaatagggactcgcggtgaaggctatgtcaagcccgatgagggcgctatggtggaggttgcgctggaagggtgctgcaaggaccagctctttgaccaacgggcgctccgctttgaggttagtgagggggagaacctggatctgccttatgatctcgagagggccattcagcacttggagaaaggagaacattccactgtgtacctcaagcccagctatgcttttggcagtgttgggaaggaaaagttccaaatcccaccaaatgccgagctgaaatatgaattatatctcaagagttttgaaaaggccaaggaatcttgggagatgatttcagaagagaagctggaacagaacaccgtagtgaaagagcagggcagtgttttttccaatgaggaagcacagaaggcacaggcccctccactggcctctcacctcgacctggccatgtgtcagctgaaactacaggccttctctgctgccattgaaagctgtaacaaggccctagaactggacagcaacaacgagaagggccccttccgccggggagaggcccacctggcggtgaatgactttgaactggcatgggctgacttccagaaggtcctgcagctctaccccaacaacaaagccgccagggcccagctggctgtgtgtcagcagcggatccacaggcagcttgcccggaagaagttctatgccaaaatgtttgagaggctggctgaggaggagaacaaggccaaggcagaggcttgctcaggagaccatcccactgacacagagatgaaggcggagtggaagagcaacacggcagggagccagtctcaggtggagacagaagcatagcgcctctcaccagccctactcctgaggctgcctgccccccagcctccccactccaccctgttagttttggttatatccaaaaaaattgctgatcaaaccaatatcttggatcattttctctgttttcatgtaatagttttacagtttcaagtcttatatttaagtctttcatcaatttagagttaatttttgtatatggtatgatat

SEQ ID NO: 478787 - DNA, 1427 bp, Homo sapiens
gtgcattttcctgctgattagtgatggcaaacatctttttcttaatatatacctattgtcaatctctttggtatgcctttatcagcagcatgcaaacagatgaatacagtaaattggtactggtagagtggggtgctgctgtaaagttatccaaaaatgtggaaccaacttcggaactgggtaacaggcagggttttaaaaggaaacagcataaaactttggaaaatttgcagccaaatgatgtgatagaaaagaaaaacgaattttctgaggagaaattcaagccggctgcagaaatttgcataagcaacaaggacccaaatgttcatcaccaagacaatggggaaaatatctccaggacatgtcagagacctttgcagcagtccctcccattacaggccaagaggcctaaaaggaaaaaatggtttcctgggctggtttcaggggccccctgctgtttgccacctagtgacttgatgccctgcatcccagctactgtagccatggctaaaagggtccaaggtacagcttggactgtggattcaggtggtgcaagccccaaaccttggcagtttcacatggtgctgagcctgtgggtgcacagaagtcaagaattgaggacagtgcagaagggaaatatggggttgaagcccccacacagagtccccactgaggtactgcctactggagctgtgagaagaaggccactgtcctccggaccccagaatggtacagccaccaaaagcttgatcatgcacacaggaaggctacagacaatgccagtccatgaaagcaaccaagaggggggctatgtcctgcaaagccacaggggtggagctgcccaaggccatgggagcccacctcttgcataagtgtgacctggattttttaattggagcctttagaattttctctatatgagatcatgtcatcttcaaatagagacactttcacttcttttccagtttggatgccttttatttctttttcttacctaattgctctggctaggacttacagactttttcagaaaccccccaaaataatctaagggagtccattgtcactagacctgctttataagaaattctaaagggagttcttcaaactgaaatgcaataagactaattagcatcacaaaaacatatgtagttataaaaagtcaccagtaaaagtaactatacagtcaaattcaaaatattcctaatactgtaatgatggagtataatcactttaacttttaaaaggttaaaagacaaaaaatattacaaataaatataactacaaaataaacaaagaaataaacgctgacatcaaaaaaacataaaaactggaggggagtaaagtgtagggttttgtatatgcttgaagttaagttgttatcaacttaaaatagaccattataactataatcatacatttcttaa

SEQ ID NO: 478788 - DNA, 548 bp, Homo sapiens
agttaacaatggttattttcacatttgaatcttggcacaaagccggtcccattgttccaggctacagacccaccttcatggtctcaggcaccagacctgttcccatggaatcaggctcaccccagcaccagttcagcttccaggttcgccccagcaccaggtcaacctttgcatccccaagctgcaggccaatacctgcaccaggcaacaggcccatccagagccatgctggcacccacaccttcaagctccaggatggcccctgcagctctaggctccagcataaggtcaacccctatggacccaattccaggcctgttttcatggtcttaggttctgggcccacccagtaccagaatagcccctatgaactcaggctcaaggaccttcccagtgccagattggcctcatggactcaggctccaggcctatccctgaagaccaagtctactctcatgggctctggtaccaggccagtcacctcagacccaggagccagtccacacccacagacccaggatccagacctacccatgtagacccatgct

SEQ ID NO: 478789 - DNA, 653 bp, Homo sapiens
cgggcacagtgttagtgtgtgtgtgtgactgtgtgtgtgtatgtgtgtaggtgggtgtatgtcatgctgaacatcaagaacttggcttcattgaaggtgtcaggcaggctgctggccaggaaagccaagatgaagctccccagtgccaaaaagagagttacttggataaggaaacagatgaaaataactgtgctaaatactcccagtccccaaaaccactttggctttctctctgatgctgtagccttacaggctataagcacagtgatagttttagctaacgcagttgaaacaaccacagtaaaaatgattccaaatgttgtctgtcagaggatacaagtgactgtgtttgtacagccagtgaagagcaaggagcagaagaaaacagacagagaaatgtcgctgagagtcttgactatgagtgtgtggtggggacacagcgaaaccataccaatggcagtgaggacagagaaacagagagctatgctggccagtgctgtccccagtgcatcttcaaaatccaggaaggtcacaactctgactaaacaatgttaacattagtcatcttaaagcacattgtccacctattcatatttcatgaaattataagatgctacaaattaactcattccagtttagcagtatttatcccc

SEQ ID NO: 478790 - DNA, 1585 bp, Homo sapiens
gggtttgaattccttaaacatgaagactataattaatctccacttcaattcaccaaatgcgtattgaatgcccattgtggattggtcactgtgtcacaccaggggtacagaaattaataatatggaatccccgagcctgaggaaatcagtttaccgtgaaaacaaatgtgcaaacaatcctttacaatgggcttatataaagtgggtggagccatcatgttatggagtcattgaaggaggggcagaattggccaatgcattggatgcttcagagaacctggaggttcaagcaatggtgaaaggaggaccaaaacaggtccagggcaaagcaagcttgatggagcacttgccagcagccaactgcacaggatttaagatggtacaactgactcaccctaaattcttgtgtgagatccaagaaccctctcttggggtctggatccagacctctttctgtaacactagctctgggaagaatcctaacttaacactgtcttggtaaaatgcagtctttgtatgtgtgggtgtttttctatgatgtgcagcaagggagaatataaatataaatataggtgatttagatatatagataccatacaagcatggtatatatacatctgtactttaagagagcatacccggtaaagaagttgcatatatcaagtaacaatttcatcagtttgtgttaatcgaagtatataaacctgctactcagagcctccaagtgaattgagttgataaaggctctctgcctcttacacttcgggtcacagagcccagggagagtgtagagcctaatgaagagtgtgggctttagagtcaggctatctgggctggatcactgtctctttcattaccatctgtgtgccccagggctacttacttactcttcatgaatcttggttttcttgtgtataaaggagggattttaataatagttacttcataggattgttgcagtaattaaaaaaagatagtgtctgagcagcacttgattaatattgggtactcaccatgtgataggcctgtctctaaagacttctaacagccttatgtgtaattatttcatttaattctcccttaactgagagatccacaaaggaaatgttggaaatgcaaatatatgaaagaccaatacaacatgacgtctggatttctaagatgcaatacattttattctaattcttctgtgcatttaaaaatagcacagaataacccctaaaagtgagttctaaaaggtatttaaaggaatacttgtgaggaatgctattttttaatgtctttatttttaatgaacaatgactcatttcataaataaaattgtctctttctctagttgtttcctctgaacaaagaaggcttatgttataaagcagaattatgctagattaagagcttctttacctttttctggaaaactatatgttgtaagtctggaggaatatattaatgaggaaatgaacctcaaatgagagctatgataatatgaaaaagattttagttataataatgattgttaacactgattagttgctcatgtttgtatagtaacactaagcactgaagtaagtacatgtgatgagac

SEQ ID NO: 478791 - DNA, 448 bp, Homo sapiens
tgagttcatgtcctctgcaggaacatggatgaaggtggaaaccatcattctcagcaaactaatacaagaacagaaaaccgaacactgaatgttcttactcataaatgggagttgaacaaatggacacagggaggggaatatcacacactagggcctgtcagggggtggggggatagcaggcatggcttgtttggctatgagaggcaggaatgggtagaattacccattctgccatctgagtgtttcccagcacaacggaaagctgtgcctgacaacaaccaatattccgactctaagggagttctggaggttgggaagcccaaaaccaagatgctggcagatttggtgtcctacagtattgacacaggaagagctggtgaatattgcgtagctcctgtcatgaaaatgtttctgggtccttagaatgcttcattatattagtgaggag

SEQ ID NO: 478792 - DNA, 714 bp, Homo sapiens
tttccaaggtgggttgctctacagaaccatggaaattgtcaccaagtgccacagatgcaagacagtggtcctcaacaaaagtacttatatggaggttcacaaagactttctaagggcatggataatgttaaggatgttttcacagccacacgtatcctgtgaattctttcctaaaaaacggtctgtagttacaaagaagccatgcttttcctccacctggaatcttaatatgaagcattgtcttggagggaaaaacacttcagctggtgtaggcgtggaagagggagagtttcatgtctggtataaagcctgtattctcctttccttttatcacacttgtggagagtattataattgtcatattagtttctcatatattacaaatgtaaatgaaaatgagcaaactgaagttcaaggagccagtatggttttgtataagggcttgagttttggagtcaaacagaaccaggcttgaattctgtcttagtaactatataaacttagacaagttacttgagtttgctgattcttggaattttctttcatggaatggagataataataattacttgctaggaatgccatggaggttttaattaaaattgtatatttttaatgcccgatgcttgtagattttatacaatttaacactttgtcactttctgtgataccattggtttttttggtgtaaatttttatttgactagtctgtgc

SEQ ID NO: 478793 - DNA, 1311 bp, Homo sapiens
gtgaacaaagtggccatggtggcagggatggaggttattcatgggcaacagggacttccactcaccaaggctgacctggctacagccactgctgagtgcccaatttgccagcagcagagaccaacactgagccctcaatatggcacagttcctcatggtgataagccagctacctggtggcaggttgattatattgaacctcttccatcatggaaaaggcagaggtttgtcctcactggaatagacacttactctggatatgggtttgcctatcttgtacacaatgcttctgccaagactaccatccatggactcacagaatgccttatccactgtcgtggtattccacacagcattgcctctgaacaagatacttactttatggctaaagaagtgtggcagtgggctcatgctcatggaattcactggtcttaccatgttccccatcatcttgaagcagctggattgatagaacagtggaatggccttttgatgtcacaattacaacaccaactaggtgacaatactttgcagggctggggcaaagttctccagaaggttgtgtatgctctgaatcagtgttcaatatatggtactgtttctcccatagccaggattcatgggtccaggaatcaaggggtagaagtggaagtggcactacttaccggcatctcagtgttaccataccccgtggttaaggtcgatgggaaactacagcagcccaatccaagcaggactataaatggcccagacccttcagaaatgaaagtttgggtcaccccaccaggaaaaaaaaaccacgacctgctgagctgcttgatgaaggcaaagggaatacagaatgggtagcagaagaagatagtcatcaataccagctatgaccacgtgaccagttgcagaaacaaggactgtaattgtcatgagtatttccttcttttgttaaaaacatgtttgtgtaggtgtacacttgtactaagaaaatatcttcattttatttcctttttcctttatcatgtgacataagatttattgacttcatgtcagcatttaagtattgttaactttatgtaacagcatttggattggggaaggatagttgtattatgttaggcggaattctgatcttattgtctttatttgaagattacgtatgttctcaggagatgtgtatgggttcaagttgacaaggggtggacttgtgatggttaataccgagtgtcaacttaattggattgcaggatgcaaagtattgatcctcggtgtgtctgtgacagtgttgccaaaggagattaaaatttgagtcagtgggct

SEQ ID NO: 478794 - DNA, 620 bp, Homo sapiens
cttcaagctgggtgaagtgtggcatgcctgtagtcccagctactaaagaggctgaagggcaggagaattgcttgagtccaggaattcaaggcccatgtgggcaatacagagaagcaggccaggcagtggggaccaaatcagcaatgagcagcacagtcgctgaggaagccacaacagctgtgaaggcggatggttccagaccttcactgatagagagaccagctcacagtgaagacccgtatcatcgacctgggcaaatagtgcaatcttcaaaacaaaaatactttactcaattattttgcaatggacttagctacaagctctattggtttctttgctcgccactgtttttcatgtcctatgtcttcctcttttcccacttctcctcctccttcaccttctttggggacgtctttgagtatctgtttcagaaagtattcctgggtggtcctgatattaaacctcagtaatacattcagaatattttttataactcaggtgcagagccttaaatgtctacccattacattgtacattgttaaatttagtctattgcatctaccctcccttagcatataactccagaaaacactagaaatggctttctggagaccagctct

SEQ ID NO: 478795 - DNA, 734 bp, Homo sapiens
cttgcatttgagtgggtggaagacagtcattcttttgacaataagacaatgcgtgtaaactgcaaagctttaacaaagttccattttccggctcttgcaaagcttcagacctctctgataccattggaagaaaacccttctaccccctgttctattacccaccctccaggaccagcctgctgcaccaatacctgcaaagactcatctgaaaatgagaagaatctaaaagctgagggtatgcctgcaggaccaaacttgacctaccagggcagaattccagagggagatagtagaggaaattcacaaataccaactacaaggaggagagcgatgaggcttgacagaggaattatgagtgttttcattggagaagactcaaatgagtgtgaggttgaccccaaatatttgaatgattatcacattgatagggccatcacactgcccaactccagggacactgtttacacagtagtctacgtgaaaagcagcagacgcccacagctgagcaatgtgcagtctgtacaactgaaagcacttgtcctgcatatggcaagtgccactgaaatcaatggaattgatcagtttctcccagatgatggtcatagcaaggcattagggcagccagatttggatcctcatctctagataccaaactatgagctctgagctgtgtctggactcttcatttggtgactgaattgtcctagctgggagggactgaaaatcaaaagtga

SEQ ID NO: 478796 - DNA, 770 bp, Homo sapiens
aaggtttgatcaaacaaaaggctgcggaaatgctgcatgaggagctgaatgttaatagccaagacaatggggaaaatgcttccagggcatttcagagatcttcgcggcagccctttccatcaaaggcctggaggcctaggagataaaaaatggtttcacaggccaggcccagggtcacactgctctgtgcagcatcaggacatggaaccatgcattgtggccactccagctccagccacggctatcacaggtgaagatttcagagaatgtatggaaatgcctggatgtcaaggcagaagtctgctgcaggagcacagcctttgtggagaacctctactacggcagtgcagagggataacatggggatggagccccctacacagtggagctgtgagaagatggccaccatcctccataccccagaatggtagatccaccaacagcttgtgccatgcacctggaaaagtcacaggcactcaacaggccttgagagcagccatgggaattgtaccctgcagagtaacaggggcagaggtgcccaagaccttagaagcccaccctttgcatcagcatgccctagatgtgagacatggagtcaaagattattatggagctataagatttaatgactgccccaccaggttttggacttgcatggggcctgtagcccctttgtcttggtcaatctctcctccttggaatgggagcatttacccagtgtctgtacccctgttctatcttggaagtaactaacttgtttttgacttgtg

SEQ ID NO: 478797 - DNA, 953 bp, Homo sapiens
ctagttgaaatattctctgggcctccgggggtgtcatcacatattggtaggaccatgatggcaaccctgagctgcaaaaccggcaagtttttattagggattttaaaaggagagggggtgtacgaacagggagctgtccctggcttgaaggcggggtttcactggggacccacccctttccgcccaggagcctatctgcttcctactgccatcaacttgccatccacagcacccactgtgcccaggatgttcatgcagtgggatgtctgcaggcccacgctgagctgccccaagttctccctcagcctccctcctatgggtgctcaaagtctggagggggtcaaggctgcaggaggctggcatgtcagcattgcaagtacctgcacacgtggccagtttgcgacagtgcctgggcttggcctcaactttgctccgaaatcggagcaggcgctgggagcacagagaggccaggcagcggaagcaggtacttctgagcctgtggggacagggggcttcttggacccccagagtgcagggatgccctggtccacagtggggctgggcggtggcagaggcacctgggaaggcgccaccaactcagaagggggtggggctcccgcgtgttcccagtacctctgcctgctcccagccagctccacagaggatgcagcccccaccgcacctccctccgctgcagccaggcgtcttcacagtggccgctctgggtgggctgccgctgccatcacttataaaagagcctatgaggccatgcacagtggctcacacgtctgaagtgaattctagacaggaactatctcaaggctgctgttattcaaaacctaagtgtttcatatgaacatgaagctatttagtgggaaaaatgaactacaagtagtttgatggaagaagcaagtataaaaaagcttagagctttacacagtagtgatcagaag

SEQ ID NO: 478798 - DNA, 2248 bp, Homo sapiens
agcagccaaacaggatttctaacaaatatgcctcttttcttgagttaatgtttcttatagccttgcattggtgtctgcatatttgatagagcagtcgcctcttccaaactttacagactggctttgatactcagatttctttctctctttcctttttcctttcctttccttcttcctcctccttcctcctcctcctccttcctcctcctccttcctcctcctccttcctcctcctcctccttcctcctcctcctgcttcctcctccttcctcctcctcctccttcctcctcctcctccctcctcctccacctccacctccttctttctcttcctacttcctcctcctcctccttcctcttcctcctcctccctcctcctccgcctccttcctcctcctctgcctccttcttcctcctctacctcctcctttctcctcctcctcttactactacagttgcatagtgtttgcttcaggaagcgtgcttgagtcatagttgatgggtctctggtccagggacagtgcagaagaggctgaaaattgtgaccctggtcctcccggtacagcagcacttagcctcgtttttaaagacttgttgaatggctttgaccaaaatgctgatagtgacatggacaataaagtccaggctgtggtggtcttagatggacaagaggaactttctgggaactggaataaaggtctctcttgctatgcaaagagagtggtggcattttgcccctaccctagagatctgtggaagtttgaacttgagagacatgatttagggtatctggcagaagaaatttctaagtggcaaagtgttcaagaggaagcagaacataaaagtttgaaaaatttatcccagaatggtaaagccactgacaacttgcacccagcacctggaaaagccacagacactcaatgccagcctgtgaaagcagccaggactggggctgtaccctgtaaagccacaggggtggaaatgatcaagaccatgagaacccacctctttcatcagcgtgacatggatgttagtcgcaaggtgaaatctgaaactgtatcaaggagcttttatactcaattatgtgaacaacctattggtctattttgtactttgaatggaccttttatccattcatgatgttagagtattgattcactgagttatgtagatctttcaaatgttgacacattttattatgtaacattgaaacatcaaaaagatttatatcaacaccaatctcagaaaaacaatttaagtaacttaaaggtagaaatgtctttaagtacaatggtacaggtacaatttttccaaagttgtgatttttgcttgaaagctcaaatattgtaattagcaataaacactgtcagttgtttttcttgaggtgatagtcttgcttttttaattttcaagaaagatgcctgtcaaacaaccaaatctggataagaatatttgtctttcagttgttctttcaagttaaaaaaaatcatgttccatgagaaaaaaaaaagctagttcagctcgctactcaaaattacacaagtgtttttcttcaatgaatatgttactttggtatgctttttaacgcatgctgccaagttcattatacagaatattaaaaagtaataagatttaataaaattaatactttttgctgcttcatcacggacatctgaaagtgaaactggctttccccttgtgaatgtgtggcagtaaagaatacaatgactgctagtctcttagtacattttggtgtcctgccttgatttatgccagcagttttgcccaatattgcttttgtaccattagttcaaaagtcaatgcagtgaaaaaggcatgatatcttagtattcttatgaaaatcattttttacctatggaccttccgaaaaatcaggtctcagggattctaattggtatatagaccatgcaatggattctcgtcgactctgcctcaactaaggtattggggaaagtaaaggtcttcacttctccacttcacttcttgaaaatttctccagtactgatacggagctgcaacaagctgttaagttcaacgccatgacaggggctgcccacagaacctggagttacaacctgctgttctggatattctttattcctagataagctaaattatcaggaataggaaaatgagatccttataaaacctttctttcaggtgctaggaggatgggaggaggaacagcaggaggcatggactgatgttttgccaagttcctgcagcc

SEQ ID NO: 478799 - DNA, 542 bp, Homo sapiens
ctcggatttaggcaactcgaagtcctgatcgaatggagccaatgttaaatttggagataaatgttacaaatctcaccaccaggttcaagtttaaaatcccacataagaaaataacaccgaaatctggacaccagccattggacttaggacctgccctaaaccaagatgatctcatcttaagatccttaattatacctgcaaagtctctatttccaaataaagttatatccacagatggaatttctggagactttttaatgaaggaactatgtacacagaccacgatgaaaggaacccaaaggaagctagcagcaccctttgacctgaaggtgcggaggaaagaaatatcagattctggttgtgagctgctgctctggatcatggattgcccaacaggaactgagcagcagcagttctccttgccaggactgtgcacaactttgtcatagcctgcatcatctggttgtggtggttgtggtgagagcaaaatcatatttatgtcctcacttacgtgatcttctccagtgagaacttggtgcttg

SEQ ID NO: 478800 - DNA, 1811 bp, Homo sapiens
cagcggatggcggagccagaagggagacggttttctcctgacatgacttgctccttcttgccttcggccatgattgtgaggactccccagtcatgtggaactgcccaagtgctctacaatcagcaggtagcaaattcagccgaacatgtgtccttcccttcaagctggcaagttctcccttgccctggtggtccagagatgccatctgggagccagagcctggacacagggaaggagcttctcctagagctgcaagctgcactgcctgtagttggggaagtttgcccaacacatgaaaggtcttgtgaacacatctgtgttcattcttcttataatggctgctccttggacaacccccagcctaaagatatgactgccagaggcactgtccactcaagggtagagggactcagaaaagggccagtggcagagctgaaattctggggcccctcatatctgaaatatggtttaaaagaagggagtcagtttctagagctcagaggcatgaaagtctgagttgtggaagaggacttttctgactcacacctgtgggaagtttgagctccttattacacctggtgagggagaagtctaggatccacactcggtctttgctggcgtgggtggagaagaaattgatataaaatgtatacaatgaggctaaagataataaatatggagggtagatctagaacatacattgtaacaggattcccaagaaaaactagactgttccaggatccacactcagtccaggtggagaacaatcagtagaagacaaacagtagaacatacttgacaattcacaaactgcccaaaaacagctggtaaaaaatctgaaaagcaaacaatatctgcaggaatttaaaagaaaaatcaaatttaaacagggagctaaagtttctcagttatcaaactggctaagaattaaatttgatgacatgctaaattagctgaagtatcagaaataagcactttcaaacattgctattggttgtgtaaattgttgcaagatttctggagggtaattttgtaacatatattaaaattcctaaaaaggtttattgcatctgacctaattatgttagttctattgctgtatctgcaggaaatagtaaaaagatctgtgtaatgatttagctatagtatgtcagttttctatataattgcaaaaaattagacacaattatattagcaaagtccttggaagtatttactgtgtattaggtacctttctaagccttttctacttattaaatcatttaatctttccaataacctatgagcttggtgctattcttattctcttttcataaatgaggaaaattgaacacaaaggggttaagtaaattgctaggatttgacaggcagcagactcagccctgagtccatatatttcaacactccatctgctgcctgtcttgataacacttacgcaacctccatatacatttgataacatgtatgcaacatctaatgatttattatgtcatcaccaaaataatgcacacattgatatttaaaatataaaaaagttctaaatttattgttaatggaaagctgttaggttagtaaataatacaaaacaatcttagaaaaaaaatctaagtgtagatttttgaagtgtagaatatttatgtcaaacaattaatgatttttcctttagggctgtgttgttctggaatcatcttctagtttctgttgtgaatataatgtattacctgttaatgctaagtttggccaagtgccagataaattcacagttattgcaataagaaaatagatctttcataagaataactaaattttct

SEQ ID NO: 478801 - DNA, 1560 bp, Homo sapiens
ttttttttttttaaagacctggaatataggaaaaccccttggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcagcttggccatggggacaacagagtgtgtgcttctgggcgtgatggcctttgaccgctatgtggctatctgcaaccctctgagatatcccatcatcatgagtaaggatgcctatgtacccatggcagctgggtcctggatcataggagctgtcaattctgcagtacaaacagtgtttgtggtacaattgcctttctgcaggaataacatcatcaatcatttcacctgtgaaattctagctgtcatgaaactggcctgtgctgacatctcaggcaatgagttcatcctgcttgtgaccacaacattgttcctattgacacctttgttattaattattgtctcttacacgttaatcattttgagcatcttcaaaattagctcttcggaggggagaagcaaaccttcctctacctgctcagctcgtctgactgtggtgataacattctgtgggaccatcttcctcatgtacatgaagcccaagtctcaagagacacttaattcagatgacttggatgccactgacaaacttatattcatattctacagggtgatgactcccatgatgaatcctttaatctacagtcttagaaacaaggatgtgaaggaggcagtaaaacacctactgagaagaaaaaattttaacaagtaaatgagaaagatacacaaataccattgtgacacaattgcctatagtgttcagtacagtagcatgctgtacagctttgtagcctaggagcaataggctatgctatgtagcctcagtgtataataggctatatcatctaggtttgcataaatataccctgtgatgtttacaacataataagatttgacaattatgcatttctcagactgtacccctgtttttatgactgtaatattttttcatgctgaaatctccatgagtctaaagaacattactctctgtaatactctttaaatttgcagacatgtagatttgtgtctagttttcctagaccccatggaaaatgttggtcagaaacatacagtttttaaagtatttagctgctgttacattttggcagaatatttaataaatagatccatacttattaaaaaaagaggtatgctcagtttttaatgtttggatccagttagaagggatgtcagcttattgttaataacactgactcaattagtatagataaccttttcatcttctcaaaaaaaagaaagctttatcctcaagtatattttttcaccttaagttttcaaatgcttcgtgatatgagttcc

SEQ ID NO: 478802 - DNA, 641 bp, Homo sapiens
gagaacgggccatgatgacgatggcggttttgtcaaatagaaaggggggaaatgtggggaaaagaaagagaaatcagattgttgatgattatgctggtcacctgcaggctgcacttaacgttgcaaagggctacaggtatgagctggtatttgctaagatcttggattttgaaattcatagagttccatttgaggatctatggactgtggagtttgggaagtttcttgtgacctattttcaaattcagattctttccttgtctatattgagtctaatgatgagcctattgggagccgaacctattgagaagtggctgcaggtggagcctatagacatagagagtcacagctacagccagaggcatggcaaggaaacagaaaaggagcagataagaaaacctatattctctggcttcctccctttggattgtctgcctgcctgtgcctccagcgtccaaaccaactggaagattttggtcagggaagcctggtagatggagtccatcaatgtcagactcccagggaaagtgcagaggagggaaaggcagagaatgaaccttggagaagtataggggaaatgcaaaacaatcagcacaatgtcccagaaaactttagcctcattttgaccatttttcatttcc

SEQ ID NO: 478803 - DNA, 506 bp, Homo sapiens
tttccttaccctgagacggtctaggttgaggacatgggctttgataggaaaaggtagacactgtcctctcctgtcattatggctctctctctctcctgccagccctgtgaagatgtgtctgcttcccctttgtcttctgccccgattagaattcattccaacgctggaaaaggaggacaagaagaaaaagagaaaataggtctaaagctctgttttccagtattgcatgacctgacctcttcggctttggcgtaccagagattaccttgtacggatgtgagacttcacaacctgctaaaaatgaactttcctaataactcgggacctacccatctaggaataaaccatcctattcatgacagccaactcaccagggtagcagggaagaagggattcaggatagccactctgagatatcatacatgtgcctctgtctggggcatcttatttttactcctctgagaaagggcatatgaggcaaggcctaagtagggaaatttgaaatg

SEQ ID NO: 478804 - DNA, 829 bp, Homo sapiens
tttgcacttcccgggtgaagagatgcctagccctgctttggctcatgctcagtgggttgcactcactgtcctgcacccactgtccgagaagcccctcagagaaaaagtgaagatggaaagctccctggccattagcaaagctagagaatcttatgaaaacgacttaagagggttgtgtgctgctggctgtgatagaaaatgcttcttttccttccctgtggaagcttcagtaatatctatgttgctgacggttatttctgctggtaacgaaataagttctaagtcctggctgcaggaatgtataaagctgagaaatagagatttgaacaacagctccataaatttaacaaaggtcaaaatcttggtcaacaacaggcctcctactggagtttcagaaaattgttaccgagcagtaccatcggtctgtctcaaacaacaatctctcatcgccctcaacctaccacaggacttctcaaggttctcatctctttctctgccccggcataacttcaggacaaaaatgggaatggatcataaggacacagaagtatttcacaatttcacacaactcaatagcaaaaaatgcacctgatcatcacaagggtctggaaacagaaactggggagaagactagattctaaatgtcagtatgaggagtccatcagggattgcaatctgtcatggctcctaactagtctttgtgacagaaagtagaatctttataattttctgagagattttctcatctcattaaaatcttcttagagagaagcattggaaggcatacattggaaggagataaggttaacatgggcattgtaaaatattt

SEQ ID NO: 478805 - DNA, 579 bp, Homo sapiens
aagtccctgcagcacagggagaacgaggagaggtgatattaccggaatgaagccgcagaccctcgcggtgagtgttacagttcttaaagatggtgtgtccggagttagttccttcagatgttcacatgtgtctggagtttcttccttccggtgggttcgtggtctcgctgatttcaggaatgaagctacagaccctcgtgaagacactgaaaagcctcatgaaaattcagcagaggacatgctagacgctttaatttatttgaaactgtcatatggaaatggattaataaaccaaacaaagatgggagttttgcagtatcagaggcttccacctagaatttcacgctatgacagatttcactccacagatccaatgctctgctcctcatggccccacttcctgtgccctcctgaacacctatcttgtactgaccccaatatgagtaactcagcagcctcctttaaccatgtcaaaagtttttacccataatataaatgtttctgttctccagtgttgaggcagtccataaaacatactcagcattgttatttaaagttcatcttgcccaattccttggt

SEQ ID NO: 478806 - DNA, 1211 bp, Homo sapiens
aggaaactgaagattatagctgttatgaatgttgtgaatgctcagggcctgaatctggggggcacttctcctgtggagctgtactcaccctggattgttccagagagactgtctataggtgaatccatgctgcattcctgtgggagaagccccagctatgtctacggtggactgccaggggtatacaaggaccccttttccaaggccctttatggttacaggggctgtctgcctaatgtggttccaggagatcagagtttaccgtcccctggagtaaacagttgctggtttgagcacttcagtgttgtcttggaatcatgcaaccagaaggactcggaaatatgtagtgccctttgtgggcagctctcattggtatggtacaagagttgtattcaatcactttgtcagaacaatgacagctgtgagaaggagcccataaagctattcattaaactctgaaacagctagcactttacttgtctggagttatttactagtggttgatgatgacactgttgactccatctcttcaacttattcttttatattttctgagacattttctcatttctattttccaaccagtagggtagcttggtagaagaaagttgtgtgtgtattgtttttcctgagccatttcagaccaagttagaaatatcatactctatgacctttacatacttgattatacatgtcttaagaacaaggacctctcctttataaccacagcacagttagcattttcaatatcaggagattttctaatatttaatattgatatagtactattatttaatctgcagttcttagtcaaatttcatcaattacccccagaataacattatagctattttgggcgggggaggatatagtccaggatttaattgaagatcactcattgcatttttttttgttatgtctttttagtcttgtttcaactagtaaatatagcctcacattcttctgtgtatgtatctagacctttacatttttgactagtacaggccagttactacatagaatgtccctcagtttgggtttgtctaatactttctcatgcacagttttagcttacatacttatcaggaaacacgtgctgtgagttagctccattacgagctatatgggcatagaaagttcggtgtagaaagttgtttacatgagcttcacaaatttttgaaaatgttagtgtttgatagacaattcttaag

SEQ ID NO: 478807 - DNA, 680 bp, Homo sapiens
accgaagctgctgcagctccctccttctgagtagtgatgatgatgatgatgatgatgatgatgatgatgatgataacaatgatgattgatgagtccaggttcctgaaaaataccttcagaactgcatgtgcttgtccacacgcccccccttccccgccaccccaggaagacctacttgtacttatacctgaaggcaaagttgaggacttaagtgggaaagtagcgaatggcattggccagattgcccacccagaagaacagcacaccctgctccttgggtatacggaccatgcagtccatgatgccattgacccacttgtcaggcatgatctgctcactggcacgttgcacctgcagcagcagcttgacccactcgctgggggccacggcatcatggagatggctgcaatgctgtatggctcagaaagtgacacccgtgaactgtacacaaagacgcaaaggaagtcaaagaaatgccttctagttcactttcctccagaaaaaagaaatcccaaatgaaggccagaaaattatgggactcaaacttagttgcaatcttgtaatggttatcagagactgatagctttgtgacaatctaaagaggtttaaatctggagagatcgttgggctagaggtataaaattgacagtcatcagaacagaggtgatatttgaaggcat

SEQ ID NO: 478808 - DNA, 1003 bp, Homo sapiens
accccctgactattagaaataacatcatagaggggtgtacactttctgcgatattgggaggagtgttcacctcttctgtgatattgttcctagtatccggagggggagaggatgataataattccactattgcaggctgtgttcacccaccctgtgatattgttattaatatcctggaagggagaggatgatattactccccatagagcaggaggtgtacaaccaccctgggatattgttcctaatatgcatggagggaagaggctgatattactcccaatatggcagggggtgtacatccacctggtgatattgttcttgatagtcaaaggccgagaggttgatattactcccaatatcatagaaagtgtacacccccgtgtgatattgttcctgatatccagaaggggagaagatgatattagtcctcctatcacaggaggtgaacacccactctgtgatatctttcctaatatgcagggggagagaggatactattgttcccaatattgcagaagatgtacacccccctgtgatattgtccttaatattccaaggcggagaggatgttattactcccaatatcccagaaagtatacgccccccagtgatattgttcccatgatccagagggcagaaggtgttactttcaatatcgcggggggtgtacatgcctccagggacactgttcctaatttcaatgtgggagaggatgatattactcccagtatctcaggggttataaacactcctttgatattattcctaatatccaggaggggagaggatgatattcctccctatattgccgagggtgtacacccgtctttgatattgttcgtaatttctagagagggagatgatattactcacaatatcataaacacgctgtgtgttcaccatggatcataatatccaggaagcgatattactccccacatcgcagggcgtgtcatattgtttcttatatccggggggagaagatgatattactaccaacatc

SEQ ID NO: 478809 - DNA, 960 bp, Homo sapiens
tgtacaaactttgcgatattgtgtgtaatattaacctctcccaacctggatattaggaacaatatcatggggggtggtgaacaatgtcccgagggggtgtacaacccctgcgatattaagagtaatatcatcctctttcaccctggaatttggaacaatatcacagggggagtgtacactccctgcgatattgagcgtaatgtaactcccaatttgaatattagaaaaaatatcaggaaggagtacaaaattacaaagtgggtgtacactccctgcgatattggaagcaatgtcatgctctaccccctaaatattaggaacaataccacagggggtgtgtacaccacctgcaatattggaagtaatgtcaacctcgttccacctggatattacaaacaatatcacacgggtggtgaacaatattacattgatgtgcacattctttgtgatattgaaagtaatatcatcctttccgccccctggatattacgaagaagatcacaggaacaacatcataaggggggtgtacaccctcttcgatattgggaggaatatcatcctttccttccctggatattaggacaatataacagggttaaggaacaatattacaagggggtgtatgccccctgtgatataaggaggaatatcatcctctacctcctgggatatttggaacaatatcacaaaagggtgtacacccaatgtgatattagtagtagtatcatcctctcacccctaaatattaggagtaatatcccaaagggaatgcacaatccctgtaatattgggagtaatgtcatcctctaccccttggatattaggagcaatatcacaggggttgtgtaccccaccttcaatattggaagtaatgtcaacctctccccacctggatattaggaacaatatcacggggaacaatataacgggggggggtgtacacttcctcggcattgggag

SEQ ID NO: 478810 - DNA, 554 bp, Homo sapiens
ttcttgatatttaatacaatttactaggacgtgactcatcgatgggtctcctagatgaggatttagatgctctgtgggcagcagataagagtgcagcctacttgcagaaagtaaattcattgaatactccccataaagtcaatactgtcaggcttatcagctgtcctcatttcccactctgctccctggggaccagacttgaaataaaaggccccagctccaggcgcttagaatctgtttctgagacttacactgtagctgatgcagactggtttaataagatacaacctgtgactggctcccctcccactcattgtccctgtgctctctgctgggattataggcttgcccaggcctcgtcagccagcggtccctgcctgagctgtcttatccaggcagcagaatctgtctgggtggaaacgaggaagagtgaagacaaaatggccttgtttttattatggtccagaaagccactggagtcccaagccttctcgtagaggtaaatgtagggtagaaggtcagttgttagcacaaactactctcctagtacaact

SEQ ID NO: 478811 - DNA, 482 bp, Homo sapiens
ccagccacctcctacagaaaatccaaggtgactagggaatggagcaggccctcagcatactgcagcagccctacggaaaagttgccatacttatatgggtgtccgttcccatacttccttactgggaaggtcctccaggcctgggtctccagccaccctgccaccagagctatcgagtcaatggaagctctgcaactccctggacagaaccctcaggggcaactgaaagctctctgccaccaccttgccttatccacacctccagcaagctgcagttaacccaaggagaggaggtcaatcggtgtcccacaggaacccctcccccaccgatctgctcatcactagacagggaacccctgtcccacagcatagactctccatcctggagtgattgcattgagcgattgctgacctgcatcactctggggtggagcccccagtagacaagcaaaagacccttgaccacaaccattactaaggtc

SEQ ID NO: 478812 - DNA, 860 bp, Homo sapiens
ctgtgaagagataacagcaaaagagaagcccaggtagcggtccaggccacctgtaggatcatctgcaacttctgatcccacaggttccccattttcctgggctggacctggagggagagtaccagtttatcagcttctaaaccaaaaagtgaattcttaggacttcatcactatatcatctgtaattcttattagaagccagctggaggaatggatgtttttggaagactgaaagccatgttctccctggaacctctggggtcccaagtggccatggaggccacagttctacttccggccctagccccgcccctacccgcctacccaccatcgcaatgcatgatgggccaccacttcacttgggccacatccacgagacccgaagcttcttccaggtgccacagactgaacagctccgtggcttttgaccatatttgcagtgtctcccagagttgtgagcagaagcagagagaggatgctgtgcaccaagcgcttgtaggatcaggcttgccctggcagtcaggccatggctctggtgtccagatgatggagggcaggcctctctgctgttgtagccgggctaagcaagaacgggctaaactcctaccatttcctcagctgaatgttcaccttcctcattttcccctgattagcagcagcctgcagtaccccttttacccttttgccctagctgggtaactttttaggccactttaaatctttctggaaacgagaggagtaaatagaaaaaaaaccaggaactgtatcaggtgctttgcgtaataaatccctaatctttataataacctgtcttagtctgtttgggctgctataacaaaataccttagactgggtaattt

SEQ ID NO: 478813 - DNA, 1529 bp, Homo sapiens
gggctgtggtgacgtaagctgggcctggtgggagtggactctgctgtcccctcagtcagaaggtgcgggctggtgactggggccacctccccttgagtggactctgctgtcccctaagtcggaaggtgcaggctggtgactggcaccacctccccatgaccggactctgttgtcccctaagttggaaggtgcaggctggtgcctggggccacctccccttgagtggactctgctgtctcctatgtcagaagctgtgggctggtgactgaggccacctccccatgagcggactctgctgtcccctaagtcagaaggtgcaggctggtgactggggccacctccccttgagtggactctgctgttccctaagttggaagctgcgagctggtgactggggccacctccccatgagtggactctgctgtcctctaagtcagaaggtgagggctggtgactggagccacctccccttgagtggattctactgtcccctaagtcggaagctgtgggctggtgactggggccacctccccttgagcagactctgctgtcccctaagtcagaagttgcaggctggcgactggggccacctccccgtaagtggactctgctgtcccctaagtgggaaggtgcaggctggtgactggggccacctccccgtgagtggactctgctgtcctctaagtcggaaggtgcgggctggtgaccggggccacctccctgtgagtggactctgctgtcccctaagtcggaaggtgcaggctggtgactggggccacctccagcttcaggttgtttttaaggctctggcagcccacccagcatcgctgtgtgaattccagaagggtgcctgtcttctggcccatttcccgctcactgagcccaccgctgaggggaaggatttgtggggagaacagacactcagctggattttagcctccttgtaaaccctcccaagtgctcttaaaaagttcaaggggagggggtatggactccacctcttgataggggaggggcaaggttctggaagagtgtatggcaagggtaattgtgcgaggccagttctggaaaataaacctgccaccatctcctgatggggcccaggtctgtagggcagagcacaggcccagggattctggaactctgaggccatcttgggccctttggtatcagcagtcaccgtgagccaaaggacagtactggcagctgctcccagggtccctggggatcgcagaggtgtttggggtttggatgagctagctgtggcctctgtagccgagactgaattgaattaacgggatcagtgtcagaatcccatcaatatatgctgtttctggggtttgctaggtgacagactcacccctaacttttgcaggctcaaagcaagagtacatatggagctctacctgccatatgtctaaatatttacagtttataaataaagcaaactaattgttaaatgactaccttatcctgtcatcttggcagatatccttcttaatgaactgaaaagctagatttgaatttgg

SEQ ID NO: 478814 - DNA, 817 bp, Homo sapiens
tgggctcctgtgcagcccgagcctccccgatgagtgcggccccctgctccacggcgcccagtcccatggaccacccaagggctgaggagtgcgggggcatggcaagggactggcaggcagttccacctgcatcccccgtgcggcatccactgggtgaagccagttgggctcctgagtctggtggggacgtggagaatctttatctcaaggtttgtaaacacaccaatcagcaccctgtgtctagcttggggtttgtgaatgcaccaatcgacactctgtatctagctactctggtggggccttggagaacctttgtgtccacactctgtatctacttcactcctgaagccagcgagaccacgagcccaccggaaggagcgaacaactccagacgctctgccttaagagctgtaacactcaccgcgagggtctgcggcttcattcttggagtcagtgagaccaaaaacccatcaagtccggacacagctatatgaccagccaaatgatggatttatttctctggcttccatcaaaagcatctaaaatatgtgtatttttgacctggtgacaaaagctgtctcttataattgttccctccttcacctcaaccttcacatctgtcttaatttggaaagttttgggggatttttctgatcattttggtggcataagtgtgcaagccttttgtgaccatcactaattgccagtgtgggaggcagcttgcatcggctctcactggctcatgagagctggctgcatcttctccaaaacctatgctcagtgtagccattttggtagcttgacatcagccatagtg

SEQ ID NO: 478815 - DNA, 846 bp, Homo sapiens
tgcagtaaaaatcatgtcaatgtgtggaggaagaagctagtatcactcgacaaatatgcttcctttacacttgcagaatcttctggcccggcatctgggaaacaatctttatgctaaactgcagcccgtgtggccctacttacctgggaccttcaccccaggtaacctgccagtctccagtgggttcatgttctcgctgacttcaagaatgaagctgcggaccttctcgtcccaaggcacaagaccacttgtgccagcagcatgcttcagcaagatggtagaagcaggaagagagctggccagaagacacataccccctggaaatggagagagtccttcggtgtaccacgtagcagttactggagaagtggtgggtgagattaacactctggtgaaaacgaggagtccagtcaagaatacgagctccgacgtgagcaggcgcagagtccaagtggagtcagaattttcaggaaactaccacatgggagtaactgcttaactgagtcctcagtggagaatgccataaaccctggctaaggtgattttgatcactaaaactttttaagcagaaataattaattacccatagagcttcagtatctctatcttggatcaactgatttgaagaaaaacatagcgaacctcctggggtaattgagcaggagaatgtgttcctgggttattaaattaatgcatctgcagcttgaggttagtcgatattagtagaataaattctgggaactgttaaaaataatgatgttagctttcaaaatgttaatacaattctaaagtcactgtttctgaaagtagaaattgttactggttcttaacaataaaagcatttgt

SEQ ID NO: 478816 - DNA, 600 bp, Homo sapiens
ctgtgctgtgatgtgatacttgttttcgtcgatgtgagagtgcagtgctgtgatttctcagagcaaggacatgtcaccaggcctgggaaccatgggaaaggttttacaaagaaggggacgagagctgggtcttgaggggctgggaaatggagctggctggagaggagcctctaacgcagactctggctggtttcagtcccaggatgctatccctgagacctcttatctgcattgcctcagccatcctgtggtcgcagtgtttgctccgcatattctgcccctgctcacgtcgcccttcatcctgccccagccagacatgctgtctgtacagcccactggttctggcagccaggagtttcctaggaccagcagcatcgattgtgctccactcagatcaaggaaagagttcccctcagctcttacctggcaaataaggtggactggaaccatttctaaagagatcaggaagtatcagggaatgggatctattcagtctttcggttacctgtaagttgaagctgaaagtcagccttgctatccatggaacctgcatctacatatccaggtactttttgcctactaaatcctcttctcatttca

SEQ ID NO: 478817 - DNA, 728 bp, Homo sapiens
aagccacaggcctgcaacagcaggattacgatagctgttatgcccaattttcaggtccagaaactgaggttcagagaatattggaggagaaagcagctctgagaggatattatgacatgtctctcctttgactacatgttccttcctccacagccaattgacaggagagaaagggacgatctctattcatttactggagaattagcattttctgtcaatgcaccttgctcttttacccaaggaatttcttcaggatcttcctctgtcaccctggctggagtacagcatagtaaaccctcagaaacttgtcctacagtttgtctgagccctacggaggacggctcttctttaatctcctgggttgcttattgtcttaaacatcaagaatgctccctgacagcagaggagcaggcccggcagcactcagaactgagtgaacacaagccagagagtgcctcgcagcccaagagctctgacagcactccattctgccccctgacattacacacggcattggagggctggtgccatgtggtggcagaacgcaaccaaaaccagaccagaccacagacaccacttgtggatgttgtgaagcgttcattggaaccttccttcactgtgtggttgatggttgagatgcttgcaaaacaagtatttggtatgtcttgtgtggtaacagttgtgacatctgggtcccgaataaagagtgtacctcccggaaggtaggg

SEQ ID NO: 478818 - DNA, 574 bp, Homo sapiens
ctggtttatcatctccccaatattattatgcctcatctgtaaactgaagatgatagaatcccggctcctccccttgctcttggcaaaggatggccgaagtcctggggagagtcgagctggctatgacacacttaaaagatgtattggagaaacagctctggacaagtccctggcctccaggagcttaccgtccagagggagaaaaggcaagaagatacttgtgctgcttattaaaggctatgttagaagaactatacactatgtcaacatcatagagatgagtctcttgctagtctgtggcccatttacgcagtcacagcaaacaatggcacatttccagcagtttggagcatcggtggtgtgctccagcgccaggtgtaggcactggcataatgctccctggtgtgctatgtttgtgggtttaatgcatatacttaggtcattgatatattttgattaagtttttcatctgtttttaaacccttataagtatagttgtacatatgtcttgttgaactttcataaatttgacaacaatgaggttactgggtcaaagcattttaaattttaaatt

SEQ ID NO: 478819 - DNA, 998 bp, Homo sapiens
ctgtcccagggtcatgagggcagagcatcctttttagggcgagctctctacaagcaccaggtcgccacagcagctcctctgcggctatgcattcgccattcttccctgtattgacccttggatgctgctttcaaagtgcctcacacatgttttgtggcctcttccagttatcctcctatctcttcccagccacccctgggattgtctttgccaccctgagagatctcaagtttccgcagcttgtctgcatcctccaagtgttcacacctcggctcctctggccctggcttcccaagcccctctctcggtgcccacctctcacgccaatcctgcttctggacatagcccaaagggaagaggcagctcactggagcaacttcccagccattccctctaacaccattcatagcttccatggattgaagatcctagacacaaactggggcaactgcctggtctaccaggatttccttaaccctctgtgtgggcggcaagccacccaggtgccaaggcaagagaccgagggcacgagctcggtagcaaaaagtgtcaaggaacaacacccgctacttagcagaccgggaaagggagtctccctttccccgggggagtttagagaagactctgctcctccaccttttgtggagggcctgacattagtcaggcttgcccgcagttatcccgaggcctaaccgtctccctgtgatgctgtgcttcagtggtcacgctcctagtccgccttcatgttccatcctgtacacctggctctgccttctagatagcagtagtaaattagtgaaagtactaaaagtctctgatatgcagaaataatggcgtaagctgtctttctctttgtctcctctctctctctgcctcggctgccaggcagggaagggccccctgtccagtggacacgtgacccacgtgaccttacctatcattggagatgactcacactctaccctgccccttttgctttgtatccaataaataacagc

SEQ ID NO: 478820 - DNA, 535 bp, Homo sapiens
ttctggaagaggaaatggactattcatgagcagtgctttcagtgatggaccagagcttttcaatgacagtgactcgaattgcaaggttctggtgcatgccaaagatccccacagaaggatcgacatcacagggacactaacccaaggggccgagtctgttctggagtcaggaagagtcccaccgggcaagaagaaatggtttcacgctttcaaacgttttcaagtgggaacaggaacatatagcttgggccaggctctgccacgacacgtggctgtggcacctcccttggtggtggctgggaaccttgtggaaacaaaagtccatttccaagaaaccagtggggccgtacaatatgctttggtagctagcttagtcagcaccagattccgcagaagatgctggtgcctgaagcagatcaatgggacgggtgccacggtgggttaccgtgtaagaagtaaatgtagcatccttaattcataagttaagctttttcataggtatttatgtacaaggaaaaatgtagtacagttgttc

SEQ ID NO: 478821 - DNA, 768 bp, Homo sapiens
tacgtcttccagtagttaaaaaacggggggccgaggcccccacagttaaagtgggcgagagagcagcttccagcatctatggcgatgatggcctttttttgcccagatgcaaccaggtctgccagtcggccagctcgcacggaggggcccacctccagccctggcctcaagagggaccaggcacaaaccttaccttgacaatgtttccagcaacacttcgctgggacaactagtcagtgtggtcaaccaggctaggacaactagtcagtgtggtcacccttgtggccgttcttacggggaatttggttattatggggaacttggccaccagggagctcagtgcctcctgcccatcctcctggacaagcctgagaggaaggagggaagtgctctgggaagctgtaaaaaccagagctcaaatgtgctgacttcagcaaatgccttcagggctaaagagctacaaatcacagctatctctttgggggtctggcttcatgtaggtttggcctgataatgatcagtttttggtgcaggctcatgcactctgccagtcatgtgggcattggcgatgaggcagactatgttgccgtaagtggttttgccttccactctccatctcgttgcttctcatggccaccatggatccctaagtgcccagcggtttggggtgagccatgagctgctggcgttttgtatggtggttgtagtgggaaaaacaagagctttcttttatttctaacccctaccctgagatgtttgaagtggtgg

SEQ ID NO: 478822 - DNA, 876 bp, Homo sapiens
ggacactgatttagagaatacacggcttcttggggagccttgcctcagccctgcaaggtttgaaggaggaagaagaaccatcaggtaaacaaagcacagttgaggaactgtgagagggaactgagggcctgaacttcacctggagaaaatatcccaagcaaaccaaaagcagcttgagatgggatgtcgtgagtggagcaataaaagagacaatggaaacatttccctcccttggaatggtcagcaagcagggctcacagatgctgggctgccagtcgtgggcaaccctgctctggtgcacccccaggaagcacatgaagctgaggggccaaggtcattcattcagccttttaaagatcttgccttcagcctgtatgaggacccaagcaggttgccgctgctggctttgggggaggggatgggggagtggccagcttttattcccttatttgtccccgcccatgtcctgctgattggcccattttacagagtgctgattggtccattttacagagcactgattggtgcattttacaaacctctagctagctacagagtgctgattggtgcattttacagagtgctgattggtgcattttacaaaccactagctagctacagagcgctgattggtgcgtttttacagagcactgattggtgcattttacaaacctcttgtaagacagaaaagttctccaagtccacactcaacccaggaagtccagctggcttcactaagggggcagaaggtcacatgaattttattcagccaagaaataacatctaagaacagtgagatccatgctttatcctttatacagctttatgcttgcaaataaagggcacgattatgggaatttttctcagttgaaaagg

SEQ ID NO: 478823 - DNA, 737 bp, Homo sapiens
tggaacccatatgaagtgcctctaagtgttgcggacaggctgacgcactaccacgccgcgcgacagcgaccgcgcgcaaagcgccaggaaccccccctactgcccgccccgcgctggcgaagcgcgacccgtcccgccccgccccgccctcggcacagcgtcagaggcggggacgcgcgctggtctatttttgggcatccggatggcgactgcgggaaatcgagttctcatgctggggcgaaaggtgtgtctgcaggagccaaatccaaatgagcagtccaggaccgtccgcccgctcggaagaggcgaatctcccacggcagacgtctgggtgtgcgaatgccagttgagcggggcctcgaggacgcgtcacacacagcgaggatttgaggagggaagcgccttccagaagtggagcaagcaagatggggaatggaaggcaagaagtatgaaatctgaggcggacctttgcaaaggatcgtttcagtatgacttcacaggggagttagggagtataggtgatatctcaagagttatctcggccagagacaagggagctgggctttcatacacttaccttgtttttcatgggttaagggccgctgaagaggatgtaagtgtgcagacacgcctagctctgcacatttagggaaagcagtttaataggctgaacaaaggcagtcctctcaagatgacccttcagtgtgggcatttgaaagtgaaagcaggttgaagtt

SEQ ID NO: 478824 - DNA, 639 bp, Homo sapiens
agctcaaggtttgtgagtgcaccaatcgacactctgtatctagctgctctggtgaggccgtggagaacctttatgtctagctcaaggattctcaaggtttgtgaatgcaccaatcgacactctgtatctagctgctctggtggggccttggagaacccgtgtgtggaaactctgtatctaactaatctgatgggcacatggagaacctttgtatctagctcagggattgtaaacacaccaatcagtgccctgacaaaacaggccactcggctctaccaatcagcaggatgtggcgagaccacgagcccaccaggagaaacgaacaagtccagatgcaccgccttaagagctgtaacactcaccgcgaaggtctgcagcttcactcctgagcccagcgagaccactagcccaccaggaggaacgaacaactccagatgcgctaccttaagagctgtaacactcaccgcgaacgtctacagcttcactcctgagccagcgagaccacgaacccaccagaaggaagaaactccgaacacatctgaacatcagaagggacagactccagacgcgccaccttaagagctgtaacactcaccgcgagggattcagcctctttatatttagtgaagcaactgaaac

SEQ ID NO: 478825 - DNA, 542 bp, Homo sapiens
cttcctttcaattgtggtgagacactgacctctattcgaagatggtggccacaggtgatgccccaagggatcctcagtggagcgagctcttctctaccagctgcccccaggctccacgggctgctctccctcaaggcccactgtgcgtctacactgcagcacctgactcagaagaggtggagtgtgttgcaggcctgggggcagctctgcctgtccctcttagtaccaccaggctaggctctagagtcaagctggtacatgggttctggggtcctgtgatcctgggttgtggggagtgggatgtgtgtttcctaggaaaggtgctgaggcgctgtggtatatggccttactccactccagtgcagccctgtggttctcaccaggctattggaagttccctttcccactgctcccattgccagctgagacacatgccaccttctccctttcttttctctctggacctgtgttgcgccaggaaagttgtttaatgttttagcaatcatgtgtattaatgtgtgacagacattgctgtgcttttc

SEQ ID NO: 478826 - DNA, 571 bp, Homo sapiens
ttctcactgtccagtgggcactctgagagcctttgctaaaaatgcctccctggctcaccctgcctaccagctccaaggcccttccctttacagcagtcatgaggccagactggaagaaagaccccatgaagctcatgtttctgtgtccagttggtgccatctactgcctgaggagagcttctaactcatcagcccaatctctaaacacaggcaacactcctgggggaggggataggggcacagggatctgtggctattctgtatgtcaaggtttctataaaacagatcttcagataaaggcagcggaaacaccagcaagagcaaatgcacaatgtatgactcagggtgaagctacacatttttcacagtctagaggccctagaccttttggttggacaaatgtcaatatcagcataactttcaagtctttctatgtaaatctgcaaaatagagcactggcctttgatttagcttagtttgagtgctgtaataagaactcttaggaatgacaggtttcttctggttttgaccagaaaatacttctgctacctactgtgcccatagaaatgta

SEQ ID NO: 478827 - DNA, 1093 bp, Homo sapiens
atcatacggaaacatcacagaatggaattgaatggaatcatcagttggactcgaatggactcatcaaatgtcctcgaagggacgcgtcaaatggactcgaacggaatcatcatcgaatggaatcgaatgggatcatcaaaaggactcgaatcaaatcttcaaaaggactcaaagggaatcattaatgcaatcatcatcaaatggaatcgaatggaatcatcaaatggaatcgaatggagtcattgtctaatgcaatcgaatgaaatcatagtatggaatcccatgaaatcaacatcgaatggaatcgattggaatcattatcaaatagaattgaatggaatcactgaatggaatcatcatcaaatggactccaacggaatcatcgaattgactctaatggaatcatcactgaatggaacagaacggaataatcaaatggaaacgaatggaatcatcatcgaatggaatcgaatgtggaacctaaaggaatcgccaaatggactccaatggaataatcatcgtatggaatcgagtggaatcatcgaatgtactcgaatggaatcatcgaatgtactcgaatggaatcatcgaatggaatcgaatggaatcatggtcgaacggaaaagaatggaatcatcaagtggacacgaatggaatcaacatctaatggaatggaatggaatcatcaaatggaatggaatggaatcatcatcgaatggaataaaatggaatcatcaaatggaatcaaatggaatcatcaatgaatggaatcgaatgggaatcgaatggaatcatcatcgaatggaatcgaatggaatcatcaacaagtggaaacgaatgaaatcatcgaatggaatcgaatggtgtcatcgaatggacacgaaaggaatcatcgaatggaatcaaatggaatcaccatcgaatggaatccaatggaatcaccatcgaatggaatgttatgaaatcatctcatggactcgaagggaatcatcatcgaatggaatcgaatggaatcattgaatgaaatggaaaggaatcaccatcgaatggaatgttatggaatcttctaatggactcgaagggaatcatcatc

SEQ ID NO: 478828 - DNA, 980 bp, Homo sapiens
ttatcaaacggactcgaatggaataaactttgaatggaatcgaagggaatcatcaaatggaatcgaatgcaatcatcgaacggaatcgaatggaatcatcgaatggaatccaatggaatcaccattgaatggactcgaatggaatcatcattgaatggaatcgaatggaatcatcgaatggactcgaatggaatcatcatcgattggaatcaaatggaatcatcgaatggaatcgaaaggaatcatcatcaactaacaaaaacattgaatggacacgaatggaatcatcatcgaatggaatcaaatggagtcatcaaatggactcgaatggaatcatcatccaatgggatcatcatcaaatggaatcgaatggaaatcgaatggaatcatcgaaaggaattgaatggaattattgaatggactcgaattgaatcatctaatggacacgaatggaataatcataaaatggaatcgaatggaatcatcaaatggactcgaatgaatggaatcattgaatggactcgaatggaatcaccgaatggactcaaatggaatcatcatcaaatggaatcgaatggaatcatcgaatggaagtgaatagagtaatcaaatggaatcaaaccgaatcgtcatcgaatggaatcgattggaattgaaggcaatcatcatcgaatggaatcaaatggaatcatcatcaaatggaatcaagcggaaggaatcatcaaatggaatcaaatggaatcattgttgaatggaatggaatggaatcattgaatggaattgaatgagatcaccaatgaacggaatcaaatggaatcatcttctaatggaatcaaaaggaatcatcaaatacactcgaatggaatcatcatcgaatggaatcgtgtggaatcgtcgaatgaactggaaatgaatcataatcaaatgcagttaaaatgaatcatcatcgaaaggaatcacatggaatcatcatcgaatgg

SEQ ID NO: 478829 - DNA, 699 bp, Homo sapiens
gtatataatcgatcgcaatactcaccgaatggaatcaaatgtaatcatcgaatggaatcgaatgcagtcatcattgaatggaatcgattggaatcatcatcgaatagaattgaatggaatcatcaaatggaatcgaatggaatcatccccaaacgtaatcgaatggaatcatcgaatggaatcaaatggaataatcgaatggaattgcatggaatcagcatcgaaagatatcgaatggaatcatcatcgaatagaatcgaatggaatcattgaatggaatcatcctcaaatggagaataatcatcaaatggaatcattgaatggaattgaatggaatcatcatcgaatggaattgaatggaatcatcaaatggactcgaatggaatcatcatcatatggaatagaatggaatcatcgaatggaatcaaatggaatcatcattgaatggcatcaaatggaatcatcatctaatggaatagaaaataatcaacatcaaatggagtcaaaagaaatcatcattgaatggaatccaaaggaatcgtcatcgaatggaaccaaatggaatcatcatcgagtggaaccgaaaggagtcatcattgaatggaatcgcatggaatcatcatcgaatggaatcgaatggaatcatcatcaaatggaatcgaatggaatcatcgaatggaattgaatggaatcatcatc

SEQ ID NO: 478830 - DNA, 1483 bp, Homo sapiens
tcatcaatgaatggaatggaataatgaaatcgattggaatcatcgaatttggtcgaatggaatcatcatcgaatggactcaaatgcaatcatcatcgaatggaaacgaagaaatcatcgaatggaatcgaaaggaatcatcgaatggacttgaatggaataatcatcgaatggaatcgaatggaatcatcatggaatggaatcgagtggaatcatcgaatggactcgaatggaatcatgctcgaaagagatcgaatggaatcatcaaatggactcgaatggaatcatcatcgaatgaaatcgagtcaccaaatagactccaatggaatcattgattggcctcgaattgaatcatcatcgaatgcaatcgaatggaatcatcgaatggactcgaatggaaatcatcgaatggactcaaaaggaatcgtcatcgagtggaatcaagtgaaatcatcaaatggactcgaatgcaatcatcgaatggcctcaaatggaatcatcatcgaactgaatcgaatggaatcattgaatggacccgaatggaatcatcatcaagtggaattgaatcatgtggaatcgaatggaatcatcgaatggactccaattgaatctttgaatgaactcgaatggaatcatcgtcaaatggaatctaatggaatcattgaatggaatcgaatggatggaatcgaaaggaaacatcgaatggacttgaatggaatcatcgaatggactcgaatgcaatcatcatcgaatggaaacaagtggaatcatcgaatggaatcgaacggaatcatcattgaatggaatcgaatggagtcatcaatgaatgtaattgaatggagtcatcgaatggattctgttcgaatcatcatcgaaaggaaccgaatgcagtcatcatcgaatggaatcagatgtaattatcgaatggaatcatcatcgaatggaatcgaatggaatcatcgaatagactcgaaagcaatcaaccaatggactcgaatggaatcatcatcgaatagaataaaaaaatgtaatcaaatggaatcatcaaatggaattgatcagaatcaacatagaatggaatcatcaaatggaattgaacagaatcatcatcgaatggaatcgaatggaatcatcaaatggaatcgaaggcaatcatcatcaaatggaatcaaagggaatcatcgaatggaatcgcatgaaatcatcgaatggcatcaaacagaatcatcattgataagaatcaaatggaatcacctaatggacaagaatagaatcacaatcgaatgggatcgaatggagtcatccaatacaatcgaatggaatcatcatcgaatggaagagaatgtaatcatcatcgaatggaatcaaaaggaatcattgaatgcactcgaaaggaaacatcaaatggactcgaaaggaaccattatcatgtggaatcgaatggaatcatcgaatggactcgaattgaatctttgaatgaactc

SEQ ID NO: 478831 - DNA, 729 bp, Homo sapiens
tatagagtttcagtttcagaagatgaaacgagttatggagatggatggtgagctccccaggttggtagtactccatgtttattgctgtacaacaatgacagcagcacgggagtttgatactgggcatgaagtgggaagaaaagttgaagacactcttgaaagaaaggaatggaatggaaagcagtggaatagaatggaatggaatgcaatggagtggaatggagtggagtggagaggagtggaatggagtggaatggaatggaatggaaacatcatcaaatggaatagaacggaattatcatcgaatggaatcaaacgaaataatcagcgattggaatcgaatggagtcatcatcgaatggaatcgaaaggcatcatcatccaatggacttgaatggaatcatcatcgaatgtactcaaaaggaatcatcatcgaatggaatcaaatggaatcatcattgtatggaagcgaatggaatcatcatcgaatggaattgaatggaatcatcatcgactggaatggaatggtatcagcatcaaagggaatagaatggaattatcatcgaatagaatcaaacggaatcatcatcgaatggaatcaaatggagtcatcattggaaggaatcgaaaggcagcatcatccaatggacttgaatggaattatcattgaatggattcgaaaggaatcatcatcgaatggaatcaaatggaatcatcactgaatggaagc

SEQ ID NO: 478832 - DNA, 1212 bp, Homo sapiens
tggattcgaatggaatcatggaatggactcgaatggaatcattgaatgaaatcggattaaattatcatcaaatgaaatcaaatggaatcatcgaatgtggaatcgaaaggaaacatcgaatggacttgaatggaatcatcgaatggaatcgagtggaatcatcatcgaatggaatcgaatggaatcatcaaatgtacacgaatgtaatcattgttgaatggattcgaaagaaatcatcgaatgacatcgaatggaatcatcttccaatggaatctaatgaaatcatcgaatggactcgaaaggaatcatcgaatggacttgagtggaatcatcatcgaatggaatcgaatggaatcatcgaatggactcgaatggaatcatcatcaaatggaattgaatataatcataatcaaatggaatcgaatggaatattcatctataggattcgattggaacaatcattgaatagaattgaatggaatcaccgaattgaatcaaatggaaggatcatgaaatggaattccaatggaatcatcattgaatggaatcgaatgcaatcattgaatggactcgaatggaatcatcatcgaatggaattgaatggaattattgaatggacacgaatgcaatcatcattgaatggactcgaatggaatcatcaaatggagtcgaatgtaatcatcatcgaatggaatcgaatggaatcttcgaatagaattgaatggaatcatcatcgaatggagtcaaatggaatcatcgaatggactcaaatggaatcgtcatggaatgtaatcgaatggaatcttcgaatggaatcgaatggaatccccatagaatgcaattgaatggaatcatcatcgaatggaattgaatttaatcatcaaatggaaaagaattgaataatcatcgaatggaatcgaatagaacaattgaatgaaatcgaacggaatcatcttcgaatggaattgaatggaatcatcaatgaatggaatcgaatggaaacatagaatggaatccaaagtaatcgtcatcaaattcaacccaatgctatcattaaatggactcgaatggaatcatcgaatggactcgaatggaatcatcatcaaatggaatagaaaggaatcattgaatgcaatcgaagggaatcatcaccaaatgaaatcaaatgaaatcatcgaatggactcgtatggaatcaacattgaatggaatc

SEQ ID NO: 478833 - DNA, 946 bp, Homo sapiens
gtcacaaagtagtttctgagaatgcatctatctagttcttacgggaagataattcctgttccacctcaggcctcaaagccctccaaatatccacttgcagattctcgaaaaagagtgtttcaaagcttctctctcaaaaggaaagttcaactctgtgagttgaaagcaaacatcacaaagaagtttctgagcatgcttctgtttaacttttctgtgaagattatcccgtttccaacgaaatcttcaaagaggcccaaacatccacttgcagatgccacaaaaagagtgtttggaaactgctgtttgaaaaggaaccttcaactctgtgagttgaatgcagtcatcacaaacaagtttctgacaatgcttctctctagtttttacgtgacgataattcgttttccaacacaggccagaaagctctccaaatgtccacttgcagaccctacgaaaagcatgtttctcatctgctctatgaaaagcaacgtgaaactctctgagttgaacacaaacatcacagagaagtttatgagaatgcttctgtttagtttttatgtgaagatattcccgtttccaaagacatcttcaaagaggaccacatatccacttgcagattccacaaaaagagagattcaaaactgctctatccataggagggttcaacgctttcagttgaatgcaatcgtcacagagaagtttctgagaaggcttctgtctagattttatttgaagatgtacccgtttcgaacgaaggccaaagagtggtccaaatatccacctgcagaacctacaaaaagagtgtttcaaagctgaactatcaaaggaaggttcaactctgggatttgaatgcaaacatcaaagagaattttgtgagaatgcttccgtttagttaggtgcagttatcccgtttccaacgaaatcctcagagaggtccaaatatccactc

SEQ ID NO: 478834 - DNA, 446 bp, Homo sapiens
tcatcatcgaatggaatcaaatggaatcatcaaatggaatcgaatgcaatcatcatcaaatggaatcaaatggaattatcatcgaatggaatcaaacggaatcgccactgaatgcactcgcatggaatcatcatcgaaaagaatcaaaaggaatcaacgaatggactcaaatggaatcatcgtcgaatggaatcgaatggaagcctcaaatagaatcaaatggaatcatcaaatgaaatcgaacggaatcatcatccaatggaaacaaatggagtcatcaaatgaaatcgaatggaatcatcatccaatggaatcgaatggaatcatcgaatggaatcgaagcaatcatcatcaaatgaaatcaaatggaatcatcgaatggaatggaatggaatcaatgaatggaattgaatgcaatcaccaatgaatggaattgaatggaatca

SEQ ID NO: 478835 - DNA, 1579 bp, Homo sapiens
aatgaacggactcgtatggactcatcatcacatggacttgaatggaatcaatggaatcatcatcaaatggaattgaatggaaacatcatggaattgaatcaaatggaatcatcatggaattgattcgaatgcctgatcatcgaatggaattgaatggaaacgtcatcgaatggaatcaaatggaatcatcaaatataatcgaatggaatcatcatcgaatggaatcgaatgtatccaatgaaagaaatcgaatggaatacaatcatcatcgaatggaatcagatggaatcatcgaatggaatgaaatggaatcatcatcaagtggaatcaagtggaatcatagaatggaatcaaatggaatcattagaatggaatcaaatggaatcatccaatggactcgaatggaatcatcatcgaatggaatcaaatggaatcatcgaatggagtcgaatggaatcatcatcaaatataaacaaaagccatcatcaagaatcatcatcgaatggaatcaaatggaatcatcatggaatggaatcaaaaagaatcatcacaaaatggagtacaatggaatcatcatcgaatggaatcaaattgaatctcgaatgccctggaatggaatcatcatcaaatggaatcaaatggaaacatcgaatggactcgtatggaatcttcatcgaatggaatcaaatggactcatcgaatggacttcaatggaatcattgaatggactcaaatggaatcttcgaatggactcgattggaatcatcattgaatggaatggaatcatcatcgaatggaatggaatgattcatcgaatggaatcagatggaatcatcattgaatggaatcgaatagaatcttcgaatgaaatcgaatggaatcatcatcaaatggactcgaatggaaccatcattgaatggactcaaatggaatcatcatccaatggaatcaaatggaatcaacatctaatggaattgaatggaaacattgaatggaatcgaatgaaatcatcaccgaatggaatcgaatggaatcatcgaatggaccctaatggaatcattatcgaatggaatcagatggaatcatcaaatggacttgaatggagtcatcaaatggactcaaatggaatcattattgaatggaatcgaatggaatcattggaagcatcaaatagaatcgaatgcaatcatcatcaaatggaatcaaatggaattttcatcaaatgggatcgaatggaatcatcatggattataatcagatgggatcatctaatgaaagaggaaggaatcatcatcaaaaagaatcaaaataaaacaaagaatggaatccatcggaatcatcgaatggaatcatatggaaccatcattgaatggattcgaatggagtcattaccgaatggaattaaatggaatcatttaatggacttgaaaggaatctttggactcgaatgggatcatcgaatggaatcgaatggaatcatcatcgaatgaaataaaatggaatcatcgaatggaatcgaatggaatcatcatcgaatgaaataacatggaatcatcgaatggactcgaatgaaatcatc

SEQ ID NO: 478836 - DNA, 1181 bp, Homo sapiens
tcattcattggacacgaatgcaatcatcatcgaatggaatagaatggaatcttggaatggaatcaaatgaaattattgaatggaatcgaatagaatcatcattgaatagaatcgaattggatcatcatcgaatggaatcaaatgatatcatcatcaaatggaatctagtggagtcatcatctaatggaattgaatggattcagcaaggaatggaatcgaatggagaaatcaaatggaatccattggaatcatcatcgaatggaaccaaatgcagtcatcatagaatggaattgaatggaatcaacgaagggactcgaattgtgtcatcatttaatggaatcggatggaatcatcgaatggactcgaatggaaacatcattaatggaatcgaatggaatcctcaaatggaatcgaatgtaatcatcgaatggacactaatggaatcatcatcgaatggaatcgaatggaatcatcaaatggactcgaatggaatcattgaatggactcgaatggaatcatccttgaagggaatcgagtggaatcctcgaatggaatcaaatggaatcatctaatggaatcgaacagatttataagaaacttacttgaaccaaaaaatagaaaaacaaacaaaccaaaaccccctaaaactgtgatgagcaagtagacgtcagaacaggaaatatcactggggatgaagaataacatttcaaaatgacgaaggggaaaatacaccaagaagtcatgtaaataagatatatgtatgcacacaatagcattatttcaaaatacataatataaaacctattaaaaatgaaaggtaaaatagtaaaaccacagtcatccatggggatttcaacagtctcctgccagaaatttttaatttttgttaaacgaaaatttggtaaggctagagaggatcttataaatataattagccaacttgatctaactgaatcttttagaataatctaaggatgaggaatgaggtagcagagaaagaaaaggcagacatcaacgtgacattagtgtttcaagtctatgagaatacaccaataatggtgtatgtgtgtgtgcagatggtaagctcaatcttaaaattattgagttttaactgacaattcattattaggaaagataagaggaaatgatatctagtgagaggctatatgactgaactctaa

SEQ ID NO: 478837 - DNA, 901 bp, Homo sapiens
ggactcgaatagaatcatcgaatggactcaaatggaataatcatcgaatggaatagaatggaatcatcaaatgcagtcgaatggaatcatcatcgagtgtactcgaatggaatcattgaatggactcaaatggaatcagcatcgaatggaattgaaaggaatcatcaaggggacttcaatggaatcattcaatggactcgaatggaatcatcatcgaatggaatcatcgaatggtcacgaatggaagaatcatcgaacggaatcgaatggaatcatggaatggaatcgaatggaatcatcattgaattgaatctaatggaatcatcatcgtatggaatcaaatggaatcatcaacgaatggaattgaatggagaaattgaatggaacctaatcgaatggaatcatcaaatggaatggaatggaatcatcatcgaaaggattcgaagggaatcatcgaatggaatcaaatggaatcatcaaatggaattgaatggaatcatcatcgaatcgactcgaatggcattatcgtcaaatggaatgcaatggaatcatccaatggactcgaatggaataatcgaatgcattccaatggaatcatcaaatggaattgaatggaatcatcgaatggattctaatggaatcatcatcaaatggaaatggatggaatcaacaaagggccccaaatggaatgatcaaatggactcgaatggaatcatctctaatggaatcatcatcaaatggaatcgaatggaatcatcaaatggactcaaatggaatcatagaatggactcgaatgatatcaatgaatggacacgaatggaatcatcatcaaatggaatcgaatggaatccttgaatagaagcggggattctttagagccgaaacgcaggttttgcaacac

SEQ ID NO: 478838 - DNA, 553 bp, Homo sapiens
tggaatcattgaatgacatcgaatggaatcatcatccaatggaatcgaatggaatcatcgaatggactcgaatgcaatcatcagcaagatcatcgaatgaaatcgaatggaatcatcttcaaatggaatcaaatggaatcatcatcaaaaggaatcgtcatcgaatggaatcgaacagaatcatcatcaaatggtatcgaatggaatcatcaacgaatggaatcgaatggaatcattgaacgcactctcgaatggaatcgtcatcgaatggaatcatcatcgaatggaatcgaacggaatcttcatcgaatggtatcgaatggaatcatcaacgaatggaatcgaatggaatcattgaatgttatcgaatggaatcatcaacgaatggaatcgaatggaatcattgaatggaatcaaatggaatcatcatcaaatggaaccgaatggaatcatcatcaaatggagcctaatggagtcatcatggaatggaattgaaaggaatcatcattgaacggaatcatcatccaatggtagcgaatggaatcatcaacga

SEQ ID NO: 478839 - DNA, 759 bp, Homo sapiens
tggaaatgaatggagtcaccaatgaatggaatcgaatggaatcatcattgaatggaatcgaatggaatcatcgaatggactcgagtggtatcatcatggaatggaattgagtggaatcatcatcgagtggactcgagtggaatcatcatcgaaccgaaccgaatggaatcatcgaatggactccaccagaatcatcattgaatggaatcgaatggaatcattcaatggactggattggaataatcatcgaatggacactaatggaatcatcatcgaatggactctagtggaatcatcatcgaatggaatcgaatggagaaacatcattgaaagtaatcgaatgaaatcatcgaatggactcgaatataatcatcgaatgcactttaatggaataatcctcgaatggaatcgaatagaatcatcatcgaatggaatcgaatggaatcatcatggagtagactcaattggaatcagcatcaaatggaaggcaatggaatcattgaatggacttgaatggaatcatcatggaatggaatcgaatggaatcttcgaatggaatcaaaaggattcatcgaatggacactaatggaatcatcctcgtatggaattgactggaatcatcatcaaatggaattgaacagaatcatcatttaatggattcgaatggaaacatcaatgactgaaatcgaatggaatcattgaatggaattgaatagaatcaatgaatggaagtgaacggactcatctttgaatggaatc

SEQ ID NO: 478840 - DNA, 1162 bp, Homo sapiens
gcctgaggagggtccatgagtggatccctgaaggatgaacgagattcgggatgaggatgcccggggcatgcccgccatgcccactagcaaacctttattgagtacttactatatgccacacactggggacacagaggcactcaacacaggcagccggactccctatggagctgccgttctgtgcaccaagcagatgaagaagcaggacgtggggtttaaactgagaccgccagagtgtgtggaggctgtgtcctcacagttgctgcctcatggtcacaagatggctgcggcacctccgggcctcacatccatgttccaggcaagaggaaggagaaggagcaaaaggccgaagagcaaagaccctgattccttggagaaaggcttgcagcccctctccttcctggattgcacacctccagccctggcagcctgtcccctggttggcacccagcagcaggccacagatggcttctggctgtcccatggcgtcgcatcagggcatgcagcggatagtgactcacactggcacctcttctgcttggaaaatgccctacacatccatcatctttggtttttctgctagaacgatggcatgagggatgattcaagggtcttggaggccctatgcggtcaatcttgttttcctgccacatcaagggagtgtgcaattttcgaggccccgagccctgtgttttcactgagggcagacatagggcattcgctgtctttgcccgtggagctgttcctcacactaaccatgcagggctgggtgggagacatgtatggggggtggggtggggtgggagggggccaagaagacatggctagttctgaattttcccaacccacccataaaattcacccttcaaattctaaagattccattccgtggtctaactctgtgtgtctgtccttggttccaaaagtccccgtccttgtggcccctgttgttttggacccatcacaggcctgccaccctgtgagatcttcctcctttgacccctgcccttaagagctggctgtgttacctcctcttctgggaacctgctggtctctttgcccctagaagatcctcctttcctctgagtaccaatggcctcggttttctgggactgccacatccaacattaagcccatcctctcccatgtgcgccttctcttg

SEQ ID NO: 478841 - DNA, 641 bp, Homo sapiens
gctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgttgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacttggccgccgccgccaaccaccgctggagccagaaggccatggacgacacgttctacctgagcaaccgcccgcgccccgggccggtcgcggaatgaggggccggcgcctggcctc

SEQ ID NO: 478842 - DNA, 476 bp, Homo sapiens
ccagcaaaccctataaaatcagtatatgagagttgctgttgtaccacgtcctcaccaatacttgatgtgtgtgcttggtagacaggcttctgcagaacaaggggcttgtccagcgcctgcctactacttcattgccagtagccaggaacgtctcccaacactcttctctggcattattttcagaaaggagcctctggtgggacactttcctgtaaatagctttcccaagaaccttagatggctgatttctggcaagttctgtgacattattaccaaaacaccaggggttttgtctaggtcttgctgctggctgcacagaaagccagtcactgagacaaccagtactgccaggaaagaaagctttaatcaggtactgcagccatggaggtgggagatcagcttcaaatccatctccgtgaccaactaaaattaggagtttatacagcagaaaagaaatgtagctacatacaggaaaa

SEQ ID NO: 478843 - DNA, 1438 bp, Homo sapiens
tgcagagcacccccatggcccaacatgtctcggccatccatcttcctgcggaccatggccacaccccacactgcaggggcccaggaaggctccagagaatgccccacctgcccacagagcacaggcccacccctccacttgcccctcgagttatggggggctgaggtcgccgcagcttccccttcctccctgcacacagggttccacggtagccccagcccctttgctctggcaccttttggagcctcgggcgaggcccctgggtcctgggcctttctctgccccctccacatgctccccccagggcaagatccggccctcagcttgaaacagcctctctatgcactgactcctccgctggactccaggtgtgtggtgtccggatcctactggaagattccacctggattcatgcatctgcatgaattccgtgtggccaaaacagatctcctgacccctcccggctcctcgctgcccccctgctccccacctggctgctctgcctacaatttctcatctgcaaaatggttggagaaaggccttgcgtccgagggcgacggcggtggtgccgaccgcatggggcgacggcggtgatgccaaccgtatggggtgaccgaggtgatgccaaccgtatggggtgactgaggtgatgccgactgcatggggtgactgaggtgatgccgactgcatggggtgaccgaggtgatgcccactctatggggcgacagcagtggtgctgactgcatagggtgatggtggtgatgcccactgtatggggtgacggtggtgatgccgactgcatggggtgatggcagtgatgccaactgcgtggggtgaccgaggtgatgctgactgcatggggcgaccaaggtgatgccaactgcatggggtgacttcggtgatgcccactgtatggggtgacggtggtgatgccgaccgcatggggtgacggcggtgatgccgaccgtatggggtgacggcggtgatgcccactgtatggggtgacggcggtgatgccgaccgtatggggtgacggcggtgatgccgaccgtatggggtgacggcggtgatgcccactgtatggggtgacggtggtgatgccgaccgtatggggtgacttcggtgatgccgactgcatggggtgaccaaggtgatgctgactgcatggggtgacggcggtgatgccaactgtatggggtgacttcggtgatgccgactgcatggggtgacggtggtgatgccaactgtatggggtgacttcggtgatgccgactgcatggggcgacggcggtgatgccaaccatatggggtgacggtggtgatgctgaccgtatggggtgacggtggtgatgccgaccgtatggggtgacggtggtgatgccaactgtatggggtgacttcggtgatgctgtctgcatggggtgacagcggtgatgcc

SEQ ID NO: 478844 - DNA, 1480 bp, Homo sapiens
tcgtacggatgcctgtgcctgctctgcccaacacagtggaggagcgtcacgtgtgtgcacctgtggatgcctgtgtgctgctgaccgggtatgccaaggcgtggaaagctatggggatcctgggggtggaggtcgacacaagagccagatggcccaaggccgggcttgccaaggacatggacacttccctccgaggaataggaacaccagtaggaaggacagatgggaatttccatctggcgtccattccttcatcccgaagagcttcctggaacagctttcttacagtgcaggccatgaattctctcaatgtgcctggggcaggcggcccttactccagagtcacctgctggcgtgtcaactccgttcttgctgagacaggattggaggaagatgagctcgtggtacgaggcagcgctgatgttcctctggagtcctcctgggccgtgcatggtgccctgggctctgcggccccgccccacaccgtggagcctcctctgacagccggaaagggcgctggaaggggcccagagctttgggtgctgggaagcctgttattgctgatggccagtgatgccacagctgaaagcctgtgcgtggccgcctcttacaatgttggcatcaacaagggcgtgaatgacaaaccattagaaagaaggatggaaaagaagccatggtttccactgggttgccggagccctggggggaagccacggccccagctcaactctgggaaagacagcagccagctgaccctggctctgggggctgtggggacagccagcctcctcctggattttggaaaccagcccctggtaagaagttccctggccttcaatgccagcagcttcagtggactggaccaaggggttgatgtgctgatcgagtgcctccgtaacagtttctatgcctggactgtacccggcaccgatgccctgacatgttcagtggcccccacggtgacagtgaaccatgcccgcagacgaaccagccctgccgacacctagattttggacttctggcctccagaacggtgacaaaatggatttctgttatgctgagccgggggtttgaaagtcaaaaaccttcagaaccccgaaagcaggagcgcagctgccgaaatgacagaaccggcaggagctggaggtgtgagggcagccgctgaaactgtggcttacgagtgggcggctccctgtgcactacgtgggccccctctggacgacagctgctcccagaagcagcactacatgtgtggagagctctctgccgggtactgtctgatttatttccccaatttcagttctgtcccatgcagaaagccatgggatcccactgtacaggcggcgagatttgaacacacatcagtctgacccccgaacttatgttctccccagtgctgctcccgtttcccttctcaggacagaccccaagacagatctgcgcacacctggctgttccctttcttcggttcaactctagc

SEQ ID NO: 478845 - DNA, 712 bp, Homo sapiens
cagtccaacaatggcaagtggacggcatgttctggctcagggttggcccgaaagacttgcgggtgagttggatgtgagatttaaaaggaagcgggttgcccggcatagctcctggaatttgggcctgggcaacaggaagggcggaactgctgttccctggactgggaaggtggggcaggagctggctgggtctggggtaggctacaaagagccgtgctgcagactcgccaggtgcacaagcacgttagataccaagggacactgtcaggtggtgcagtatgagctgggaattcagagaagaggctatgctgagattcagatgaaggctggcattgccaccgttgcgtttgatgacgaggaagtcgctgggagcttcctgattttgcagacaggaacgccatgggatgaggaaaagacaagcatctaaatctgtcagcagtgaggtgtgttggtgtcacgggctgtggcctccctctacctgaacctcagccaaccccaaaggggtggacacaatgaagaactcggagcaacctcctcgaggggcccgagtggatgccagattccccaaaatccagaactagagccaaagagctaggagcttgggttgcagaagcaaatataaatattaaaagtacggacaagatacaaataatacaagcagtacagattgagaggagggacagggtggccagagaaagaggagctgaatatt

SEQ ID NO: 478846 - DNA, 902 bp, Homo sapiens
ctgtcatgccagtagttgacagtgactgtgtgtgccctccttgctggggccgggcccggcatcccgatctgagcagggacaccatggttggggagaaggtaggaggttcccccaggccccagtgctgcccaggatcagccttctggggtgtgaagaggatgtcagcggctaagatactccccattctggaagacagctcaggcccttgcatcctcaggctgcccccacctgggccagtgctcagacaccaagcactggacagcaaagactttccacggccctcaagtaacctggaaatctgctctatgcccagtggtccagggacaacatgggcttttggaaaggcccatagtgaggttttggactttaaggagtgggtaggagagtgccgcttggtcccatgggaggcagcccgggcagagatgcttgcccatgagcaggatgtgggtccaccagggatgctgcaggagagagccccagccccacagcagcctggggaccgccaggatgagcagaacctccctgcctgtgccagcggcgctagctctgtccggccaggtgttcaggctgaagctttggtgctgcccctgacactcctctttctacatctagtccatgagcaggccctgcgggcttccttccactatcaatggttccatgcgttttgtcccgccgcggcccacaccgcagggctggcttcccggcctgagacctgggcagcaggtctcacgctgacttgatcctctgctgttggaggcctcacccttttatttttcactgggtcctgcacaccgtacaactggctcctcctgcacaaatcatttcaacagcctcctggactcggaccatcctcctgccctccctaaccctttattctctcttctaactcggtggtgagagtg

SEQ ID NO: 478847 - DNA, 564 bp, Homo sapiens
gcgcctggagcagtgcctggtacagagtcggctggtgccatctatgtagtatagcctggggtatgatggaacccacactcacgctgggtgtgtttcagcagaggttttggccacctggggtgcgggccccgaatgctcgtttctggaagttgcccaccccacacaaagagaatggggacaagcgtatgtggcgttgcggtatgacctgctctagagacagccctgccctgctcaccctcctgcagacgacatctagcagtcaaggcagcagcggcgccgtgcggagcctcctgtctgctggtgtctcggggctctggcagctgctccccttaaatggacaccaggctggctcgcaatgtagccgcaacatcattgtgagaaacaaactcacctcttcaaacccaaagaatggactcagagacacggagaacagcggaagagagacttgcaagatcgggtgtctgatgggcaggcacacccagcacagtttcaacaagcaatttatcccctagtgcacagtcccctcccccggttcctcataggctgtgtactgtggggcctcaa

SEQ ID NO: 478848 - DNA, 3153 bp, Homo sapiens
cggagcagtcggccagccctgctggctccgggcaatgagggacttagcacccgggccagcagctgcagagggtgtactgggtcccccagcagtgccagcccactggcgctgcgctccatttctcgccgggccttagctgccttcccacggggcaggcctcgggacctgcagcccgccatgcctgagcctcccccggctccgtgggttcctgtgcagcccgagcttccccgacgagcgccgccccctgctccactgtgcccggtcccatcgaccacccaagggctgaggcatgcgggcgcacggcaccgggactggcaggcagctccacctgcagccccagtgcgggatccactgggtgaagccagctgggctcctgagtctggtggggctttggaggacctttatgtctagctcagggattataaatacaccaatcggcaccctgtgtctagctcaagaaggaagaaactccaaacacatccgaacatcagaaggagcaaactccagacgcaccaccttaagagctgtaacactcaccgcgagggtccgcggcttcattcttgaagtcagtgagaccaagaacccaccaattccgaacacagcttcacagagaagcctggacttcatcaagctcgaaatacctgcccgagagcaggaaacaggggacttcgctcttcaaacatgcctctacaccaggcactgggacgtggaaataaatgtggcatccctgcaccggtgccctcagggcatctgcaggagctccccacgatgtgcccaggctcatcccaccctcccagcccagttccggtttccagcgccacctgccaagcacagcactgttcacctccccactcgcggggtggacagtgggcacctcgtgctggggctggcatcgccctcggcaccatcttgaatcggtggcagtgatctctgcatgagatttcagtctcctaccattaggcagcggccccacttcctcagtctcccctcacacccctgaccaggacactccttcctgtgtggccacaagctgcctcgacctgcagagtaatgtttgttttccccaatcctgctaagtgtccagcccccaccccctcccgattttaaaagcacctgcctgttagtgtctgaaaagacagcagatacagtgtggaatctttgagcagctgcctgtcatttaaataatttctcttaattttttaaaaaagataaatttaaacatttagataatttaaaagaaaacgcagctcctactgccctccttgtataaccaccatcctctcactgtccgtcctccccgtggaatgatcattatctcgccatccttcctccctgtataaccatcatcgtcctcccgccgtccctcctcccagtgtagccatcataaccctctcgctgtccctcctctctgtatagccatcatcctcttgccatccctcctccctgtataaccatcatcctctcgccgtccctcctccctgtgtaaccatcatcttcctctcgccatccttcctgcctgtatagccatcatcctgtcgccatcccttctccctgtataaccatccctcctccctgtgtaaccatcatcatcctcttgccgtccctcctccctgtgtaaccatcatcatccttttgccgtccctcctccctgtgtaaccatcatcttcctctcaccatccctcctccctgtgtaaccatcatcatcctcttgccgtccctcctccctgtgtaaccatcatcatcctcttgccgtccctcctccctgtgtaaccatcatcttcctctcaccatccctcctccctgtataaccatcatcttcctctcaccatccctcctacctgtatagccatcatcatctcgccatcccgcttgtgtaaccatcattatcctctagccatccctcctccctgtataagcatcatcttcctcttacgatccctcctctctgtataaccgtcgtcctctcgctgtcgctcctccctgtgtagccatcatcctctcaccatccctcctccctgtataaccatcatcttcctctcgccatccctcctccctgtgtaaccatcatcctcttgccgtcccttctccctgtataaccatcatcctgtcgccatcccacctccctgtataaccattattctctcactggccctcctccctgtataatcatcattctccctgtataaccatcctcccacggagggaccagcatggtttgtggtgagcctttgtgggcaggcaactgactggcacagattccctccgtgacccactgcgagcctgggctgagccccgtctcaactaggccttgaccttggccttcgtgtccatggctggctgagtcttgttatactgagaaccctcccatcctttgcattggatcagattcctcgcccctgaccatcaatgtctaaatcctcggcctgcctttaacaggaactcctgcccttggtgtctaaccaggcaactaacgaccctactttaggtcactatggattagtcagcttccttccttccttccttccgtccttcctcccttccttccttccttccgtccttcctcccttccttccctcctcccttccttcctcccttccttccttccttccgtccttcctcccttccttccctcctcccttccttcctcccttccctccctccctccctacttccctgcctccctccttcccttccttccttccctctttccttccctcccttcctccttccttccctcccccctcctccctccctctctccttcctcccctccctctttctttccttcctccttctctctttcctctcctccctcccttctttcttccctccttccttcccctccctgcctccctccctccctctctcctccctccctctcttttctcctccctcccctccctccctcctttcctcccttcctccctccttctctccttccttccttcccctccctacctccctccctccctctatcctccctccctgtcttcttctctccttcctcccctccctccctcctttcctcccttcctccctccttctctccttccttccttcctccctccttctctccttccttcctcccctccctttcttcatttctttcttccgtccctccctgccttcctttctttcttccttccctcactct

SEQ ID NO: 478849 - DNA, 796 bp, Homo sapiens
cagtgattccaggtccccagcttcttctagcatgtggcttttccacgttccatatgtggcccctgtcctgaggtgggtctccactccagccacttggaactggaagagagcatgggggtgcccgtggcaggggcttctggtgactccctggtgcctaatgagcctgctggtgctgcatgggcagtgggagctcaggtggggcacagcgaatgccagatggccctattcccaggcccacatcgacctccacctgcctcacctgagggaatggctgtctcccccatgacatttgccgtgggacagggttggagctggaccaatgtggactggcggcatgtggcccaagctcccaccctggttgtcttggctccagctatgaaaaagggggctccctctaccccactgatccagcctccaagcgcaaagggcagagggctcttccaagaacagcattccatgcagacctccaacagacagacagacatcacaaaggcgtgcttgagaaaggtatccaaatggcttcttcggtacgtctccacgttccaccttcttgtggaagatacgcactcgccaagccaaggccgcacagcccgcaggttctggacactaagagattgctctgtgatcagtggcaccctgagatcccctggccagcacatggtgagcagcactggtgtgattgagtgcatgacagttgctggggccctgggagaaagcgtgtcccagccatgaactcatctgaccctacaagctgtggaagcacagtctgttttgtggatgagggaaccaggcagcc

SEQ ID NO: 478850 - DNA, 780 bp, Homo sapiens
cagccggggccgccagcttcccgcccctccttccagggaacaccagaggcgaggggcctgaggagcgcagcccaggcctccccgctcctgggaacctcccctcccacactgccctgtagaagccgttcacctgcagacacagcccacatcatgttcctgcagctgcttctccaaggctgcccctcagctggcccggccttccctgcaggctcgccgtgttttcccgtgtgtcagcgctgcgtcctttttaagcctaaattataccccatggcgcagttagaccgcttgttaatccacccgtctgccggaggacacctgggctgtttccaccttttggctgctgtaaatgatgctgctgtgaccgccccgatccccatcacagacctgaccccgatccccatcacagaccagaccccgatccccatcacagaccaggccccgatccctgtcacagaccaggccctgatccccgtcacagaccaggccctgatccccatcacagaccaggccctgatccccatcacagaccaggccctgatccccctcctccgcacggcgtcctgtgggcggccaccgcaccgcaatctattctgagtttgcaagtggaaattaaattccttgtagccgaaatgagcctccacttcaatcagcctgaagcctgtcctcccatcccccaccgccctcccgctgcagcatcttttgaatatgcaaatgggacaccttgctaaatggtcagcaggattgatcctgctgttttcatcaaggaaataaaattaaaac

SEQ ID NO: 478851 - DNA, 615 bp, Homo sapiens
cgcgatgatggtgctgtgcagcccccctcgcctgggggccagggtgtgggggacatgagaggccacccagggctggctcagagctgtgtctcgtcgcgagtctcggggttgcaggacgacagcttgtggctgcagctgctcttccggctctgggagctgctggccacccctctgctgagcggccccactgtggtgcctgtggcctcatctccccagtgcccacctggtgctcagggggggtctccacacagcccacaggccgagcccaggaaatgcctgccgcgggagtcctgtgagccctcgccccccaagcccgctgtggccatgcctgccctggagctgcagtgggagccgcaggaagctttggcgggccagggtggcccaccggtcacatcagagctcatcgtaaacagcaaagcaggagaagcagcaccagggcccgtcctcaacgcccagccaggggacactctgtcggcatgcgaggccttgcccaacagggccgcctgggctgacacctgggacgtgctctcacagctcctgtccacctgcctggccgggatggcgcagcaaggctgccggcggtgaagggttggcgagccccgttgtgcggtggtc

SEQ ID NO: 478852 - DNA, 759 bp, Homo sapiens
gccgtctccaaacctgctttgtggaggagcggatttcccgaagccttcggtctctacggccccgcagggagcagcgcgtctgacgcctgaagcccgccgcggtcagccggccgacagggggcgtgggagcctggcttcccaggggcgtccacggaggccaaggccctgccggatgtcccgccccggcaccccggaaggagtcgcgagagaggcggcccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagagggctccagccaccttcagcgagctgcgactgtgctcctcagccctgacatcatcactgccagtcctattatgaaaaaaaggtcccccattttagatacatagcgatagtgtttttacctagagaagtcgacactggtgtctttgacaagcttagcagtggttgtgatcttagccgccagtctcttaaggggcatatccgcatcccagggctgtggagaccgtctctcaggacttgtttgggaaccagaagaggctgac

SEQ ID NO: 478853 - DNA, 710 bp, Homo sapiens
aaacattgcggatgcatcatctgcttgagtgtagaaaagattttgaactaggaaaaggtgcaaaacctgccagagtgtcatggctggggatggctgcacatcctgcaaattcagggtctctgctacctgataatgcagcaggaggtattgccagcgcaagtggcaagtggcccaccactgtgatagtggtgaccctgctgcatgaacgagatgaggctacaccagatgctgtaccagggaaatctcccatcctcgctgtgggaaaatcagtgtgccatcttctcagggctttgaccgttagaaacataatttgtaattttaaagtcatctcaatcccacctgtgccctttaaggaagaagatagaggccctcaagtgattcgagggtgcccaggctggtttaaaaattttcacaatggaaacttggggttggagagggtggatggagaaagctgcagggagactgaagcctctgatgaggggggatgcccaggaagctctgacttggagaatgtatcatgacaaggtgtctggcctttggtctgcagaccaggcgtttcatgtgcatttcactttcaacctatgtgcatccttagacctaaagtctccattatgcagcatagttttagacagaatactgtcttaaaataaaatttatagaatttcaaaggcaaccaattaagttgtccctcagtatacatgggtgcttgg

SEQ ID NO: 478854 - DNA, 860 bp, Homo sapiens
gtcaccacgcatgtagctggagggttggagagttggtatcagcatggctcttccaaggcagtgggtgcccaaggtggaatgccgcaggttcagggatcgggcccccccttcctttttgttacagaactctgaaatggtgctcagcatttctttaaacactgtcttgtttggacaactgcggcctggcctatcttctgcgtccctgtcttccactctcagggaagctcaagccctactgttgatcttctctccttactgggctcttcttctacgtccttcctcttggtacacagaacatctgcccactcacactctgaacctgtccctttctccatcctcaccactgaatccagccctccctccctatcacctggctgcccctccacgcctcaatccagtcttgacccagcactcagagggaccctctggaatgcaaatgacaacatggcagtgctgggcttcatactcttccattgtctccactcccagtgcccctgcctgggaagtctcgcttgatctagtccctggcctccttgcctcctggtcacctgcacactcattccccaccagatccagcggagcgcccatctcccctgcctccagcagttgctggggacgcctttcccccaacctgaggggctcagtggcagttagaaaggcaagaaactgccaagctgttttctggagtggctgtacattttacattctcaccagcaatgtctgagtgatctaatttctcattgtggttttaatttgcattttctaatggctaataatgctgaatattttctatgtgctcatttgctatctatgtgtctccttagtggaatgtctgcttatgtctttggtccatgttctaa

SEQ ID NO: 478855 - DNA, 700 bp, Homo sapiens
gctctggcaaccacttcctacctttggaattttgggaacctcaacgggaaaaatgcttttttttctcagcgtccatccacttaattttgtgctgtgtgctataccatctcagaaatgcctcattaggggattttgttgtgggagcatcatagagtgtgtttacacaaacctagatggtctagcctactacacacctaggatatacggtttgttcctgggctacaaacctgtgcagcatgtgactgtactgaacactgtaggcaattggaacacaatgctaagtacttgggtatctaaacacagaaaagccagcgctgtggttttgggcgagacgaaccgcacgctctttgggttcggtgaggtctctcggtgcgcccccgtgcgccctgggcgtccgccggctactgcagcacccacgtgcgcccagcctccgccgctgcctcctcagcccgcagggtttacccttggggagaatttgacagaagtagtcactactcggcagattaaccctatgcagatcgggctccgtttccataaccacccaagtcaaaccgctcctggagtgcagggagactgttgatactatttaagccctctattttggcaggtagttatcctgtttaagtttttaatataccgtatactttttaaatgtcatatttaagtttagtgtgtaggttctagtctactttcatgggct

SEQ ID NO: 478856 - DNA, 761 bp, Homo sapiens
cagctgcattccaagttgtaaatctctgtggctgagacctgatattgccgtagtgtgagcatgtgcgtgtgcatatgtgtatatgagtgtgcatgtgtgagcatatgggtgagtgattgggtgcgtgtacacacgtgtgaacctagtcagtggcaccaaattgccataacaggccatctggagaagaatgggggaaggaggaagggagaccacggcagccatgcaccaggtgttgaacacctcttttctgttccatcctcatcttgtactgaccaacacagacaaagagcagctggctccacagagaagaggcaaccgcctggccacgtggcccatgcatggccgaaattttgctggcaagtgcctccaccatcaaagatatcgctaccccctgtggaggagcctctgggaggcacccaggagggcgtgaagacatttttcaattaccattcaacaaggtgtccaattaagaacatggcacagctccaagcctccacgtggcttctgcctccagaaacaatgccacctgcagaggtaacaggctggctctaaaaactgaaatccgttactttaacatagttttaatgagttttctaaagtaacattattcttcatcttttttaacttactgcatttgaaaagtgaaatcaaattgtttttaaaacaaatattcttttgtaaatcctaaatcaggattcttgtctacaaattaagctagtccaagttcactctaataacttgggtttgcctggtgtttgcag

SEQ ID NO: 478857 - DNA, 1774 bp, Homo sapiens
cgttccgagactggagctctacaagcgggacttggagctgcctgtggctctgttattccttactccttggtgatactcttcactttgcctcacgcatttcaaggaaatcacttctcttctaactaaagcagacagaaagagcagacagtaaaacacagataagacagctcgggcacagagggaggtgaggggaaagtctcttgggtaactgccaaacttcaccatcatacaatggggaccagtaaaacaatgggccttaataagcaagcacattcctttcccttcaggggcactaagatagaaaagctaaaagcagactcgggggatatgcctgcagctgcagaaagatgtaagggaacagacacacagctctccctcccagataagcacaacaaagagacacagaagcagtctcagaatccacctccaaccaccggcaacgggtattcactccctaacccttgctcccctcttcctctctctctctctttctctctctctctcttcctcacatggctccagtctgggaggccctttgccaattccaactggaatatccaatatcggacacgaactcagccagctggtaagatctgccttctcctggcttcctcctggtaccagagaaagtccggcctgccatccaggtccttggaggaccaatgggactaagctagagaaaatcttggggatgcccagttccttctcagcttaactggcctctttcagaaagaggatattcacatttaatgtttatggaaatgtaatgtctttattgataattttattataaaatttcataaatcgtgtttttcaaaataagtttatatcaaatccagcttcccagaaacactaatagttcagcatgtcaatgtactaactaaatcattcacttgtacccatggggaagattttagtgttattgccctccacagtgaaaaaaaaaaaaaaaagaaaaaagaaaatctttcatttttaaaattagattaggaaatgttacataacttggcactttagtagtgcatatactagcattagtttatagactgcttttgccactggggagttcaagttgaaatgtccctccgtcatgtagctctggaatacaccttccattcataatttctgctcagataattgaatagtttaccatctaggttattttcatttatacggtaaaacaaagcaaactactcccgtttaatttttttatacttagaatattgcacattttctatatatgagtcattcggattagtatctatgtaggttcagtcagatccaaccatggattcgagttattatactatataaccctataaaatacatagaagtattattactttgcctttaaaacaaaacccaagagtctgtttcgatttatgaattcagcatttaagcaaagagattttagttcccaaagtcgggggaaaaaatgacaaaacaatgagggaagaaggaaccaggccttagtgccacacatttttctctttgggttgtaaggtagagcctccttctttacagaatgctttattatatttttttagacctgattttctgtgtcaaagcataattctcatgctgaagctctagcctaaaaaagcaaaagaaagtcttcattgtacaaaacatattcatcactttaacaagatcataagggaacaaaagttaggatttaaactgagcgataatactgtttgaatgagcatgtccctaagataaaccagaactggcagttaatttagacatctagaaaatctcatttcctaccagt

SEQ ID NO: 478858 - DNA, 541 bp, Homo sapiens
ctgcagtgagccatgactgcaccactgcactccagtctgggtgatggagcaagatcctgtctcaacaagaggaagaagaaggatgaggaggggaagaaggagggggaggaggaggaagaaggactaacaaaagactcaaagaagaaggaagaagaaggggaggaggaggaggaggagaaagaagaagaaagaaggaggagaaggagaagaaaagaagaagaagaagaagaagagaagaagaaaagaagaagaaagaagaagaaagaaaagaagaaagaagaagaaggaagaagaagaaagaagaagaaagaagaagaagaacaagaacaagaagaacaagaagaagaagaaggaggaggaggaggaggagaagaggaagaaggagaagaagaagaagaagaagaagacctaataaaagactcagtgtagtccaatggttaatagtgtggggctaggggtaggctttctgggttcaaatagagtttgaccactgtgggacctgagctgtggtcgtctccaaagatgaccaccatgctatcaa

SEQ ID NO: 478859 - DNA, 627 bp, Homo sapiens
tctggcacacgcactgttggctctgagaagctcctcaaccccttgtgggcatcaaagtaaagaaagaagaaagccctaagtaggagaggttgaagacgatgctgtgggctggcacagctttttgttttgcacatgcggaaattgagactgggagtggaatgtgagcagttcagagttaaacaactaattcgaaagacttatgagtggaggaatctcatcaacataagaggccacgctaagaagcctgggaagcctaggaagccctgtcgttgttcacgcgaatggtcaattgcttgcagttggaagctgagtgggaagtctggcaaacgtcggtattgcttgtgcttcaacttcttaagtgacattttcctacaggacgccttcagcagggagcctggaaggatcagaagaagatgggagaacttccttcctgctggtcacttaggagccagaatgacctttgttacctggacttttccttttctcctcctcatcattgttccatccccactaagaccttcattattttggaaatattaagttagaaatctagtcatggccagcatgagagagggacagggatgcatacaggaatcaaactgaatacattttgtgttttcattcccc

SEQ ID NO: 478860 - DNA, 497 bp, Homo sapiens
tgatcgatcattgcctcctcttgtgcccacaatgtttttgagtgaagacacctggcaatcaaaatgttggcagccctgtgttcattgccaaagtatgccaacgttaacattctcctggttctttgaaatcccagagtctgagaacctctgctccagcagaaaatgggggcaaggtgatggggcggttaagaacgaggagctcctcgttaagctgcaggtagaggtagaacaaaaatctcctacaagcatttgttacaacagcttccgcagaacggaaacaaaagtgtgccactgtgccaatagtgaggctgctgtatttgacgaggaccacagcgccctggcagatagaccctgttctgatttgccaaacctcctggaggtgaatgaaggtttgctgactgtggtcaggaaggtcccaattatgaatgattccctaaccaagtgttgaaaacactttactttgtaattaaaatgcaaaacacatacaaactgccaaa

SEQ ID NO: 478861 - DNA, 582 bp, Homo sapiens
tccaacattggagattgcaattcaacatgagatttgggcaggacatatatccaaactatatcaattgcccttttgtatgggttctaagagtacatagtccactgatccaaaaaagaacaatgcacacaaacactcaagaggccaatatagtaaggaaaataaatcaaaaggagactttattatctagtccaaaaggaaatttgcttccttaccctggatttgtgactttgatggctacaaaccagtggtctatttcaggcagtgccattgaagccataagaaggaaatactttcataaccgcctcataatattcaaagtttctcccccactaggcagtcaaatttcacattattatgccctttctcatatccgcttccaaattatgctgcctcaagcctgccagccaaagaaaggccctgttcccgagccagctgtgtctcagacagttgcttacctgccaaggcttgaagactacctctgcacgggtaattaattctgttctcagtcaagggctttcacatgaatctgttcctggttttccctatttataggttattttatactcacaactctccctcttt

SEQ ID NO: 478862 - DNA, 496 bp, Homo sapiens
gaggcagagactggagtgatggagccaaaagccaaggaatgttggcagctgccatatgttgaaggagtcacaatctttcctcataatctggaggaagtggcaccctgccagcaccttgatttcagacttctggcctccagaactgtgggaggatacctttctgttattttaaggcacacaatttctcatcaagaatgtggaaaagtagaactgctcccatcaggaatcgtggccctgtggaaccccagctcactctttctcttgggagctactgaattctcaggaaaagcctataccaagtccagcaacttcagggccatctgtgacactctgtggacccctcatgaaggttttccccctaactcttatgcaagagaagttgaccatgccccaaagccacatcgaccagacgaatccccatgatatgaggggatgggatgaaattttccaaggtgagggtcgtgaagctacctctacccaagagggagcccgttac

SEQ ID NO: 478863 - DNA, 916 bp, Homo sapiens
tccaggatagagctgacatttcagcttgagcctggaagcagtctgcaggcagtcaatttctcttaagtccttagcaactcactgggaggagaatcataatgcatactgagacctggtttttatacctgttcacacgagtactcagacccaccagccaacttgggaaggtggatgatgtttcccagttccttgctactcagtgtggtccaaggactggcagcattggtgtcatctggaagcctgagggcagcgcagggcagaatgagcttcctaaacatgtggggagaaaccaaggctcccactcaggactgggcacctgggcctgtgagcacgaaaggagcatcggatcaggctcattgtacatttctggcttggagctggctgaccctttccttcttgagccactctgcccacctgctgccgagaaagcagaggccagttcaaacctgggcatggcccttgcggaacaggggctgagagctcatttgaagaagaacagaccactaataaatctcatggtcattaccctttatgcatacttgttctaataggtactttttttcatgtgtctcctcctttggctggttctaatttatatataattaaaatacttctttatttgcggaaatgaagcattgtcataagtatagcattttcctgtgttctgtgagtcattccagttgaggaagttcccttttattcctagttctttgagtatttttattaagaaaaggtaactattgttttgtgaagagccaagaagaacagctgaatgaaacaccctataaagcaacaatatgaggcctcttccatttagttacttccttattttccataccagttgtgaatcttgagaacagaacctctgaattgtaggcagttgccaatttatagcaagcatgttactctgctgcca

SEQ ID NO: 478864 - DNA, 745 bp, Homo sapiens
ccgctgaaaggaaaagtggggtgttaccagacccccagcatggatacacagtgcactgcctacgatgatgactgactgtccatctgtgcacattccccactaccctcagattgcaaagatctcacaacaccctgggatccactttaggagagtagaagggaaattctgcaaaaggatagcaggtctccggagagcctatgcttcaatgcctgtcagaaggcagcatagaagtgtgtctctcatctgccacctggcagcgagctcagggcatcccattacagccaggattctggagactgagaaatacaagttcaagacgccagcatctggtgagggctcctccttgcttctaagatggcaccttgaatgccgagtcctccagaggggagaaatgctgcatcttcacatggcagaattcaaaagaccaaaactgggacaaataattccctttatcaggcccttctataaggggacccaatcccattcacgagggaggagccctcatggtctaatcacctcttacaggccccactccttaatacgatcacactggcagaacctgaattttggaagagacacattcaaaccataacagggccttcactagattattcattataatgaaaagtgtttttggaaagttacaaaagttaaatcagttattgagattgacagaaagccaatggaaaacttaaataggagaataacttgatccaggagggcacctgggtcccttcttggtgtt

SEQ ID NO: 478865 - DNA, 451 bp, Homo sapiens
gccctgatttagactttgggccatgctgacttaccttggaatagagctgggccctcctcctaaggaaggaccagaaatcgggccctcatccaacatcgaacctgctggcactttgatctggacttccaagattccagaactagatttggttcaaacagtctgtgatttccacgttgggctctctctggaaacactccctgtggaggaagatgccacatttgaggacatttgggcagcctatggaaaggcccgtgtgaaactaggtgttggctttgcaggagggatgatttatagaatgccaagaaaggtgattggaaagacaagacggaaggcatgtgatctgaccgtcacatcttgccgtcctcttgggacacttgctgtgagtcctgaaggaggtgacgcaggaggactacctttcagaggaagtttatgaatggctcctgttcccagc

SEQ ID NO: 478866 - DNA, 595 bp, Homo sapiens
aaagatctcaaaatcaaggaaacttttccatcaggagtttccatgtctagtgattttctcctggccaactcttcaatagcacaggtccaagaccgccatgacataggaatggatgaacagttgatatggatcatgccagatgtgttctgctctctcttcatttgttggcttcgaagaagcaaactgccatggactcagctgaaaggagtcaaatgcctccaacaatcacataagcagggaagtggacacttccctggtggagcctctggtgagaacccagccctggctgacgcattaattgcagcctgtgagacctttagcagaagccctcctgatccacagaaactgccatggtatggagcaggtggactgggggaagtactgggagcagtaagtcaatctcccagtgaaaaacatgggatttggagtccagacgacatgtgacttctaatctttccttccaacatagcctttagcaaatcaacttctctcttcaggtcctagtttcctcatcaataataggggaggttgtactaaatttgctacagccttgaaaataattgttaaatatcttctatgagcaatgaactacttc

SEQ ID NO: 478867 - DNA, 667 bp, Homo sapiens
aggggttactttcttttccataaagttgagaaaagaaggcaggaagcatccaacacgggagaaagatgaaggccagaagactcagcaaatcagcttcttccaccttcttctgcctgctttttctggcttcactggcagccgattggatggtgcccacccacattatgaaagaagacagaaaaatgtggaaaagtttgcaacttcatagagacttgttgaatggctttgaccaagtggacaatgaactccaggctgaggtggtctcagatggagacaagaaacttatggggaactggagcaaagttgactctcactatgctttagcaaagagaggggactgtaccctacaaagcccaggggcggagcttcccaaggccgtgggaacccacttcttgcatcagcatgccctggatgtgagacatggagtcaaaggagatcattttgtagctttaatatttgactgcccatctgggttttggacttgcattgggcctgtagcctctttgttttggccaatttatcccatttggagtgggtgtatttaccaatgcctgtacccccattgtatctaggaagtaactaacgtgcttttgattttacagattcataggcaaaagggacttgccatgtctcagatgaaactttgggcttggacttttgggttaat

SEQ ID NO: 478868 - DNA, 1015 bp, Homo sapiens
ctcttttccatggctccgcggaggcattcagctacttcaagatgaagctgagcatctccttcccagccactgacagccggaaactcattgaagaggaactcaaacttcgtactttttatgagaagcctatggccacagaagtagctgctgattctctgggtgaagaatggaaggattatgtggcccaaatcagtggtgagaactacaaacaaggtttccccatgaagaagggtgtcatgacccatggccgtgtccgcctgctactgagtaaggtcctcttacagaccaaggagaactggagaaagaaagaaagaaaatcagtttgtgattgcattgtggatgccaatcttagcattctcaacttggttattgtaaaaaagggagagaaagatattcctggacagactgatactacggtgcctcattgcctggggctccaaagagctagcagaatcctcaaacttttcaatctctctaaagaaaatgatgtccaccagtatgttgtaagaaagcccttaaacaaagaaggtaagaaacctaggaccaaagcacccaagattcagcatcttgttactccacatgtcctgcagcacaatcggcggtgtattgctctgaagaagcagcgtactaagaaaaataaggaagaggctgcagaatacactaaacttttggccaagagcatgaaggaggctaaagagaagccccagaaacaaattgccaagagatgcagactttcctctctgtgagtttctgcttccaagcctgaatccagtcagaaataagattttttgaaaaggcatggaacttaggggaaataaatgaagaggacttttaatcttttttatatagtttattttgaggaatatagctctttaaaacactatacacagtttaatacatgaaaattgcccttgggaagattaacagtgtttttttagaaaagctaacttttaaggcatagtttcagtggatagcatcttaaaatacttcaggaagttttgtaaaccagtgcaaa

SEQ ID NO: 478869 - DNA, 1762 bp, Homo sapiens
tgagacagcgctgagcgccggaagtggggccgaaggaaaacacggagagggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaagctcttgtgttttctatttttttgttttttgttttccctggctttccctaaggtaacaaggactttcatatgcattgtcattataaacctgtttccattataaattttaccctgtgtgtgaactttaagttgaatgccctgcattattggggcactgtgggactcttgtgtatgtatgtttccctttccgctcatctaaattgacaccatattttgagttaaaatcaagagaagtatcctgaagttattttcaggttattcatgtcaaaaaaaaaaaaaaagattttatttaactgtacttaagagaattgcagcatctaaaatgaactttgaaaactagttttaagaaatttgtattggattttgtgcactgttgaattgattttccaagttatgtctgtcttctgcctgtttttaacttt

SEQ ID NO: 478870 - DNA, 535 bp, Homo sapiens
gagtctgtggcgtgggccgtgcaagtggttctcgatcgcaggcatgttttatccatcatgacttggttgttacgatacacagtgtttatttttcttcataaaaagatgcaagctgtgcgcctccaaatgctggcagctcagaatattccatttgtttgtgaagagacagactggatggcacaatttcaatcaaactatgaaatgcaggctggcatgcctggagagaaagatcataacagggcccctggtacacaagcagtagcagggcagaaagaagacgggattggtgatttccagcacgttgtcgttgccacaatttgtccagcacaaggaaaacataagagaatcgagtccaaatcccttattgttgcagatgggaaaactgagacctatgcaggtcacatgcctctgaagcttacacagtgtttatggcaaagcaaaggcttgaacctggtggttagctactgagtcccagtatttaaacatttttatttcattgcctccttatgcaaaccaggtgcacacagatatgttt

SEQ ID NO: 478871 - DNA, 896 bp, Homo sapiens
aacaagtatatgctcaatcaatatgtgctcagcagaagctgaatccgccttgctcttgtggatcttggcggtgcctgcgttggggaaggggcccctggctacctctgggccgtcacccagcaagtgcttttgcacgggctgcctgctgctgccgctcccgccgatgagctgctggggcctgtggcatcatttttcatggctgtgcaatagcccatggcaagtgagtaagtcaaggcctcggtggttttggaggacaactgcagctaaagagtcaacttgggcctggaggactgataaagtttgtgatatgtctgtgatgctagcagagaagtcattagacaggctacaaaatgtcgtgacagaggttgaaatgcctgctattccagtactgagagcaatagtggaggcagaaagtcctaaaccgaccatcaagggaattaagggagttaagagtggcagtttggggatagcaccaagagctatcagctgtgatggattgaagaaacagtgtaaaccggcggtaaataagagtgagtttaagggaagtgggggagagtacttgcgacttccaggaggaagaggagggattaggctggctgtccgatggccacagctttattctggaaaggtgaacccagtggggaggatcctgcaggcagacagcagttggggtactatagataagtaggggtctagggctgtaaagtgtctcagggttgctgccaaacaagtcatgaactgggctggatttttatatttgatgaaaaagagcctaaacgctatctggtttgggataaagaaaaaggagcattaaccttgactatgcctttagctccagccacctttttaagagtaaattgctgggcaggagggggagggctagtcatggaatgaaa

SEQ ID NO: 478872 - DNA, 782 bp, Homo sapiens
ataggacatcgtctctggggttcgctggaaggacttggagttgggtgccacccgtttacgtgggggagttcagctgctggccgggtgcctgttgctaagtacctggaaaactaaacgtggccactagggggtgccgctctcccagagtcctgacccgggtccccatttgggaagggagagagagcaccgggaagggctgctccagcgccctccatcttcctcccgagggaccccgcagatgggcatggtaacaggaatgcttcagagggttgttgtgaaggttacagaaggtgaaggcacatgtcctaagcttggcctggtggacactggctcctggcacattggacctgaagtaaaggaagccaagatgaagggaatagtggagagcttcaaatgtgagaacacattccagctgcaggatcagaggacttttcctacagcccataaatgcctgcagctctatcggatttgcaaatctacaaaagagagcacatcctattgttcccgagaaggcggtaagaacaagggagctgccatttcaaaggagattgttactgatgcggtgacagctgagctgagactcaaaggaggtgagggagtgccaaaagagcctgtgcccagaaaacccggtggtggagcagttcaggcaggggcgagggcagccctaaaggccgaaactgtgctgagcagttaggcactgcacagagtgggtttatagggaagagaacctatacgtttaggagaaaatggaatattaactccagagtttttcatttttaaag

SEQ ID NO: 478873 - DNA, 1799 bp, Homo sapiens
attatattggacctcttccatcatggaaagggcagaggttgtgtatactctgaatcagcgtccaatatatggtactgaatctgccataggcaggattcacagatccaggaatcaaggggtggaagtggaagtggcaccactcaccaacacccctagtgattcgttagcaaaatttttgcttcctgttccctctacattacgttctgctggcctaaaggtcttagttctagagggaggaatgctgccaccaggagacatgacaatgccattaaactggaagttaagattgccacctggacactgtgggctcctcctacatttaagtcaacaagctaagaagggagttacagcattggctgtggtgattgacctggactgtgaagatgaaatcagtctactattccacaatggagggaaggaagaggacatggatgaagctgtaagccatcatcctcgcaaactaacacaggaacagaaaaccaaacactgcttataagtggtagttcactcataagtgggagttgcacagtgagaacacatggtcacagggaggggaacaacacacaccagcgcagcgcccgtttggtgggtggagaaagtttccagtcttttatcataaattatgatattcgcggaaaggttttggtagatggtcttatcagatgaagaaaagtcttcttccctttttatgtgcagaggtttttgtgtgtttttcatttcattttttaacaatcataaatgtgttcacagtttttgcatctctttaaatcgtcatatacttcttccttttttattttctttatatagaggatgatattaattgactttcaaaagttggaccactcttgcattcctgtaataaacactgtctggtcatgatatagtactttttgaaatgtattgctagatggtaatggctaattatgctaaaaaggttttgatatgaaagttatgttggccacattaaatgttgaaaagtgcctttttttatcttctgaaaaccttgtacaatattagttggtgttatttcttccttaaatgcttgatgggatttgccaatgaagttatctgatcctgaggctttctgattgaaaaatgttcttttaaattgtgaaagtttagatctttccttttaaaaatttcttttgtcccatttagggacttccctctcaatattgctttagctgcatttcacaaaattttgatatgtttgtttcccttatcattcaattagaaatattttctaatttcctttgtgatttatttttcgccccatgagttatttagaatactgttgcttagtttccaaatacttagaaaatttcatatctttttgttattcatttgttgtgttggagatcatacttttagttgctttgttattattggataatatactttgtatacattcagttctttgaaatgtattcagaccttttcatggtccagcatatgatttattttggtgaatgtttcatgtacacttgaaaatatgtgtattctgtggttgttgagtgcagtattctataatgttaataatgctaagtttattgataatgttgttcaaatcttctatatatttattgattttctatatatttgttctaccagtttctgaaaaagaaatgttacattctccaacttaaactagagattaatctctcccttagctctgatagtttttgtatcatatattttgaacctgtgtcttaggtgcatacacatttgggattgttatgtcttcttaatgaattatttattgcatcattatgaaatatcattatctttattcatgtcat

SEQ ID NO: 478874 - DNA, 795 bp, Homo sapiens
ccaaagaccgaaggtagataaaccacgaagatgaggaaaaaccagcacaacaaggctgaaaattccaaaaaccagaacgtctcttctccaaaggatcacaacttctcgccagcaagggaacaaaactggacagataatgagtttgacgaattgacagaagtaggcttcagaaggtgggtaataacaaactcctctgagctaaaggagcatgttctaacccaatgcaagatagctaagaaccttgaaaaaaggttagaggaattgctaactagaataatcagtttagacaagaacacaaatgacctgatggagctgaaaaacacagcaagagaacttactgaagcatacccaagtatcaatagccaaattggtcaagcagaagaaaggatatcagagattaaagatcaacttaatgaaataaagtgtgaagacaagattggagaaaaaagaatgaaaaggaatgaacaaagccttcaagaaatatgggactatgtgaaaagaccaaaccgttgtttgattggtgtacctgaaagtgatggggagaatggaaccaagttggaaaacactcttcaggatattatccaggagaacttccccaacctagcaaggcaggtcaacattccaattcaagaaatacagagaacaccacagatacttcttgagaagagcaaccccaagacacatattcatcagattcaccaaggttaaaatgaaggaaaaaatgttaagggcagccagagagacaggttgggttacccacaaagggaagcccatcagactaacagtggatctctc

SEQ ID NO: 478875 - DNA, 606 bp, Homo sapiens
cacaaacaacggcagaaatgactggacaatgaaagcctttgacaacctcggtgaaaatttcaaagggcatgacgaggatgaaattcaggctgtggtgggtggaagcagggagatcagatcaactccctggtgggcttcactgccaccagggagggggaagcagagagcttactcacgctgctttggtgctgaaaggcaagtccagaacctcagttccccactagcaccacagggagagggcaaacagagtggccaactagccctgctttccctaagctcattcagccctacagattttagggagaagtggagtttctgctccctacaagacatggtgatgggttgggggtgggagaagggaagattatctccatggtcagtcctgcagataccacctggtaggggaatcggagcatgccaccctgctttggtggaagtgaagaagctacaaaaatgtcaacctaaccttagctaaactcacttgttagtgattgacaacacattttttgaaaagcatattacctctttgaaatgaaatgtatttagtcctccacagattttcaataaggcataatttataatttcaaaaaataatagagtgtgaca

SEQ ID NO: 478876 - DNA, 579 bp, Homo sapiens
gacaattggagcccacagctgtaagggctctggaagttaggaaacctggggagccaagggacaatgacatatcacttctttgtggaggcgttcgattctctcatttcattaacaggaaaaattcaattgactgccgcggatggcaaagctcgctatcacgtggatcacccagactccctcattttactggttcttcacagcacccaggaagattttagatggacctcaaatacaaaggctcactgggagactgaccttgtgttctacctggcatcctggggaaaggccagcctggggcagcccctagttcttcagatggaaggtgcactttcaatacccagcacaacagaaaacaagttcggagagttttatttacagattgtggacaaggaaggaataataattcaggggagcagtcctccatccccgggtcttgcaatcaacccaggaatgatgagaatgatgagtcaggaagagagagagcacatctagcgattagcagcacatataagggaatagggaatggagtactttaaattcatgggcaaatgcctgatggtccatttaaaggaagctgta

SEQ ID NO: 478877 - DNA, 1037 bp, Homo sapiens
gaagaattgcaaggaatttcaacatggctttattgtctctctgggtgcaagtgggctgtgggcacaagcaagccatatgtacagcatcagcaagggcagtgcagaggggaaatgcagagttggaggcccgacacagagtccccattgggtcactgtctagtggagctgtgaggagagggccactgtcctccagaccccagaatggtagatccaccaacaacttgtactatgtgcctggaaaaccttcaggcactcaatgccagcttgtgaaagcagccaagggggctgtacctggcagagccacaggggtggaacttgccaaggctttgggagcccactctttgcatcagtgtggcctggatgtgagatatgaaatcagaggagattattttagagctttaagatttactgactgccctgctagatttcagacttgcatgaggcctccctttgatgttaggcagagtcttctggtgatggagctgatggtggtggccactgggaattaccccatttgggcatctgagtctgctgagcaagtgggttcagccaggcaatccctgagagaggctggcagaaaaggtagtgctgacatcagactggccctgtgtcatgggcaagatagtcccattatgtctaggtccggcagtcaacaaaggcaagagcctcctataggagtatggcaagccttgggatatgggcatccctggctgtactcccctgcagccattcctgtgcctaaccccctgggtttatacagggtgaagtcctgtctatgtgaactctccgagcagctctcccagacagctcaaatgtccttgggggtcatggggtctcctgcagctaaaattctggagtgttcggatctggaaaagcaacatcctaagcacaacaatgatacaagaataagtagatgagatactgtcaggaaagcaaatgcatataatattcaataaataatatatcccagatttaataaatgcttctaagtgcttcatgtattgaatggttacttcattccctgaagattaatactt

SEQ ID NO: 478878 - DNA, 744 bp, Homo sapiens
tggtttaggaagccttaagaagtttaggactcctctttctctctctttctctttctctttctctttctctttctctctctctctctctctttctctctctctctttctctctctctgtctcattaattccattttcaggcggctggagcagcacacgggatgggggatggtggtggtgattgagatggagtgtgtggctgtaaaagggcaatggaggaacccccttgcctatgtcaatgtcaatatcctcattgtcatttacattcacgaagcacttcaggactcattgccaaggctcttgtgtaagcatctctttggtatgcaggcacagatgaagctcttgaagatggttggtgccccagttatgcttggaatgcctgatgcatttgaattttcaagtttagaacagtattatgtgaaaatgcctcgaaaattccagaaaagaatatgtctaaggggaatgaagaaatataagacattagaggtaagagcccctggtagtcattacagccatctgtctgctttgacaactgctgagatgttccttgctcctgcccacatggcctcttcagtcctggcatctcctgttctttttatgtcatgcttgtgacctgaagctccctgaaaggctgtctgtggccacactagtttgaagcacttctctcaaatcttgtcacctccttaagagcagcacacaaattctctttctcgtcaaaacgagtctttcattaaggaaataactaa

SEQ ID NO: 478879 - DNA, 578 bp, Homo sapiens
tgaaggggtcagggaaatattctgcttcaatactgtgagttccctttcaaagggcggcccagtggtatgcttccaaataatgaagatgaggcagaattcaagggtgataccaagggcccactcacaatttctctttcatgggaaaacagtgtagtgctgaggggcattagtaagaatttggcagacacttgtcctaattccatgggacaaagaaataaaggcaaaggcccctcttctgcagttctgctggagtttgctgggggtccactccagaccctgtttgcctgggtatcaccagcagaggctgcagaacagcaaagattgctgcctgctctgtcctctggaagctttgtcccagagggggagcctcctgatgccagctggagctctcctaggctaatctttatagacagcatgaaaggacccacttgtcctttagggtccatttggatatggctgttgagaagcacctacaagtatttggagaatgggtaagtgcaggatcatggtttttccttctctgaatttctccttgtcaggttgtcaaggcttagctccattgctctactgaaaatcat

SEQ ID NO: 478880 - DNA, 781 bp, Homo sapiens
agatcaaggcagggagttaaattgaaggaggaggcggctgcggccaaggattcagtctgcataggcctggggtggagcctgagcttctgcatttttaacaagtctctagaggatgctgctgcatctgggctgctaactacacttggagagaggaggttctggagagcagaggaaggagcatgaaccataacctaggggctggtagtcctgacttccgagccaaggtttgcctttatgtggctggcaacttgcttggactcctacctcaattctttgggcccaaggtttgtcctgcctcagaaggatgtcaagaaaattgagaagagcctcccagatcagcatcttctgtttctggatactctccctttgaaaagccagatttcagcaaaaagctttcctaatggtgaaattgcacaactgaaaccctatgggagcaatgggaaagatggagaaagaggtggttatatcatgagtcagaaaacagtgaaaggaagtaacatcctatgttggatacctggtagggttagtgaagaaacgttattgctgagctctgtgttacgctcacgaatgatgccattgaggaagtcacacttgttgaaaggaacgcagatacacaaagagttttgctgctgtctgttggataagaaccccctggtcgatttcagctcctactgcaagttagaaaaatcaatccaatgataaatgaaaagtgaccagtgtgctgggaaataacttattttttggcttcagaggaaattttagaaacagtgccaagtgaaac

SEQ ID NO: 478881 - DNA, 1158 bp, Homo sapiens
gtagggcgcggtgggcactgtcagcaccgggatggggctcccctccatggcgcctcctggccggtcctgctgcggctcccggagccggagggaatctgcagcctgccgggggcctccaccagcctggctgcgcgccgggactccgcctcgcgcccgggccccctctccagcagaccgcccgagctgccctcagtttctccccaagttggactcactttcggggtgtcccaaaagcctgattccagggcctgctagcccgaccccggtgacgcctccacccgcgcctggccccagccttcacccgcgatcgccgccctccggggcacaccctccgccagaaaacagccggcgggcggcgagactttgggcagagtccgggttcctctccggcgcccggcccgtctccctgtctccctgggacgaacagcctcagccaaaaataaccctggaaaggcgagctaagaatggttatctcctgccagcgctgaaatcggaggctgggcgctgcacttcaatccaacaggacccactcgagccatccacactttccccagcctcctccaaaacagcacactttccggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttcaaaattgctaagacaataaatttcaaatgttctcaccacaaaaaagataggttttgaggtgatgaatctattaattctctggatttaattattccacaatgtatacatatatcataacatcacatcatacctccgtaaatacatacaattttaatttgtcaattaacatttttttaaaagaatagtgtggccagtcggggaggtag

SEQ ID NO: 478882 - DNA, 638 bp, Homo sapiens
tggaacggattggaattgcaatggaacggaatggaatggaatggaagggaatggaatcaaccccagtggaatggaacggaaaggaatggaatggaatggaatggaatggaatggaatggaatgtatccgaatggaatcgattggaatgtaatggaatggaatcaaacctagtgaaatggactggaatagaatggaatggaatggaatggaatcaacccgagtggaatggaatggaatggaatggaatggaatggaatggaatggaatggaatggaatggaatggaatgcaatggaatggaatctacccgattggaatggaagggaatggaatggaatggaatggaatggatcgaaatggaatggaatggaatcaacccgattggaatggaatggaatggaatggaatggaatggaatggaatagagtggaatggatcgaaagggaatggaatggaatcaaaccgattggaatggaatggaatggaatggaatggaatggaatggaatagagtggaatggatcgaaagggaatggaatggaatcaacccgattggaatggaatggaatggaatggaatggaatcgagtgaacctgagtggaacggaatggaagggaatgaaatgaaattgaaactaccc

SEQ ID NO: 478883 - DNA, 653 bp, Homo sapiens
tggaacggattggaattgcaatggaacggaatggaatggaatggaagggaatggaatcaaccccagtggaatggaacggaaaggaatggaatggaatggaatggaatggaatatatccgaatggaatcgattggaatgtaatggaatggaatcaaacctagtgaaatggactggaatagaatggaatggaatggaatggaatcaacccgagtggaatggaatggaatggaatggaatggaatggaatggaatggaatggaatggaatggaatgcaatggaatggaatctacccgattggaatggaagggaatggaatggaatggaatggaatggaatggaaaggatcgaaatggaatggaatggaatcaacccgattggaatggaatggaatggaatggaatggaatggaatggaatggaatggaatggaatagagtggaatggatcgaaagggaatggaatggaatcaaaccgattggaatggaatggaatggaatggaatggaatggaatggaatggaatagagtggaatggatcgaaagggaatggaatggaatcaacccgattggaatggaatggaatggaatggaatggaatcgagtgaacctgagtggaacggaatggaagggaatgaaatgaaattgaaactaccc

SEQ ID NO: 478884 - DNA, 5055 bp, Homo sapiens
cggaacggaatggattggaatggaatcaacccgagtggaacggcatggactggaatggaatggaatggaatagaatggaatggaacgaaatggaaaggaatggattcaacccgattggaatggaatggaatggaatggtatggaatagaatgcaatggtacaaaatggaatgaaatggataggaatggaatcattctgagtggaatagaagggaatgtattcgagtggaatggaaaggaatgtaatcaacccgatggaatggaagggaatgaaatcgagaggaatggaaaggaatggaatcaacccgagtggaatggaagggaatgcaatggaatggaatggaatggaatcatcctgaatggaatggagtggaatggaatggaatggaatgaaatgaatggaacgaaatggaatagaatgcattcaacccacttggaatggaatggaatggaatggaattgtgtggaatggaatggaatggaatggagtgtgaaggaattgaatagaatcaacccaaatggaatggaatggaatggaatggaatggaatggaatggaatggaatggaatggattcaacccgaatgcaatggaatggaatggaatggaatggaatggtatggattcatcccgaaaggaatggaatggaatggaatcaacccgattggaatggcatggaatggaatagaatggaaaggaatggaatggaatggtatgtaatagaatggaatggaacgaaatggaatgaaattgattcaacacaactggaatggaatggaaaggaatggaatggaatggaatggaatggaatggaatcaacgcgaatggaatggcatagaatggaatggaatggaatgaatcaaccagaatggaatgaaaaggaatggaatgcaatggaatggaatggaatggaatggaatcaacacgagtggaatgaaatggaatggaatggattggaatggaatgcaatggaatggaatggaatggaatggaatggaatcattccgagtggaatggaagggaatgtattcgagtggaatggaaaggaatggaatcaacccgagtggaatggaagggaatggaatagaatggaaaggaatagaatggaatcaaccggagtggaatggaatggaaagaatggaatggaatggaatgaatggaatgtaatcaacccgagtgcaatggaaaggaatggaattgaatggaatgctaaggaatacaatggaatggaacaaaatggaacggaatggattcaccccaattggaatggaatggaatggaatggaattgtgtggaatggaatggaatttggaatggaagggaatgcaatggaatggaaaggaatagaatggaatcaacccgagtgctatggaatggaatggaatggaaaggaatggaaaggaatggtacaaaatagaatggaatggaacgaaatgagtggaatggaatggaatggaatggattggaatggaatgcaattgaagggaatggatgggaatggaatggaatcgaatcattccgagtggaatggaagggaatgtaatcgagtggaatggaaaggaattgaatcaacccgagtggaatggaagggaatggaatggaatggaaaggaatggaatggaatcaacacaagtggaatggaatggaaaggaatggaaaggaatggaatggaatggaatcgaatggaatggaatgaaatcaaccctggaatagaagggaatgtattcgagtggaatggaaaggaatggaatcaacccgagtgcaatggaatggaatggaatggaatggaatggaatggaatggaatcaacccgaatagaattgaatgaaatggaatcaacccgagtggaatggcatggaatggaaaggaatggaatggaattgaatggaatggaacggaacggaatggaatggaatggaatggaatggaatggaatggtatggaatggaatcaactcgagtggaatggaatggaatggaatggattggaatggaatgcaatggaagggaatggaagggaatggaacggaatggaatcattccgagtggaatggaagggaatggaatcaagtggaatggaaaggaatggaatcaacccgagtggaacggaagggaatggaatggaaaggaatggagtggaatcaacccgagtggaatggaatggaaatgaatggaaaggaaaggaatggagtggaatcaacccgagtggaatggaatggaaatgaatggaaaggaaaggaatgcaatggaatggaatggaatggaatggaatggaatcaacccgagagcaatggtatggaatggaatggaatggaaaggaatggaatggaagggaatggaatcaacccgaatggaatggaatggaaaggaatcaacccgagtggaatggaatggaatggattggaatggaatggaatggaatggaatggaatactatcattccgatggaatggaatggaatcaacccgagtgcaatggaatggaatggaacggaatggaatggaatataatcaacccgaatggaatggaatggaaaggaatcaacccgagtggaatggcatggaagggaatggaatggaatggaatggaatggaatggaaaagaatagaatggaatggaacgaaatggaatggaatggattcaaccctattggaatggaatggaatggaatggattggaatggaatgcaatggaatggaatggaatggaatggtatcattccgagtggaatggaagggaattggaatggaagggaaagtaatcgagtggaatggaaaggaatggaatcaacccgagtgcaatggaatggaatggaatggaatctaccagaatggaatggaatggaatggaatggaagcgaatggaacggaatgggttgtacccgagtggaataatggaatggaatcaaatcgcgtggaatggaatggaatggaactgagtcaaacagagtggaatggaatggaatggaatggaatggaatggaatggaatggaatcaccccaaatggaatggagtggaatggaatggaatagattggaatggaatgcaatggaatggaatggaatggaatggaatggaatggaatggaatggaatcaacacgagtgcaatagaatggaatcgaaagaatggaatggaatggaatggattcaacccgaatgcaaatggaatggaaagaaatggaatggaatggattcaacccaatttgaatggaatggaatggaatggaatggaattgtgtggaatggaatggaatgcaatggagtgtaaagaattgaatagaatcaacccgaatggaatggaatggaatggaatggaatggaatggaatggaatgcaatggaatggaatggaatggaatcagctcgagtggaatggcatgctatggaatggattggaatggaatgcaatggaatggaatggaatcattccgagtggaatggaagggaatagtggactggaatggaatggaatggaatgcaatggaacggaatggaatggaatcatcccgaatggaatggagtggaatggaatggaatggaatggaatgtagtggaatggaatggaatcaacccgagtgcaatggaatggaatggaacggaatggaatggaatataatcaacccgaatggaatggaatggaaaggaatcaacccgagtggaatggcatggaatggaatggaatggaatggaatggaaaagaatagaatggaatggaacaaaatagaatggaatggattcaaccctattggaatggaatggaatggaatggaatggattggaatggaatgcaatggaatggaatggaatggaatggtatcattccgagtggaatggatgggaattggaatggaaaagaatagaatcaacccgagtggaatggaagtgaatggaatggaaaggaaagtaatagaatggaatgaaaccgagtggaatggaatggaatggaatggaatggaattgaatggaacggaatcaactcgaaatggaatggaatggaatggaatggaatggaatgaaattgtgtggaatggaatggaatggaatggagtgaaaagaattgaatcgaatcaacccgaatacaatggaatggaacggaatgcaatggaatggaatggaatggaatggaatggaatggaatggaatggaataaatcaacccgaatggaatggaatggaatggaatggaatggaatggaatgcaatggaatggaatggaatggaatcagctcgagtggaatggcatggtatggaatggataggaatggaatgcaatggaatggaatggaatcattccgagtggaatggaagggaattgcaatggaatggaatggaacggaatggaatggaatataatcaacccgaatggaatggaatggaaaggaatcaacccgagtggaatggcatggaatggaatggaatggaatggaatggaatggaaaagaatagaatggaatggaacgaaatagaatggaatggattcaaccctattggaatggaatggaatggaatggaatggattggaatggaatgcaatggaatggaatggaatggaatggtatcattccgagtggaatggaagggaattggaatggaagggaatgtaatcgagtggaatggaaaggaatggaatcaacccgagtgcaatggaaaggaatggaatggaatggaatggaatggaatctaccagaatggaatggaatggaatggaatggaatggaagcgaatcgaacggaatgggtttggaatggcgtggaatggaaaggaatggaatggaatggaatgctacgtaatagaatggaatggaacgaaatggaatggaatggattcaacccaattggaatggaatggaatggaatggaatcattccgagtggaatagaagggaatatattcgagtggaatggaaaagaatagaatcaacccgagtggaatggaagtgaatggaatggaaaggaaagtaatagaatggaatcaagccgagtggaatggaatggaatggaatggaatggaatggaatggaacggaatcaactcgagtgcaacggaatggaatggaatgga

SEQ ID NO: 478885 - DNA, 7532 bp, Homo sapiens
ttggaatcaacctgaatagaatggaatgaaatggcatcaacccgattgcaatggaatcaaatcacgtggaatggaatggaatggaactgaatcaaacagagtggaatggaatggaatggaatggaatggaatggaatggaatggaatggaatggaatcaccccgaatggaatggagtggaatggaatggaatggaatggaatgaaatggaatggaatggaatggaatcaacccgagtgcaattgaatggaatcgaatggaatgcaatggaatcgaatggatttaacccgaatggagtggaaaggaatggaatcaacccgagtggaatggcatggaatggaatggaatgcaatggattggaatgtaatggaatggtacggaatagagtggaatggaacgaaatggaatggaatggaatggaatggaatggaatggaattgtgtggaatggaatggaatggaatggaatggaatggaatggaatggagttggaatggaatggaatggaatggattggaatggaatgcaatggaattgaatggaatcattccgagtggaatggaagggaatgttatccagtggaatggaaaggaatggaatcaacccgaatggaatggagtggaatggaatcaacccgagtggaatggcatggaatggaatggaatggaaaggagtggaatggtacggattagaatggaatggaacgaaatggactggaatggattcaacacaattggaatgtgcaatggaagtcaatgtaatcgagtggaatggaaaggaattgaatcaacccgagtgcaatggaatggaatggaatggaatggaatgaaatggaatggagtctaccagaaaagaatggaatggaatggaatggaaaggaatggaatggaatgtacccgaatggaaaggaatggaatggaatcagtggaatggaatggaatggaatggaatggaatggaatggaatggagtcatcccgaatggaatggagtcgaatggaatggaatggaatggaatcaacacatgtgcaatggaatggaatcgaatggaatggaatggaatggaatggtttcaacccgaatgtaatggaaaagaatggaatcaacccaagtggaaaggcatggaatggaatggaatggaatggaatggaatggaatgtggaataaaagggaatgttttcgagtggaatggaaaggaatggaatcaccccgagtggaatggaagggaatggaatggaatggaaaagaatagaatggaatcaaccagagtggaatggaatggaaaggaatggaatggaatggaatggaatggaatggaatggaatggaatcaactcgagtgcaattgaatggaatggaatggagtggaatggaatggaatggaatggaatggaatcaactcgaatagaatggaatgaaattgaatcaacccgaaatcaacccgaacggaatggaaaggaatggaacggaacggaatggaatggaatggaatggaaaggaatggaatggaatggaatggaatggaatcaactcgagtggaatggaatggaatggaatggattggaatggaaggcaatggaagggaatggaagggaatggaacggaatggaatcattccgagtggaatggaagggaatggaatcaagtggaatggaaaggaatggaatcaacccgagtggaacggaagggaatggaatggaatggaaaggaatggagtggaatcaacccgagtggaatggaatggaaatgaatggaaaggaaaggaatgcaatggaacggaatggaatggaatggaatggaatcaacccgagagcaatggtatggaatggaatggaatggaatggaatggaatggaatggaatggaatggaatcaacccgaatggaatggaatggaaaggaatcaacccgagtggaatggcatggaatggaatggaatggaatggaacggaatgatacggaatagaatggaatggaacgaaatggaatggaatggattcaacccaattggaagtggaatggaatggaaaggaaatgaatggaatggaatggaatggaatggaatggaatggaatggaatgaaatggaaccaacttgaatgcaatggaatggaatggaaaaggaatggaatggaatggaatggaatggaatggaatggaatggaatggattgtatccgaacggaatggaatggaatggaatggaatggaatggaattgtatggcgtggaatggaatgaaacggaatagaatggaatggaatcaaatcacatggaatggaatggaattgaatcaaacagagtggactggaatggaatggaatggaatgcaatggaatggaatggaatcatcccgaatggaatggagtggaatggaatggaatggaatggaatgtagcggaatggaatggaatcaacccgagtgtaatggaatggaatggaacggaatggaatggaatataatcaacccgaatggaatggaatggaaaggaatcaacccgagtggaatggcatggaatggaatggaatggaatggaatggaaaagaatagaatggaatggaacgaaatggaatggaatgcaatgaaccctattggaatggaatggaatgcaatggaatggaatggaatggaatggtatcattccgagtggaatggaagggaatgtaatcgagtggaaaggaaaggaatggaatcaacccgagtgcaatgtaatgtaattgaaatggaaaggaatggaatcaacccgagtgcaatggaatggaatggattggaatggaatggaatggaatggaatggaatctaccagaatggaatggaatggaatggaatggaatggaatggaatggaatcaaatggaacggaatgggttgtacccgagtggaataatggaatggaatcaaatcgcgtggaatggaatggaatggaactgaaacaaacagagtggaatggaatggaatggaatcaacccgagtgcaatggagtggaatggaatggaatggaatggaacggaatcaactcgagtgcaatggaatggaatggaattgtaaaggaattgaagagaatcaacccgaatggaatggaatggaacggaatgcaatggaatgtaatggaatggattggaaaggaatggtacggaatagaatggaatcgaacgaaatggaatggaatggattcaacccaattggtatggaatggaatggaatcgaatggaatggaatggaatggaatggagtgtacagaattgaatagtattaacctgaatgcaatggaatggaatggaatggaatggaatggaatggaatggaatcaactcgagtggaacggaatggtatggaatggattggaatggaatgcaatggaatcattccgagtggaatggaagggaattggaatggaagggaatgtaatcgagtgtaatggaaaggaatggaatcaacccgagtgcaatggaatggaatgcaatgcaatggaatggaatagaaactaccagaatggaatggaatggaatggaatggaatggaatggaatggaatgtacccgaatggaattgaatggaatggaatcgtatggcaatggaatggaatcaaatcgcgtggaatggaatcaaatggaactgaatcaaacagagtggaatggaatggaatggaatggaatggaaaggaatggaatggaatggaatggaatggaatggaataatcccgaatggaatggggcggaatggaatggaatggaatggaatggaatggaatggaatggaatggaatcaacccgagtgcaatggaatggaatcgaatggattggaatggaatggaacggattcaacccgaatggaatggaaaggaatggaatcaacccgagtggaatggcatggaatggaatagaatggaaaggaatggaatggaatggtatggaatacaatggaatggaacgaaatggaatggaatggaatggaatggaatggagtggaatcattccgagtggaatagaagggaatgtattcgagtggaatggaaaggaatggaatcaacccaagtggaatggcagggaacggaatggaatggaaaagaatagaatggaatcaaccagagtggaatggaatggaatggaatggaatggaaacaactcgagtgcaatggaatggaatggaatgcaatggaatggaatggaatggaatggaatcaactcgaaatggaatggaacgaaatggaacggaatggattcaacccaattggaatttaatggaatggaatggaattgtgtcgaatggaatggaatggaatggaatgtcaaggatttgaatagaatcaacccgaatggaatggaatggaacgcaatgcaatggaatggaataatggaaagaaatggaatggaatggattcaacccaattggaatggaatggaatggaatggaatagaattgtgtggaatggaatggaatggaatgcaatggaatggaacgcaattgaatggaatggaatggaatcaactcgagtggaatggaatggtatggaatggattggaatggaatgcaatagaatggaatggaatcattccgagcggaatggaagggaatgtaatcgagtggaatggaaaggaatggaatcaacgcgagtggaatggaagggaatggaatggaatggaaaggaatggaatggaattaacccgagtggaatggaatggaatggaatggaatggaatggaatggaatgaaatggaatcaacccgagaattgaatagaatcaacccgagtggaatgggatggaatggaacagagcggatgggagtggaatggaatgaaaacgaatggaatggaatggaatggaatggaatggaatggaatggaatcaactcgagtggaatggaatggattggaatggaatgcaatggaatggaatgtaatggaatggaatcattccgagtggaatggaagggaatgaaatcgagtggaattaaaatgaatggaatcaacccgagtgcaatggaatggaatgcaatggaatggaatggaatggaatctaccagaatggaatggaatggaatggaatggaatggaatagaatggaatggaatggaatggaatagtggaatggaatggaatggaatggaatcatcccgaatggaaaggagtggaatggaatggaatggaatggaatggaatgaaatggaatggaatgaaatggaatcaacccgaatgcaatggaatggaatggaatggaatggaatggaatgcaatggaatggaatcgaatcgaatcgaatcaattcgagttgaatggaatggaatggaatggattggaatggaatacaatggaatggaatggaatcattccgagtggaatggaagagaatgtaatcgagtggaatggaaaggaatggaatcaaccgagtcgaatgaaagggaatcgaacggaatggaaaggaatggattggaatcaacccgagttggaatggaatggaatggaatggaatggaatggaatggaatgtagtcgaatggaatggaatcaacccgagtacaatggaatggaattgaatggaatggaatggaatggaatgaatggaatggaatcaactctagtgcaatggaaacgaatggaatggaatggaatagaatcaactcgagtggaatggaatggaatggaatggattagaatggaatgccgtggattagaatggaatcattccgagtggaatggaagggaatgtaatcgagtcgaatggaaagcagtggaattaacccgtgtggaatggaagggattggaatggaaaggaaaggaatggaatggaatcaacccgagtggaacggaatggaatggaatggaatggaatagaatggaatggaatggaatcaacccgagtagaatggcatggaagagaatgcaatgtaatggactggaatgccgaggggaatggtatggaatggaatggaatggaatggaatggaatggaaaggaatggaatggaatggaatggaatcaacccgagaacaatggaatggaatggaatggaatggaatggaatggaatggaatcaacccgaatggaatggagtggattgaaatcagtccgactggaacggcatggaatggaatggaatggaaaggagtggaatgtgcaatggaatggaatggaatggaatggactggaatctaccagaatggaatggaatggaatggaatggaatggagtggaatggaatggaattaaatggaatgcattcaacccgattggaatggaatggaatggaatggaatggaatggaattgcaattgaatggagtgtaaagaaattgaatagaatcaatccgaatggaatggaatggaatggaatggaacggaatggaatggaatggaatggaatggaatcaactcgagtggaatggaatggaatggaatggattggaatggaatgcaatggaagggaatggaagggaatggaatggaatggaatcattccgagtggaatggaaaggaatgtaatcgagtggaatggtaatggaatcaacacgagtggaatggaaggaatggaatggaatggaaaggaatggaatggaatctacacgagtggaatggaatggaatggactggaatggaatggaatggaatggaatcaacccgagagcaatggaatggaatggattggaatggaatggaatggaaagaaatcaagccgcgtgcaatggaatggaatggaatggaatggaatggaatcaacccgaatagaatggaatgaaatggaatcaacccgagaggaatggcatggaatggaatggaatgcaatggaatggaatgaatcaacccgaaaggaatggaatggaacggaactgaatcaaacagagtggaatggaatggaacagaatggaatggaatataatcatcccgaatggaatggagtggaatggaatggaatggaatggaaaggaatggagtggaatggaatggaatggaatggaatcaactcgaatggaatggaatgcaatggaatgcattggaatggaatgcaatggaagggaatggaagggaatggaatggaatggaatcattccgagtggaatggaagggaatgtaatcgagtggaatggaaatggaatcaacacgagtggaatggaagggaatggaatggaatggaaaggaatagaacggaatcagcacgagtggaatggaatggaaacgaatggaatggaatggaacggaatggaatggaacggaatggaatcaacccgagaacaatggaatggaatggaatggaatggaatggaatggaatggaatggaatggaatggaatcatcccgaaagttatggagtggattggaatcaacccgagtggaacggcatggaatggaatggagtggaaaagagtggaatggtacggattagaatggaatggaatgaaattgactggaatggattaaacccaattggaatggtatggtatggaatggattggaattgtgtggaatggaatggaatggaatggaatggagtgtaaaggaattgaatacaataaacgcgaatataatggaatggaatggaatggaacggaa

SEQ ID NO: 478886 - DNA, 570 bp, Homo sapiens
cttgacactcaacatccatccatgctgctgtgtgcatcaacagtttctttttatttttttggctggcctgagagggcctctggagcctgcaggcccatgggacatgatcaaacataccatgttgtcacaagccccgagctattgtctaagaaaggggaaggccttggccatggacacaccctcagcccatctccacggagcagtcactcacacgtgtatctcaagcctggtcactgtcaaggcatcagaccctcctgcctgggccgtggagagcaccatccagggaccccccggggccccagacttctaggagcagtatatgtagatggagagggggaaaagagacagtggaggagtaacactaaccagttagacatcattgtggagaagaattttgtgtctggtataattttgtatcatggccattatggaataaaaaaagataatgatcctcatactattaatactgtagaccactgaaagcgtaaagtaagatgtttcttttctccatttctttcatttcactttttaataagtggtgaattctatgaaccaattccccagggtcac

SEQ ID NO: 478887 - DNA, 496 bp, Homo sapiens
atcacactgtagattccatttcaatacatgaatttcagggggatgcacgccaatcatagcagtcaccaaaatggatattggtacagtcacacagtgcgaaccacagtagaagtttccagctccaacaacatttcctgtggactgaacagcacggtggaattgcttctggcaggttctgatcctgggaaagaaggccctgaggccctcagcactgacactgatgtacctgagtgcctgcggttcctggaacaacctcgcacagcacgacacaagagggaaaagcctagagcaggccccgtgactactatggccagtccagtgccgctggcagcaagcttgcatgttttgggcatctcagctgccctgactccggctgtgccccaccatgaggtgcgaagagctcccaggctctcatatccctgtgtgatcagcctcagaagaaccttggaagcacagacatagggatgaatcaggttaccatgaattactaactaca

SEQ ID NO: 478888 - DNA, 805 bp, Homo sapiens
ttccgttaagtggaaaaacccattttaattctggtacaaaggagatgcacactcctgctcggagtcactctaatgacatcagccgggatgaagccgttcccgccactaacatcatcggcagtccttatgaggaagatgagaaacctttctgcatttgactcttgcagaaataagaaccaggggagtgaaggggctcacccagtgtcacaggagcagtcaggggtggagccagcgtgtggacacaaggcctcttccagctgcccactgtttctatgctgcctctccgcaccccaccgcagtcaggaacctcgaaggctttctgtggttctcctgcgcaccagctgccaggacctgaccactgcacccaccatcgccagcacagaaaaaatatcaccactgtatcagggcagatggtcgggaacagcaacaaaacattccccaactagagccgcaaacacaaacagcgcccatcatgcagaaattgccttggcgtgcgggtcattggtgatttcatttgacgccgcggggccgagagcagagctcacccttgagtctgcaaccttggctctgaaggtcctcggccctttctccaagggtagttccagaatctttcagacagtagtttcaacatctgtttgtggcttcaaggacaaagaaaataaagttaatgctctcaaactctgccactgctctatccactaaatttatggaatattataaagcctttgttgtcatttcaatgatgtttatagcatcttcaacaggaggggacttcatctccagaaactactttctttgctcatcc

SEQ ID NO: 478889 - DNA, 766 bp, Homo sapiens
gctttgtggggtcagtgccctgaaaggcaactgcggcgtctccaggcaggcagttgtgaacactgaccacccatcctatcggtcttctgctgcttcagcgtcggttcacgactctccactcagggccacactgcgctcggtgattgagccccacctgaggcacaaccccaggccacagcaccgtggggggttctgcccacggcttggggcacaggtgccagtgctgcccagagtgtggactgtggctctcggccatcgtcacggcaggtgatgcttgggacaggatgttgcctctcctcattcctgagtcttctcctgcaggaagagagaaactgtctgctgaggaacccgttattaagactgttgaagctcaaacgcgtggaatccagaaagtggaggctctcaggaggttttctctcacagaacaggctcacgctgccggccctgggggcaccctgtgccagtctcacccatccccatcctcacacagcaatggtgagtctcccttacttctgtttggagatgaagggtttgggcttggaggcccgcagagtggtggacccaagattaaagttcatgtttgtcttatagttcaaactttacgttcatcggattacaggaaatcacaggtggtttcgttgcccatggccaaagagggatcttttcagtatatcccactccttccccaactccaaggggaatgagatgggaatcaggtgatttctgcttcgaggatttgccagtgggaaggaggcccgaggtgacc

SEQ ID NO: 478890 - DNA, 651 bp, Homo sapiens
gtgatgggaacccacactatacgtatataccaaatactctatgtacagacatgcatcacgccatgatgcggatacctcctgagaagtgcattgttaggcaattttgttaccgtgtgaacatggtagagagcatgtacacagacctagacggcatggtccaggcacccctaggctgtatggcgagacggcaagaaagaagcacaggggctttggagattcacatcagtaatggtaaagaagaaaggatgctgcaggcagtgtcagaggcaggaatgatcaggtgtcagggccacagaaatgtgctctattttcctctggaaaatgttgaatccatgctccccctaaatgcacactatttccccaagatatgggaagtaataaatggttttgacataggagactggcaggacgtgtttcctggtcacagccctgctgacccaagcagggtccggtccagacaagataaagtgaagaaagccatgggaaccagcagatgctgctcaaagcaatccctggctgccctcactgctggctggcataaagatgcttccaccagcgccatgacagtttaccaatgccatggcaacagcccagaagttatcactgctttcagtggcaacaacctagaaggggctgccctttcctagggag

SEQ ID NO: 478891 - DNA, 740 bp, Homo sapiens
ttatagaagtcagtagaatattcagaatttcatttgcatttctgatcatcaaggtgaccaccactgccagcatgtgcagggtacctgcattgtgtctcttggccacagcgggtccttctgcaggtggagctgtggtctttgcagaaagtaaacaaaactatttcaatgaatcctgtgtcaaaaaaattaaaataaatctgtgtgatgtcatctgcgtctgccaacctgcccttccaaagagacgcaagatggaagctttcagtgcttgtcctgaccacccagcaacagctgcccataagggcaacctgtcccaagaggcttccgatagcatctgcgtcctcttctgcatgttgtcacccacgaaggaggcctgcgtggcacagagcccacagtgccatatttctgaagcagtggaaggaattgctctgggtgacgccggtggaaggaattgctctccgctgaccctagcaatggatgctgagccaggagcaagtgagaacaaggtcccacgagatcagccggagggcatggggaataagcttctgtcccttcaaggaggccaaagtcctattcgtctaccttgtcgtgtaggtttgtgtgtgggcgagtatttgttctcctttgccctgtagagtcctattcctctacctcgtcgtgtaggtttccgtgtgggggaatgttgctcccatatcagaacagaagcaccttgcagggggaaggcttgtttccttaaggtctcc

SEQ ID NO: 478892 - DNA, 539 bp, Homo sapiens
gctgtgttgcttttgcctgtctccagcagcctagtatatagacaactaactaaatgtctcattgtctccacctgggggtagggaccagtgtcggagaaaaaggctcatacgatgaggaccagcttcttgtggatctccaggtctctgaccacagcactgaattcctcaaaggatatcttcccatcgccatccttgtccaggatgatgatggttttgtcgaccagctgctggagctgccagtccgtcaggttgttgcccaccatcatcttcagcacctggaagagctccccgttggaaatgtagccatctttatccatgtcgtaaatgctgaacgcaaacctcaacttctgctcctcgtcgcccttgacgctgaactgggaggtccccaggatgaattccttgaagtccacttctccatcaccgtcggtgtcgaagacgtcgatcactcgccgcaccaacgggttgtggcgcagctccggcagggacatgaactcctccacgctcagagaccctgatttgtccaagtccaacttcttaaa

SEQ ID NO: 478893 - DNA, 740 bp, Homo sapiens
acccaacagctccgaagagacagcgaccattgagaacgggccatgatgacgatggtgtgcgggtacgcagggagcacagtcgttgtgccaggtgggtgccagcacacagcagtcattgacattgtacagacttctggagtaaatggagggatggatgaaacacttgtgcaatcgaaatttttgcgactccttccatttgacaagtacggtccacgccattcattccccaacccaaagcccgcgaagccccgcagcttacacagaggccccgcccaaccgccccgctctgcgcgctccctcagctccagcgcagcagctctgggagacacgctgaacggtagtcaagttccgggtcacagtgcgcttgctggtcaagaattgctgctttgcagtgagacagatccagattccagtgtctggtgtgactgtgtgtggccttgggcaagttatctgtccaagtttcaatcgctacctgtatcaaatgtagttgattgtagttgtgtgcatcacagggattttgtgaagattaaatgacgtcgtatgtatcaagggcttagcgcactgcctgaaatatttattataaattggacacaatactgacagtttatatttaattcttaacttatgaaaacactgtaagcaaatcctttcagatgctacagaagagtaacatcatcttgtcatcttccattggtgtcttgcttttttagctttgcctatacatactaactactcatttt

SEQ ID NO: 478894 - DNA, 488 bp, Homo sapiens
cccgttcccctgaagtcattggtggccaggaatgatcccctgtattgtggccacagggccccagtcacttttggcttgtaagttttcagctgagaagtctgctgttagtgtgatgggcttcctattggtacatgtgcacaacgtgcagtcaaacccctcttctccaaatctgctgcagtttgctgaggtccactccagacactgttctcctgggtatcaccagtgtaggctgcagaacagccaagattgctgcctgctccttcctctgggagattcatctcaaaggggcaccggcctgatgccagccagagctcccctgtgtgagatgtcctgggcctggtgcactgtgctgggagaatcccctttgccaggatcagttgctcttttcagagcctgcaagcaggaaagattaagtctgctgaagctgcaactgcagccgcccctccccagatgctccgtcccacggagatgagagttttatctgtaaa

SEQ ID NO: 478895 - DNA, 814 bp, Homo sapiens
ggtccctttcagccataactggtttttatggttttaggtctaacattcaagaccctcagctgtaggtctgttggagtttgccgatggtccactccagactctttttgcctgggtatcagcagcagaggctgcagaacagcagatattggtgaacagcaaatgttgctgcctgatcgttcctctggaagttttgtctcagaggagtacctggctggtgagatgaacccagtacctccattggaaatgcggaaatctcccaccgtctgcgtcactcatgctgggagctgtagactggagctgttcctatttggccatcttggctccacccccgaaaactggtcttttaagttgtctcctgaagtctgggaaggctctgtgggctgggtgacctcctgtcctctgtccccaggcttaagaatcttcgagcagacaaaatggaacatttatatgcaagtttggtgacataaatcaagtgaggaaaagtccattttcatgtggtcattgtgtcaactgttattatttcagttcagcctggccacatatataaatctcctttaagaaaccagaaaaggaatatgtgaaataacatttctagtatgcatggtcacttgcttctattaataattactacttgtaaagcctggaaatgcttaagttgttcatattttttgagcgattgactggctcttttatttatacatacaagaaaaaaagccaagtggagagaggaaatcatctgttgctgcagaaacatgaaagtcacatttttggcactgttccctggttgacaaaccagctggatttaggttaggaa

SEQ ID NO: 478896 - DNA, 674 bp, Homo sapiens
ccggccatttgcactgcctctggcttatctgcctcattctgcattaggtatatctcctaatgctatcccagccctcttcccccaacccacaacagtccatggtgtgtgatgttcccttcctgtgtccatgtgttctcattgttcaattcccacctatgagaccctcagctgcaggtctgttggagtttactagaggtccattccagaccctgtttgcctgcatatcagcagtggtgactgcagaacagtggatattggtgaaccgcagatgctgctgcctgatcgttcctctggaagttttgtttcagaagagtaccaggctgttcttgagcctgctcagctgtgacacaaatcttccccatgtgcaatgtccatctgagccttttgaaatccctctaaaaaatgtagtatggacaaggagaactaatacaaatatgaggcttttgcctccaggtagacagtaaatagtaggtatttttttcatacttcagtgtctcatgccttctaccagcatccatggaaatggaaggttaataggtttgtttacaaataggatgaaatcttagatccttcacaattatttaattttggagatgacaatgggatgctgagataaacacaactttctgaaaggggaaaatacacaaatacttgaagagcttgcaacggatatg

SEQ ID NO: 478897 - DNA, 1715 bp, Homo sapiens
tcgaacggattggaatcaaacggaatgggatggaacggaatggaaaggaatggaatggaatcaaatggaatggagagtgtaacggaatgatatccaatggaatggaatttaatggaatggactcgaaaggaatggactggggtggaatggactggaatggaatggactcgaatggaatggactcaaatggaatggactggagtggaatggactcgaatggaatgcaaacgaatggaatggaatgcaatggaatggaatggaaaggaatagaatggaatggaatcggatggaatagaatggaatggaatggagtcaaatggaatagaattgaacggaatggcatcaaatggaatggacaggaatggaatggaattgaatggaatggaatggactcgaatggaatctatggaatggaatcgaatggaatggaatcaaagggaatggaccggaaaggagtggactggaatagaacagacacgaatgtaatgcattgcaatgtgtatgattcgaatggaatggaatcaaatggaataacggaatgcaatggaatggaaagcagtggaatcaagtggaaaggtatcgaatggaatggacttgaatgcaatggactggaattgaatgcagtcgaatggaatggagtggatcataatggaatcgaatggattggaattcaatggaatggaatggattcgaatggaatggagtcaaatggaatggaatcgaatggaatggaatttaatagaattgaattgaatgaaatggaattgaatggaatcaaaaggaataaaatggagtggagtgtaacggaaagatatcgaatgaaatggaatggaatggaatggactcgaatggaatggactggaatgcaatggactcgaaaggaatggaatggaatggaaaggaaaagatggaatggaattggatggaacggaatcgaatggaatggagaacaaaatggaattcaatggattggaatcgaatggaacggaatggaatggaatggaatgcattggaatggaatggaatggaatggagtcgaaagaaatggagtcgagtggaatggaatcaagtggaatggagtcgaatggaatggaatgggattgaatggaattgaaaggaatacaatggaatggagttgtaatggaaagatattgaatggaatggactcgaatggattggactcaaatggaatggactggagtggaatggactcgaatggaatggatcggagtggaatggagtcgaatcgaatggaaacgaatggagtggaatacaatggaatggaatggaatggaatggaaaggaaaggaatagaatggaatggattcgtatggaaagtaatggaagggaatggagtcgaatggaatagaatcgaaaggaatggcatcaaatggaatggactggaatggaatggactcgaagggaatataatcgaatgaaaaggcatcgaatgtaatggaatggaatggcatggaatggaatggactcgaagggaatataatcgaatgaaaaggcatcgaatgtaatggaatggaatggcatggaatggaatggaattgactcgaaggaatataatcgaatgaaaaggcatcgaattgtatggaattggaatggcatgggaatggattggatggaattggacccagatgtgattgacacggaattgaattggactcaaacagagtggaatccgaaaaaatggtcccgaaatgaat

SEQ ID NO: 478898 - DNA, 1787 bp, Homo sapiens
aacatcgtcaaatgaattcgaatggaattatcatcgaatgaaattgaatggaatcatcatcgaatggaatcgaatggaatcaccatcaaatggaatggaattgaatcatcatcaattggaatcgaatggaatcatcgaatggaatcgaatgaaatcatcatcgaatggaatcgaatgaaaatggaatggaatagaatcatcgtcgaatggaatcgagtggaatcaacagtgaatggaatcgaatggaatcctcatcaaatggaattgaatggaatcatggaatgcaatcgaatggaattatcattggttcgaatcgaatgcaatctggaatccagtggaatcatcgaatggaatcgaatggaatcatcattgaatggaatcaaatggaatcatcgaatggaatcgaatgaaatcatgatcggatggacacaaatggaatcatcatcaaatggacaaaaatgcaatcatcatcagatggactcaaagaatggaatagaatggaatcatcctagaatggaatccaatggaatcatcaaatggaatcgaatggaatcatcatcaaatggaatcaaatggaatcatcatcgaatggaatcgaaggaatcatcgaatggaatcgaatggcatcattggatggacacgaatggaatcatcatcggattgactcaaatggaatctcgaatggaatcatcaaatggaatcaaatggaaacatcatcaaatggaatcgaatggagtcatcaaatggtatcaaattgaatcatcatcgaatggaatcccatggaatcatcaaatggaatcgaatggaatcatcaaatggaatcaaatggaaacatcatcaaatggaatcaaatggaaacatcatcaaatggaatcgaatggagtcgaatggaatcatcgaatggaatcaaatggaaacatcatcaaatggaatcgaatggatcccatggaatcatcaactggaatcgaatggaatcatcgaatggactcgaatggaatcatcgaatggaatccaatgggatcttcattgaatggaatcaaatggaatcatcatcaaatggaatcgaatggaattattgaatggaatagaatggaatcatcatcggatggacacgaatggaattatcatcagattgacttgaatggaattaatcttcttccaatgcacatgaatggaatcatcattggatggactcatatggaatcagcatcgaatggactcaaatgcaatcatcatcagatggactcgaaagtaatcatcatcggatggaatcgaatggaatcatcatcaaatggaatcgaatggaatcatcaacggatggaattgaatggaatcatcatcagatggaatcaaagggaatcatcgaatggaatcatcatcgaatggactcgaatggaatcatcatcagatggacccaaatggaatcatcattggatggactctaatggaatcatcatcggatggacccgaatggaatcatcatcagatggactcaaatggaatcatcattggatggactcgaatggaatcatcattggatggactcaaatggaatcaccattggatggacacgaatggaatcatcattggatgaagaagaatggaatcatcattggatggactcaaatggaatcatcatcggatggaatcgaatggaatcagcatcaaatggaatcgaacggaataatcaaatggaatagaatggaatcctcatcaaatggaaacgaatgcaatcattgaatggaatggaaaggaatcgtcatcaaatgaaatagaatagaatcatc

SEQ ID NO: 478899 - DNA, 638 bp, Homo sapiens
gaatcgaccagaagtatcattgaatgaagttgaatggcatcatcaaatggaacctaatggaatcattatcgagtggaatcaaatggaatcatcgaatagaatcaaaaggaatcatcatcaaatggaccctaatggaaccatcatcgaatggaatcaaatggaatcatcatcgaatggaccctaatggaaccatcatcgaatggacacgaatggaatcaccatcgaatggagtcgaatggaatcaaaggaatcaaatggaaatatcatcaaatggaatccaaaggaatcatcgaatggaatcaaatggaatcactgaatggaatcgaatgaaatcatcattgaatggaatcgaatggaatcatcaaatgcaatcaaatgaaatcatcatcaaatggaatcgaatggaaacatcatcgaatggcatcaaatggaattatcatcgaatggaattgaatggaaatatcatcgaattgaatcgaatggaatcatcatcaaatggaatcgaacggaatcatcatatattggaaccgtataaaatcattgagtggaatcgaatggaattatcatcgaatggaatcaaaagggaccatcatcgaatggaatcgaatggaatcatcatcgaatggaattgaatggaa

SEQ ID NO: 478900 - DNA, 2060 bp, Homo sapiens
gaatggaaccatcatcgaatagactcgaatggaatcatcatcgaatggactcgaatggaatcatcgtcaaatggactcggatggaatcatcttcgaatggactcgaatggagtcatcatcgaatggactcgaatggagtcatcatggaatggactcgaatggaatcatcatcaaatggactcgaatggaatcatcatcgaatggactcaaatggagtcatcgtggaatggacttgaatggaaataatcatcgaatggactcggatggaatcgtcatccaatggactcgaatggaatcatcatcgaatggactcgaatggaatcatcatcaaatggactcgaatggagtcatcattgaatggaatcgagtggaatcatcatccaatggactcgaatggaatcatcatcgaatggacctgaatagaataatcatcgaatggactcagatggaatcgtcatccaatggactcgaatggaatcatcatcgaatggaatcgaatggaatcatcgaatggactcgaatggaatcatcatcgaatggactcgaatggaatcatcatcaaatggactcgaatggagtcatcattgaatggaatcgagtggaatcatcatccaatggactcgaatggaatcatcatcgaatgggctcgaatagaatcatcatcaaatggctcgaatggaatcgtcatccaatgaactcgaatggaataatcatcgaatggaatcgaatggagtcatcatcgaatggacccaaaaggaatcatcatggaatggactcaaatggaatcatcatcaaatggactcgaatggaatcatcatcgaatggactcaaatggagtcatcatggaatggacttgaatggagaatggaatggaatgcattggaatggaatgcattggaatggaatggaatggaatggagtggactggagtgaagtggagtggagtgaagtggagtggagtggagaggagtggaatgtagtggaatggaactggattaaatggaatggaatggaatggactcgaatggaatggactcgaatggaatggaagggacttgaatggaatcatcatcgaacggactcgaatagaatcatcatcgaatggactcgaatggaatcatcatcgaatggactcgaatggaatcatcaccgaatggactcaaatggaatcatcttcaaatggaaccgaatggaatcatcatcaaatggaattgaatggaatcatcaaatggagttgaatggaatcatcatcgaatggaatagaatggaatcatcatcgaacggagttgaatggagaatggaatgcaatggagtgaaatggaatggaatggaatggagtggagtggagtggagtggagtggaatggaatggaatggaatggaatggaatggaatggaatggaatggaatggaatggaattgaaatgaatcgaatcaaatcgaacagaatggaatcaaatcaaatggaattgcatggaatggaaaggaatggaatgggagctgagattgtgccactgcactccagcctgggtgacagagtgagaaactctcgaaagaaagtaatggaatggaatggagtggaatggaatggaacggaatggagtgaacctgagtggagtggagtggagtggagtggagtggaatggagtggaatggaatcggatgttatggaaagtagtggaatggaatggaatagaatggactggaatggactggaatggaatggaatcgaatggaatggactcgaatggattggaatggactcgaatggaatgaaatggacacgaatggaatcatcctcgaatagactcaaatggaagcatcatcaaatggactcgaatggaatcatcatcaaatgtacaccaaagaaatcatcatcgaatgaactcgaatggaagtgtcatcaaatggactcaaatggaatcatcatcgaatggattcgaatggaataatcatcgaatggactcgaattgaattgtgatcacatggactcaaatggaatcatcattgaatggactcgaatagaatcgtgctagaatggagtcgaaaggaatcgtcatc

SEQ ID NO: 478901 - DNA, 720 bp, Homo sapiens
tgcagcaaaccaccatggcacatgcatacttatgtaacaaacctgcaagttcagcacatggaagcacagcataaaggtttggaaaatttgcagcctgacaatgctgcagaaaagaaaacacccttttctgaggagaaattcaagttggctacagacatctgcgtaactaataatgagccaaaatttaatccccaagacaatgggaaaatgtttccaaggcatatcacaggtcttcatggcagtccctcccatcacaggtccagaggcctaggaggaaaaattggttttgtgggcagggtccagggtcccctttgtgtgttcagtcttgtgacttggtgccctatatcccagcttccccatccgtggcttcagagggttcaagcctcaagatttggcagcttccacgtggttttgagtctgcaagtgcacaaaagtcaagaactgaggtttggcaacctccacctagatttcagaagatgtatggaaataccaaggcagaagtttgctataggggcggggccctcatggagaacttctgctagggcagtgcagaagagtaacatggggtgggagccctcacgcagagttcctaccggtgcaccacctagtggatctgtgagaagagtcccaccttcctccagaccacagaatgatagttctaccaacagcttgcaccgtgtgctagaaaagccacaaacactgaatgctagcctgtgaaag

SEQ ID NO: 478902 - DNA, 1017 bp, Homo sapiens
ctgccagcatgctgtcacctctcagtttcttctgaaggctctagagatatgcggaagtttgaacttgagggagatgatttagggtatctggctgaagaaattcctcagcagcaaagcattcaaaaggttacttgggtgctattaaatgcattccattttaaaagggaaacagagcgtaaaagttcagaaaatttgcagcctgatgatgcagtggaaaagaaaaatctattttttgaggagaaattcaagctggctgcagaaatttccataagcaacaaggagccgaatgttaatccacaagacaacggggaaaacgtctccagagcatgtcacaggtcttcatggcagcccttcccctcacagacccagaatcctaggaggaaatatggttttgtaggcgggacccagggtccccatgctgtgtgcctagggacttggtgccctgcatcccagctgctccagccattgctgaaaggggtcaaggtacagcttggttcatggtttcaggggtttcaagccccagaccttggcagcttcaacgtggtgttgatcctgtgggtgcacagaagtcaagaattgaggcttgggagcctccacccagatttcagaagatgtatggaaatgcctggatgcccaggggacagttttctgcaggggcagggccctcttggagaatctctgctaggtcagtgtggaagggaaatgtggggtcagagcccccacagagtctccactggggcactgcctagtggagctgtgagaaaagggccagtgtcctccagaccccacaatggtagattctctgacagcttgcactgtgcacctggaaaagccgcagacgctcaacgccatcccatgaaagcagccagggggaggctgtaccctgcaaagccacaggggcggagctgtccaagaccatgggaacctatctcttacatcagcataacctggatgtgagacatggagtcaaaggagatcactttggagcttttaaattttactgccctgctggatttc

SEQ ID NO: 478903 - DNA, 590 bp, Homo sapiens
gactggtgtatttacaatctcttagctagacataaatgttctacaagtccccaccagactcaggagcccagctggcttcatccagtggatcccgcacaggagctgcaggtggagctgcctgccagtccctctccatgcgcccacactcctcagcccttgggagcccacggagggtggaggctaaggaatggcgggctgcaggtcccgagccctgccccacggggaggcagctaaggcccggcgagaagtcgagcacagcagctgctggcccaggtgttaagcccctcactgcccgggcatgcaaggctggtcggcagctcctagtgcggggccaccaagcccacgcccacccagaactccagccggcaggcaagcagcatgcctgtgggctgaagggctcctcaagtgccgccaaagtgggagcccaggcaaaagaggcgctgaaagtgagcgagggctgtgagggctgccagcatgctgtcacctctcataaggagtgattaatctgagcttctccagaaagtccattcctgtgtttcctgagcacctactatgtgctgccccctgtgagagctgttagggttgaaata

SEQ ID NO: 478904 - DNA, 970 bp, Homo sapiens
aattgactgagttgtgtccatgtgggcagtgcaggaaagggtgcaatgggaggcggctccagggacgtctttggcttccatcatgggggagcaagcgcctggattatccaccctaacaaatctggacaaaggaaaacgaggttctctgaggaaggagacatagagcccaaggagctaaccaagagactaatagtcatcctgtcttcccggcgtgtggacctggggacccaccagaagggcccgatgtggagtctcacggagcgtcggcggaaggcgcacaggatgctaaagctttacaacggcctttgggaaggggaggctgtgggactccccacagggcccgaccccctggaccccactgatctgaacggggcgcacttcgacccggaagtttacctagacaagctgcctagagagtgccctctggcccagctgatggacagtgagacagacatggtgcagcagatccgggctatagacagcgacgtgcaaaccctggtatatgagaactacgataagttcatcccagccacagaaattgacaaacaacataaaactgtatgaggaattgcaggagacccagaatttcccaaataaccttgtaaaagaggagcaaagttggaagactcacacacacaaatatatatatatatatatatatatatatatataaagttgtgttttcgttcagttgtaaatgtttagtaatttctattgtgatttttcatttaactcatgagaggatgtttttaattttcctaatgtatgcttgtgtttagctatcttcttgctgttgacttctaattttgttgcattatggtcaggaaaatgtggtctggacaatgtcaatcgtatagtggattttgttgagacttctttatggcctaatatgtggccagtttttttttttttttttttttgcaaatttgccacgttgttaaaaggaatgtggattttttttttaggagag

SEQ ID NO: 478905 - DNA, 1196 bp, Homo sapiens
tatttctacatctcgcctttgtcagcccttgccaaaaccgtgaggcagcgatgtgttacctgctgacagcatgatgcgaggcaaggtccagccattccgcccggcatacgagcttatggagcagccccctttgaaggtctccaggtggacttcacagagatgccaaagtgtggaggtaacaaaggatccagaactgcaaccggtcctcgctttgctctccctgtccctgtccatgtatctggtcacggtgatgaggaacctgctcagcatcctgactgtcagctctgtctctcccctccacacccccatgtacttcttcctctccaacctgtgctgggctgacatcggtttcacctcggccacggttcccacgatgattgtggacatgcagtcgcatagcagagtcatccctcatgcgggctgcctgacgcagatgtatttcttggtcttttttgcatgtatagaaggcatgctcctgactgtgatggcctatgactgctttgtagccatctgtcgccctctgcactacccagtcatcgtgaatcctcacctctgtgtcttcttcgttttggtgtccttttttcttagcctgttggattcccagctgcacagttgaattgtgttacaattcaacatcatcaagaatgtggaaatctctaattttgtctgtgacccctctcaacttctcaaacttgcctgttctgacagcgtcatcaatatcattttcatatatttcgatagtactatgtttgcttttcttcccatttcagggatcctatggcttactataaaatcgtcccctccattctaaggatttcatcgtcagatgggaagtataaatccttctccacctgtgcctctcacctagcagttgtttgctgatttgatggaacaggcattggcatgtacctgacttcagctgtgtcaccaccccccaggaatggtgtggtggcgtcagtgatgtacgctgtggtcacccccatgctgaaccttttcatctatagcctgagaaacaggaacatacaaagtgccctgcggaggctgcgcagcagaacagtcgaatctcatgatctgttccatcgtttttcttgtgtggaaataacttctcacctatatgttcaaatgattttccacatgagtgctaagaaagctcaatggtggaaaagcagccttttcaataaatggtgttggagaaa

SEQ ID NO: 478906 - DNA, 1015 bp, Homo sapiens
ttaaaacatccagaggtggaaattggtggctatgctcatggccattggtggcattgaagcatggagccagcgcaggtggcttttggcactggctggtgcactctacatggacctgagggcagcacaggtgaaggactcggttgagatagcagaggccagccaagtggaggaggtcgctgatgtactagaggagacctgggtggagaaggtggctgaagtcccaaggccacgagtggagactattgaagtaccagaggagactcatgtgaaagtggtaggggaggggccagaggccacccagctgcaggaggtggatgaggtctcagaagacaggcagctgcaggaggtggatgaggtcccagaggacaggcagctgcaggaggtggatgaggtctcagaggacaaagagcttcgggaagtggtcgaggtcccagaggacagagagttgtaggagatagttgaggtcccagaggacactccagtggaggaggtgcttcagttcccagagggcagtcgagtggaggaggttgatgaggtcccagagggcacttgagtgcaggaggtggttgaggtcccagaggaaactttaataagaaggttgttgaggttccagaggacactcaactggaggaggtggttgaggtcccagaggacactcaactggaggaggtggttgaggtcccagaggacacttgagtggaggtggttgaggtcccagaggacactcaagtgcagtaggtagttgaagtcccagaggacactagagtggaggagatgattgaagttccaggggacactcgagtggaggacattgctgaggtccattaggaaacttgagtggaggaggtatctgagttctcagtaaaacttcagctggagaaggtgtttcaggtcccagaggatgttcgagtggaggatgtatcagaggtcccagaaaaccttcagttgcagagagtggttgaggtcccagaggacacggaggtggagggggtggctggcagcccatcaatggtcc

SEQ ID NO: 478907 - DNA, 835 bp, Homo sapiens
aggagatctgtgcttaggaaaggtcttccgaatgttaactcaacaggatttaattataagttttactttggagcagttcaaacccgcagtaagctatgggtgttagagatagtcaggcgtctgatttagctagagtcttctttagagtaggattagccctttcacctttccagaggactgcggtctgcatacagagtgaagagactggtgccgccgcgggtcctccatatggtaagcgccgatgccctgggcccactttttctctatactttgtctctgagactcttcacaagtctcttgttccacctgaggagaaacgcccacagaatggcttcacgactctaaaagacagcccacttgccaggtgtcagctgattgattctgtgtggattgttttccttggagtgagggtcttgtcttggtgtccgttcatggtgttgctgaaagatgttgctggaaaagagggtcctgatacagaccacaaagtaggattcttagatcttgtgcagtaaaaaatttgaggctgtacagaaagcatagcactggcttctgcttctggggaagcctctgaaaactgacaaggtgaaaaataaatccggtgcttgcacatcacatgttttcagtctggtcctacagacttttttattaaggctttaattttgttaattgttattgatctgttcaggttttaggtttttttcctagttaaatcttgtgaaggtgatttctcttgaattataatctaatttcttgctttttactttttgtacatctttggtacaccttttgatttgaaattcccatgaggtttgaaaataatataatacatgatttt

SEQ ID NO: 478908 - DNA, 573 bp, Homo sapiens
caacgataagagctactgtataatgattgcggttctgcaaacagcaggctttccatatcacatgtggcaagctctgatgacaaccctgtgtgacagccagagaccaagatttctgcagtgccttggctggggcccacagataagcatggccaagcagtgctcccagaagccagcagatgccatcaatcagttttacatcctccaggcactgagaatctctggacaccagaagtgtcctctgttgccagagctgaactctcaagtgaaaactccagaaggccctgaaatgtgggcaggctcccattattgcctgtctggccacaaggacacagactctttccatggctgcctactctgctacaattgcatttctggcaggcagtggatcagagaagcaccggcagttgaggaccgtgtggagaaccactgctggccaagcattcccaacctgacagcagaacaggagtacagcagtgctgaggtgaacttgacagagaactttgagaccatgaaggcaaccaacacttccaactcatcacaacctgcctctcccatagatttattgtagaagaa

SEQ ID NO: 478909 - DNA, 475 bp, Homo sapiens
gcccgtgctgccttgagtttctctgacttccctggctttgggaatgcatttagagcctcctggccaggttgcagcctggattctatccatggaggccatggcaaaggtcaagtgtaagaaaattatattggaggccgtgcccagtggctcctgcctgtcatcccagcacttagggaggccgagtgttggaggtgaggccaggtggaagtgtttgggtatcatgctgaaatctcgccccagtgttggaggtgaagccggctgcatggaggtgtttgagtctcatgcagaaatctggtccccagtattggtgtgttggaggtgggtctgggtgagggtatttgggcctcatgctgaaatctggtccccagtgttggtggtgaagctggatggaggtgttcgggtctcatgctgaaatctggtcccagtgatggaggtggggctgggtgaggggtttgggtctcatgctgaaatctgg

SEQ ID NO: 478910 - DNA, 1069 bp, Homo sapiens
cttataatcaagtgaattatattgaaaacaaagagagaatatttacaccatggaaatcagcaaaagttacaaatcaaggtcctctttctccttcattaaacatttaccagccaaccatgggctaagatacatcaaggtttatggtaattgggcctctagactcctgaatgccaaggctggttctccttcatgccagcatgaacttgggcagaaggcagaatggtgtctagagaatggagataatagaaatcaggagaatgatattctgaagtatgttttccggtttgattccattctccccatctctttcagtcaggaggaacaggatcagggaccacttaaagaagcagtctggctgctttttgatagagcaggtgtgctgcactgggactggggggcccttcctcgtctggaccatttggactctccaaagctggcaggctgtgtctgcataaccctggctggagctggagtgcctgaaaccccgacagagaggtcccacccagaacctggtcctgtctcaggcagactccagcctgttgctgttggctggctggaattccaagccagtatgaggtgccgtggaagtgggacctgcagaatgacgctgcttggcttcctggattcagcccccttcctaggggtacgaacaggtcacttgctcaaggtcacagaaccaagtagttgatagtgagttgaacccaagtagtcttatgccagagctcaacatgcttaatcactatactagagtttacatatcatgtcaagggtacatgctattaacatgacttaccattgttgattttcacttgcattggattttaaaatgaatcttatataaaactctatttttaattgtataaactatataatggaggataaacttacaaatatattctcctaatcctaagggaccctgtaccgttttagttattacgtggattaaatgcatgaagatgtatgagattttaagtcaatgggttaactattataagcatgataaataagtttaatttctcataacaaatataaggtgagttcttagtctgttttatgctgctattctgtg

SEQ ID NO: 478911 - DNA, 459 bp, Homo sapiens
gaagaccaaaatctatgaagatggggagaaaccagcacaaaaaggctgaaaattccaaaaaccagaatgcctcttctcctccaaaggatcacaactcctcgccagcaaggaaacaaaactggacagagaatgagtttgacaaatcgacagaagtaggcttcagaaggtggataataaactcctccaagctaaaggagtgtgttctaacccaatgcaaggaagctaagaaccttgaaaaaagtttagagaagaacctaaatgacctgatggagctgcaaaacacagcaccagaacttcgtgaagcatacacaagtatcaatagccaaatcgatcaagaggaagaaaggatatcagagattgaagatcaacttaatgaaataaagcgagaagacaagattagagaaaaaagaatgaaaggagtgaacaaagcctccaagaaatatgggactatgtgaaaag

SEQ ID NO: 478912 - DNA, 1031 bp, Homo sapiens
tcagagtgccagcagggatgtggcttttaagttgaagcctgaaatgtcggaaattgtggaccagatgattaatgggaggaagtgggttttagaagaaagaaagaatatgtatgaaggccccccaggatggaaagaactttgtatgttcaaggaacatacagaggagggacctacatatagggacaaagggcaggtggtgctggatgaggctggacaagtgaataagcacagccacacccagcttcgtagatgctgggatagaagtgtaattcatatcaactcattggctctccagtttatagttgtttcttctcatgtaatggcccctgtaacgcagtggccagatttcctcgttgtccttgtgcccatggccacagttgattctaaggcagttgttctcaaacaggagtgtgcatcagaatctccttgttacaatagagttctggatcccatcaccagtgtgtctgacgcagcaggtctagggtggagcttgagaagtttcatttcaataagttcccaggacaaaaagaagggtagaagggatgataagaatattgaaaataagaaagcagataggcaactgttccaactggcttctgtagacctgggaattctgagctgtaagcagcagaagctggagagcgaggggatttgcacaccagagccccagaaaagttctggattctggaacttctgaatgagtcgacttaaatattcatggacctttattcctctatgtaagtttttagaatatttccatttttcagctcttctgtatctattattattttaaagttttcctcatggaagtcttagactcaaggataatactgagtgcctaatgtaatgtgaagttctatgtagaggcttaatgatagcgttactcatttatagggattaaacagaatgtccacaaagaactggttgaaaataggctgcaaaaatggtacagaagatatgtgttcttagttactcaagttttatgcattcactagactgtaagattcaggtgggggtgggctgtatgcttg

SEQ ID NO: 478913 - DNA, 682 bp, Homo sapiens
tctctcctaaagaggaaaccagacctgcccttcctcaggtcataagatgggtgctgctcctccagccatcacaattattttccggtgcaaagaagggcaggaccaaaagccagaggggacatttcgtttcagagaagttaaccatgacctctactcattgaatattacctacaactcaccgggcagaactggatcttacaactacttctattttcaaggatgttggcgtgtgcacgtgcatgttttatccaaggagctgaagcctctgctccctcttcctagatgcctccagtcagaagtaccttctttacccctgagcacccagctcttcactcaaagctcaacctggtgctcaggtcggttggcttttcccttttccgtggtcgcctatgagtctgtccccccgtcccacccccatctagtagactacagccacttgctactaacagagatagtttcaggtgctacatagtgtggctattagtaacatggaaatatattctatttgcactgtggagatcctatcagttctatattaaattgagtgtgatgcatgactgtacttttttcctctgaattcccttccatttttccccaacatcctttttttaaaatggaaatttttattgagataattataaattcacatgcaattatgagaaataatagagatcaataataa

SEQ ID NO: 478914 - DNA, 648 bp, Homo sapiens
ctgtgacttgcacgcatacacccagatggcctgaagtaactgaattaatcacaaaagaagtgaatatgccctgccctaccttaactgatgacattccaccacaaaagaagtgtaaatggccggtccttgccttaagtgatgacattaccttggattgggaaaaacaaaatgctctccctcagcccgggttgctcatatccccagtggaaagaatttatggaaagcttggcatggctcctactttgattggctcagaagtcaagcatggccccattatatctacagagaggagtgatgagctgtgtgctgctggactaaagcccaagcgggctagccaagccagagcagtacccaccacactggccctggagcaggaccaatgcatgaatatcctccctagtctacctctgggtgctaatgtttccaatgagattgggaggcctgggcccgtctactggaggaatggatctcaggctttcaaactggctgcagaactaactttacatatatctgacttccctgacttattagagcctgctgaccctgggagatgacagctttggttggatggatgaaggtggggtgagaatgattaataaccagagtttctctggaatcaacattcatggcagaagataagtactaatc

SEQ ID NO: 478915 - DNA, 604 bp, Homo sapiens
cagtgttgagggtggtgacgaggaggtttgcgtttcaaaaaaggccattctgtctggtgtatggtgcatcgtctgataggagcacgtggacacgaggaggccagtccttctcatatccacaccagggcagggctgaggtgctccaaaggcccagaatatccattgccacctattgatgcagcacaaggtgagagcaatgaaactggtggaaaaaacttgccaaaagagtctttagcagctgggagtgggggtggctgttggagatccacttcctgccatgatgggggaaggcacgtgtgtcctctgggcccaggcaaggcagcagccatcaggcatcttgaaagggactgtgcacaaaactgcctgcgggtgaggaaacctaatggagacagtccgtgtgaggtagagggatggattgtggggctgaggtgtggtcataaatatacagccagaggggtattggaatcagaggtcatcaaattagggggccctgctatgatggggctggagtcgcaaattcctaacaaccccagaggcacctcacaaaggaaagaaacagtctttgaacatctaccacattcactccagtgtcagctttaaattg

SEQ ID NO: 478916 - DNA, 659 bp, Homo sapiens
cccaggtgaaataaacagccatgttgctcacacaaagcctgtttggtggtctcttcacacggacgcacatgaaactcactatgccaaagggaaaactcctgaatgtaaatccagactggatgatggcaaattcagtgttttttaattcattacagctggagacagaggcagaaaaatactgtgtatctatgaggagacagcacttcaggtgcatcttaaaggctagatatggtttaagggtaggcattattgaagaaagagcagaggcagaagaaattcctttaattcatgcttccacagttggtcctgattctcctcaactaacagattacagcagtcccacaaatcttcccacagggttccactcagagatgggttttaaaccgaaacctaaggcagtcaactcccaatatcgctatagattcaacgattggttcagagattatcaattgtccagttcctggagcccaatcatgatggagcatcgctacagatgtcccggggcctgtcttggtgaggaggacttctgcattgggtagcaaggcatgattgtgtatgtctatgcttcccacatctccttttaaatggctagatttagcatgaaaatttcaacttcaaatagtctccaaagacatggttggtgaccagcataatacttt

SEQ ID NO: 478917 - DNA, 1584 bp, Homo sapiens
ctgatggccgaataggaacagctccagtctacagctcccagtgtgagtgacacagaagacaggagatttctgcatttccaactgaggtactgggttcatctcactggggagtgccgaacagtgggtgcaggagactgggtgcagcgcaccatgcgtgagccgaagcagggcaaggcatcacctcacctgggaagcgcaaggggtcagggaattccctttcctagtcaaagaaaggggtgacagacggcacctagaaaatcgggtcactcccaccctaatattgtgcttttccaacgggcttaacaaatggcacaccaggagattatatcccgcacctggcttggagggtcctatgcccacggagcctcgctcattgctagcacagcagtctgagatcaaactgcgaggtggcagcaaggctgggggaggggcgcccactattgctcaggcttgagtaggtaaacaaagtggcccgaaagctcaaactgggtggagtccaacacagctcaaggaggcctgcctgcctctgtaggctccacctctgggggcggggcacagacaaacaaaagacagcaataacctttgcatacttaaatgtccctgtctgacagctttgaagagcgtagtggttctcccagcacgcagcttgagatctgagaatgggcagactgcctcctcaagtgggtccctgacccccgagtagcctaactgggaggcaccccccagtagggggctgactgacacctcacacagccgggtactcctctgagacaaaacttccagaggaacgatcaggcagcagcatttgcggttcaccaatgtacactattctgcagccaccactgctgacacccaggcaaacagggtctggagtggacctgtagcaaactccaacagagctgcagctgagggtcctgtctgttagaaggaaaactaacaaacagaaaggacatccacaccaaaaacctgtctgtacgtcaccatcatcaaagaccaaaggtagataaaactacaaagatgggaaaaaaacagagcagaaaaagtggaaactctaaaaatcagaatgcctctcctcctccaaaggaatgcagctcctcaccagcaatggaacaaagctggatggagaatgactttgacaaaatgagagaagaaggcttcagacaatcaaactactccgagctacaggaagaaattcgaaccaatgtcaaagaagttaaaagctttgaaataaaattagatgaatggataactagaataaccaaagcagagaagtccttaaaggacctgacagagctgaaaaccaaggcgcgagagccacgtgatgaatgcagaagcctcagtagccgatgcaatcaactggaagaaaggaaactctacaagccagaagagagtgggggccaatattcaacattcttaaagaaaagaattttcaacccagaatttcatatccagccaaactaagcttcataagcgaaggagaaataaaatactttacagacaagcaaatgctgagagattttgtcaccaccaggcctgccctacaagagctcctgaaggaagcactaaacatgaaaaggaacaacc

SEQ ID NO: 478918 - DNA, 2155 bp, Homo sapiens
ttttgtaggttgaagagttacagaaacatagtgctggcaattccatgcttattcctagcatgtcagttacaatggaaacaagcatgattatgagcaacatccagcgaatcattcaggtgagggtgattaagaacataccactcaggctgaaggtcttacccatcctctcttctcagaggtatgttgagcagagtaacctgatgatggagaagaggaacaactcacttcagacagccacagaaaacacacaggcaagagtattgcatgctgaacaagagaaggccaaggtgacagaggagttagcagcggccactgcacaggtctctcatctgcagctgaaaatgactgctcaccaaaaaaaggaaacagagctgcagatgcagctgacagaaagcctgaaggagacagatcttctcaggggccagctcaccaaagtgcaggcaaagctctcagagctccaagaaacctctgagcaagcacagtccaaattcaaaagtgaaaagcagaaccggaaacaactggaactcaaggtgacatccctggaggaggaactgactgaccttcgagttgagaaggagtccttggaaaagaacctctcagaaaggaaaaagaagtcagctcaagagcgttctcaggccgaggaggagatagatgaaattcgcaagtcataccaggaggaattggacaaacttcgacagctcttgaaaaagactcgagtgtccacagaccaagcagctgcagagcagctgtctttagtacaggctgagctacagacccagtgggaagcaaaatgtgaacatttgttggcctccgccaaggatgagcacctgcagcagtaccaggaggtgtgcgcacagagagatgcctaccagcagaagctggtacaacttcaggaaaaggcccaaatcacagctctcaccaagcaaaatgaacagcacatcaaggaactagagaagaacaagtcccagatgtctggggttgaagctgctgcatctgacccctcagagaaggtcaagaagatcatgaaccaggtgttccagtccttacggagagagtttgagctggaggaatcttacaatggcaggaccattctgggaaccatcatgaatacgatcaagctgttaaaccaacaggagcaagagaaggaagagagcagcagtgaagaagaagaagaaaaagcagaagagcggccacgaagaccttcccaggagcagtcagcctcagccagttctgggcagcctcaagcacccctgaatagggagaggccagagtcccccatggtgccctcagagcaggtggtcgaggaagctgtcccgttgcctcctcaggccctcaccacttcccaggatggacacagaaggaaaggggactcagaagctgaggcactctcagagataaaagatggttcccttccacccgaactgtcttgcatcccatcccacagagttctagggcccccgacttcaattccacctgagcccctaggccctgtatccatggactctgagtgtgaggagtcacttgctgccagcccaatggcagctaagcccgacaacccatcaggaaaggtctgtgtcagggaagtagcaccagatggcccactacaagaaagctccacaagactgtccctgacttcagaccccgaggagggggacccactggccttagggcctgaaagcccaggagagcctcagcctccacagctcaagaaagatgatgtcactagctccaccggtccccacaaggagctgtcaagcacagaggcaggttccacagttgcaggagcagccctcagacccagccatcattcccagcgttccagtctctctggggatgaagaggatgaactgtttaaaggggcaactctgaaagctctgaggcccaaagcacagcctgaggaggaggatgaagacgaggtgagcatgaagggacgcccgcccccaacgcccctttttggagatgatgatgatgacgatgacattgactggctgggatgaagacccaggaaactggtgcaaaggtttctctgcaacccttccctaagcatgattttgcacagccaaccctgggtctaggcgaaccacagggtgaggtcaagactttttaatctcttcattaactctcagactgacctgggagccctcctctacctgaa

SEQ ID NO: 478919 - DNA, 598 bp, Homo sapiens
ctcaccacagataactaccctgtccctgaagcagtgctcagaggaacatacctggaacgctgggaatgatggctggtgggccatctggtgctacttccctgacacagacctttcctgatgggttgtcgggcttagctgccattgggctggcagcaagtgactcctcacactcagagtccatggatacagggcctaggggctcaggtggaattgaagtcgggggccctagaactctgtgggatgggatgcaagacaggcctgaggaggcaacgggacagcttcctcgaccacctgctctgagggcaccatgggggactctggcctctccctattcaggggtgcttgaggctgcccagaactggctgaggctgactgctcctgggaaggtcttcgtggccgctcttctgctttttcttcttcttcttcactgctgctctcttccttctcttgctcctgttggtttaacagctgaagagtcaccatctattcaaaagccaaggaagagatggtcactgaaaggaacacagtagccactcctaattcttattaacactactggtcatgtagtttaaatgactttgcttctttcctgttaaaa

SEQ ID NO: 478920 - DNA, 509 bp, Homo sapiens
tcctattcccagcacacagcacaggatgtggcatgcagcaggaacctcaggtacatgtgcacaatgtgcagatcaggggtccacaacccccgggacctggactggaactggtctgtggcctatttggaattgggccacacagcaggcagcgagcagtgggcaactccttatgagaatctaatgcctgatgatctgaggtggaacaatttcatccccaaatcatctccccaaccccctgtccatggaaaaattatcttccacaaaactggttcctggtcccaaaaaggttggggaccgctgttttacacagtccattcacatgtcccaaacacttccatgactttccatgaggaaggaaatgggaggccatttcagacaggaagacgtacatgggtaaaggtatggatttcctcaacgtttcttgccatttgtccatctttgacgtcaccctctcccttgttggagtggttaaggcaggataaagtccaaattctgtcacttccataaaa

SEQ ID NO: 478921 - DNA, 454 bp, Homo sapiens
taagtgacttgctcaaggtgataagaccaccaaggaatgaagcagggcttgacacccctatatatgagtccagaaacctatatccttgtaccactctatctcataaatgagatgcatggccctgaaactcataagcgtggtcatgtcattcccaacaacgttgtgcgtttcacccagagaaggggccgtattcctacatggaccacaccccctgtgtcacctgcctccattgcctctctgaccttatcttctaccatctttcctgtcacttgcttcccttcagcaacactgacctccttgctgttcctgggacactgcaggcatgtgcttgctgttccctctgcctggattgtccccacccccatcccatgtgtccacatgactcacctccttccctctttcaagtctttgctcgaaggtcaccttcagcaatgcctaccctgaccaccatatc

SEQ ID NO: 478922 - DNA, 891 bp, Homo sapiens
ttcaaggatcaaacaacttttttgatgagggaagtgttatttctactcagccaagacatcaaagcctgtgaatcgtgctttttaggtccccagtgtgaacgtttcctggaggacctggtagctaaggcagtgccaggaaaagtacagccactgccaaatagtctggtgcagcttagtgtgtccggggcaaatggaccaccttgtatctttgagtgccagctatgtctttgggatcagtggtctcaaggctgggctgagcaggagtgcaatgcacttgtcaggcagctggagttccatgagccagacttcgtggcaaagtttgaccaagcagtggctgctacagctgattatccaactttggtcactggaggctcctgtgtccctttgacataccctattattggggggcattgctttattgtttttatttttgtttttcagtatttacaagatgctccaggacacagcaggaaggtgtcatctgtgagtcagaaaatgggccctgaccagacattgaatctgccctgatcttggccttcccagcctccggaactgtgagaaataaatttctattgtttccaagctacctagcttatggtattttgttacagcagcctgaagggactaagacaacccccttggacagctggtacaaaaactgagaatatttagtctctctagcttcagtttccttatctataaaatggggatagactttgtgttggggaggccaaaagaaaaaaaaaagacaacttttgctaaaaatagcatagcttgattcatcatcattttagacaaatatgtaatgaaacaggaagtaactttgaaagccctcttaactacactgatatacatgtgttttaactatggtgggggaggatgctagatctg

SEQ ID NO: 478923 - DNA, 595 bp, Homo sapiens
gcagtcttctctcactatggctggagcattctgctgggccattctctgctccttcctgttcctgctgcatgatgaccatgtcaccatccgcacccacattcaaggtcagcggggtggaaccactcttctcagctgcaagggaatcctgctcagtctatgtagtgagcttattccgccttctctccctcaccccagggatgagcttaaggttattagaactgggtttctgtcccatgaaacccaaagaatcctgatgtatacagctagtaaagggcagagtgtgagttttaaatcaggcctatgtgattccaaagttgtcctcactccacggtccctgcatgacccctttcttgtactcgcactggctgggtggatgtttgagaggcttcaggggataagtgaagcttgcagcaggaaaattgctgccaaacctcacggagcttgagaaggctgatcagaagagcaacaagcctgaagtttagaattaggttaaagaagatttagctttattaccctgaaatatatacaatgactcagaaaacatcatattgccaggcctgcaggaattaacaactggaaaagaacagaatgaatg

SEQ ID NO: 478924 - DNA, 637 bp, Homo sapiens
gcagttgtagtagaaacagaagatgaagattacacctgaggttgtggaaaaggaagattactcagagattatagggagcatgggtgaggcacttgaagaagaactggattccatggcaaaacatgaatccagggaagataaaatttttcagaagttcaaaactcagatagcccttgaaccagaacagattctcagatatggcagagaaaaggatattccagagaatatcctttgtgatgccaagaaaatgtttgaattccaggttatgcctcagctcctaaactacctgaaggctgacagactgagcgagagcattgactggggcatcctggctgtcttcacctgggctgagagctgcataccggctatacagaataatttgtgtggaagcaggatgtaacagatacactgtaaaggcatcttagagccttaaaaaaagttaataatcttttataccttgcaattccatttctgggacgtcatcctaaggaaatacttataccaaaaatagaggtgcagagatgttgagacattgcttacacagtgtcttcatattagtgaaacaaaagtgtccagtgacagggaattaaatacattttggtacatccacagtggaaggctacacagtcttaattat

SEQ ID NO: 478925 - DNA, 1520 bp, Homo sapiens
ttttatgtgaaatgccagtgaagcggctgtttctgcctatccttgccaaattaaaatatatatatgtatttctaaataaaagtttgaaaaactggtcctacagtaagacaagaggggttaaaggggtcgtctctgcttccctggacacgaagtcaaaatggtcagcataccatcctctcagtgcagcaagtactgactggagtctctgcgctcaatccaaactcagaatagagaatggaggagaagttgggaaggagttgggatcaaccagcagcaacgtacttcctcaaggagggaccttgcaggtcatggtgaagtctccagagaagcagcagatgaggggagtgaggcatagaaaagtaaaatggaatgtttctttcaccagtaattggacaaactgccagcatgtgactcttgatgggatgcaccgacaaccaacagtgcttacacagaattcctgccaaaaatgcataacccaaatctaatcatgaggaaacatcagacaaatccagatcaagggacattctacagaacaactggcctgtattctgcaaaaatgtcaatgttatgaaagacaaagaaagaccaaggaactgtttcaaattaaaggagactaaagagataagtatgacaactaaatgcaaaaagtgatcttgaaccattttttttttttggctcctggatcagagtgggaaaaaaattactataaaggacattttggggacaattggtgaaatttgaatatagttgtatattagagaatagtatgtattcattttaaatttctggattgatcatcattttctggttgtgtaaaatcttctcactcttagaaagtacacacttttgatggaaaggcacatgattatctgcaactctcgaaaaatatatatacatatgtatatgtctgtatgcatacatatattatatatataagataaagcaattatatgtgactgaatatgaattggcaaatttgaacaaagggtatgcaaaaggtctttgtcctattcttgcaactgttctataattttgaaattatttcaaaataacaagttaacaaaagtgaaatatttaatatgtttgaaaaagctagaagcctacactgaaactattttcattggaatggaatcttttcattgtatattcaacggaaaaaaatttgattcattgatcagtggcttgtcaacatcaaaatttgctgattatctttcttcgtaacatgaatatgttcttttgtagctgttattcccatgaggtccaattttcctaggcaaattttatgatctcaattttgtcatgcagatgtagggtcttcccatccatgtttagtcaatatttactggacgcagtgttagtctttgtgttttattttctgttgcttatttctaccaggctgaataatatttcattgtatggctataccccatgtcatttatccattcatccattgatggatacttgggttgcttctaccttttacctattgtgaataatgttgctatgaatattcatgtata

SEQ ID NO: 478926 - DNA, 758 bp, Homo sapiens
tcttccctcgggatggatgcagttggtatcagatgttcaccactctttgtggtccagacatctgcctgggttctcctggaggcctggagaaagccagtggtttgaggcttacagagtcacctgaacaatatgtcctgaatccttcagcacagccactaccctgtgcaggtcatcgtctgcaggtcatcgtccgcaggtcgttgtctgcaggctttctccttgtggcaggtctaccagcatttggatcatgtcggtggacgttctatgtatccactactgatgggaaacttcctggtgaaggagagatgaactttgctatgaggacatccaccaccatgctcgtcatccagcatccgcatgcaagctgggtggggtgggagctcaaagttggtcaaagacaagactttaatgctctcaacttttagttcattccttcatttgttcaattaattcaattgttcattcacctatatacttcttccttcattcagtcattctttcaacaaacactggttcaagagagaagaacttttcaaacttgaatgtgcacaaatcacctgtggactttgttcaaatgcaggttctgattcagcagatctggggtggggttgagaatctgcatttctcaagagattccagggcttagcagaatgttcacaaggagtgggtaataggcattcttacatactcctgatgggagacgctacctatgaagtctttttgataggtgctggcaaaaagtatcaataatagcctct

SEQ ID NO: 478927 - DNA, 1367 bp, Homo sapiens
ctggaatgacagtcaggtccaggacacagggaagcccaggggacaagggaaccataaaggaaatgcctcaattcatcccaggtttaagagatggcttcctggctgggacctggcaaagcagagattcacgttttccagctacagtcttaagttcatctagaaaacaaccctgcccagagaactgtgctggacctccaacatctgtggttcaagaaggcaacgctacagggaaagactggcagagtggaggctccatgtcctttccacagatcttctgttgttgccgcaagaccagcgaggggtcttccaccactgttggcttccacaatccaagaatgttcgaacagcatcatccacggtccttcaatctgaacacaaattctctccacagtgctgtaccaaaaagacatccacgcctcccctatgacaaccgcatgatgctcaaggcgtgcatccttaggaggccatgagcattctagccggcggcacccacgtggtccctgcggctgcacagctgctgggcttccatgaggaagagggcagtggacaagagtcatgaagactgattcagaaactcccctgcaggaggagaagacgtctgagccatccctgtgccaccaccaagagtcactccagcttctgaaaaagccaccgtgggggggagccgcctccaattaaagtccttggtcacatcagaggaagtgtctctcctccttccccctttgccagccctacctctgagattcccaaaaacatggagcaattagaccctggcacctcttggaaagaaatgtggttttgtcattttaacgcattaacacatttgtttcagtcactcctaaccaacctaacagggaagtgctatattaggagaggccagtttgtataacaggccactgtcataaacgtccagagcttcagggcacaattctgcttgcctactgtgcgactccatttgacgctcagggccatagggaacagcagggcatgttgtgaaaaactctacaaacagcagccctagagttatgcaatgcgtagccagtgctgatacgcagcaccgcttgtgctgaaacacggagtatgcaactatcctcttccaagtgcttcataaatatcaacccaatcagcacaataacccaacaaggttagaactgttactacctgattttacagattagggaagtgagacacaggttaaataaatcttttaaggtttacactaactcacattaagtgccagagctaagactttaactcaagaaacccaactgcagagtccacactcttaacaacttggttatgcggcccctcgataatggtagaatgacattcagttattactctggaccccaaatttactgttcatc

SEQ ID NO: 478928 - DNA, 694 bp, Homo sapiens
tggggaattggaggaattgaagacagagttggtgatgagggttgtgggtggacaggagggaagaaggatgattagattacagagtatcttaagacccagggactgtcaggagccctatgccatcaatgactccaaggttcccagtcaaacccaggagcacaagccatcgacccaaaatttgctgcttcagaaggatgagcttgacagacaaaatcccaagcgcattaacgcagtctcccatttgccttcgagaacacccctgatccagacaaaaaagagcacttcctccagcagcagtgagtttgaggatctgaatgcatatgcttcccaaagaaatttttacaagagaaacttaaaccgctactgccaggagcactggccattccagccatgcctcactgggaggccctgagcattctagccggcggctgcacagctgctggggcatctccatgaggaagagggcggtggacaggagtcatgaagactaattcggaaactcccctgaaggaggagaagacatctgagccatccttgtgccaccaagcaagagtcactccagctcctaaaaagccaccatgggaagagctgcctccaattaaagttcttgattgcaccagaggatgtgtccttctcttttcctttcccccttaccaactaatgtcttattatttttaaatatattgtcacatct

SEQ ID NO: 478929 - DNA, 742 bp, Homo sapiens
agttgttacactgggatcctaatgaaccccaatgttagccctacttgactcacgagattctggtaatgggtcactgataaagcccagggagaaacagatgagagaagaaagagggctgtgtggttcccatagaacttggagatgatgctaccttatcctgaagccgggattacttccttctttctctctaccagttcctctgttctctcgttctttagcagaagacttgatgacctatttaatctagagtctggatcatcagcaattaaaacaagccaaaaaagaaaaaagatcatttccttttccttaagcggtcaggagcgctcagccttcaaactgcataatacagttggggcaaaaattgtggcagcctcactctgggaaggaggtggtcttctggcaaaagaagatatcaaagttcttccatcagaggagatccttatcagcaagacattcactctgagatccaatggggggagaagtacaaagaggtatctagaaaggaatgaagacaggataccaagaagacttctaggcatccatgaaaggcagacttgatatatcctgccagctataaaatacacatgttgagtcataaagcaaagcaccaggagatttctagaagtgttcctagaggagcactcccatgtaagtattggttatcatcatcacaatcatcatcaatcaatcatcatcatcattatcttcattatcatttctaatgattcctggtgataccctg

SEQ ID NO: 478930 - DNA, 2543 bp, Homo sapiens
caggctgtgtgaccttcggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccgcccctggtaacctgtattttactttcagtctcagaatttgactattccagggacctcatataagtggaatcatacaacatttgtcctctgtgtgtggcttatttcacttagcagaatgttttcaagactcatctgtgttgtagcatatatcaacttttcactcctttttgtggctgagtaatattctactgcatgtctataccacatctggtttattcagccatcaatggactctttgttatttgtgcctttt

SEQ ID NO: 478931 - DNA, 710 bp, Homo sapiens
gaaccaaagcatgtacgagtgtgcatatttaaacttctcaaggacccgcggcgagactcccgtgtgccgcatgctgctgggtctccatcctgctggcagctagtgttgacctaaacctgcatgcaggggttctgctggggtgaaaatggaataagctgcttccttcctcatgggcagggaatgcacagtgcctggattagtgtccttgtaagagacaccagaaggcttcccccacctcttcctccatacacaaagaagagatcacatgagcatgcagggaggctgtggccacctacaagccaagggcagaaacctcagaatgagatctaccttgctggcaccttgatcttggatgtccagcctctagaactgtgggagatacattgcggtgtctacgccacccagtccatggtattttgtgctggcagcctgagcttactcacacactgcatgagtaagcatacgtctccactaggtgtctgcagtactagtgataactgtaagaacttagattcaccatgcagtaatgacttgctgagtttagatttgccatccagtgatgacttgctgtgtgcctggccctgttaaacactctaatctgtatttgtttctccttttgctgtgggacattttccttccatgttcttgctgagccctggtctgcagtctgtagggaatcttgcacatcaacatgaagacaatgtgctatg

SEQ ID NO: 478932 - DNA, 1308 bp, Homo sapiens
agcagtctgcatgtttgtgggtctgcgtccatcttgagatttgaggaacagatgtgacatcccatcacttttgccatatggtctctgttagaagcaagtcactgggtcccaccctcactcaagaagaaggtatcacaaagggtgtgaataccaaatgtactggggtccttctagacgctttctactacaattataagaagaaatgcactagccccaaatcattggaaacagggtcacagggagatagagcaagttggaaagtgccttgggacttggcttccctcttttctgacaagaatcgtcttcatgaatgtgacatcacctctttgataggtggaaggaggcagggagcaggggcagatcaaggctcatgtcagcatggtcctactgaggcagccctgtcctttctgcaggcagcagcaatcagatgcaggtcttcatctccaacaggagctggaatcctggtttctgatgttggcccagagcacttctggagaaatgtgtgagggagacaagtggagaagggatgtccacagcccaccatacttagggtggtgtgcccgagtgaggtgcccgtgctctcatgttctgtaacctgtatggtattcagtaaattatgtgagacattttatactttactataaaataagctttgtgtttgatgatttttcccaactgtaggctaatggaaatattctgagcacaattcagtgctacaattttccctctcaccactgcttttgtgatgtttaataaagtttgttatgttgtattttcattttcattcaactctgtgcatctcatttcccttgagacttcctctttgacccatagattattaagaagtgtgttatttagtttattgggtcatttccaccattctttcttctacttcactgattctttcttgtgctccctccatctgctgttgagttcttccatttatttatttttttatggttactgtgtttttcagttctaagatttctatttgattcttttttacatctcttagttctttgctgggactttctattatttcatggtttttaagcttgttcataatcactcattgaagcatttttatgatgactgcctttaaatatgtgtcagagaattctaacatttctgtcatcttgacgttggaatctttttttttgtccttttgatttagtttgaaatcttcctggtgcttggtatgatgagtgattttttattgaaaactggaaatgtgggctttgtggaatgagaagttgaatcttatttaagctttctgtgttagttgtctttttattacaccactctagc

SEQ ID NO: 478933 - DNA, 474 bp, Homo sapiens
ctctgggagtcttaagactttaatgcgcacaggaaacaccccatgattgtgttaaatgcagattttattactgtgcacctcagcagacttgaggaagagtcacacagccagcaactgactgagctagatcttcaagtggctgcttccagacactgtgcccttgacccactggctcactggtggaagtttaatgacctgctctccaaacaaaaacgccctggtttgaagcatttgccaaatcctgtgatacaaatccttcaagctaccaatatgacatcactgagcagagtccgggaggaattagactgtgcatgtgagtcagagtcactagctgtggaaatggagccccttccaaaaaggcattttgatccagctcttaatgttcctcctacgttgttttggagtggtccttctcaggacagctggtgttcacttcatcctgggaagcttctttgctgctgaagtcagggaccc

SEQ ID NO: 478934 - DNA, 454 bp, Homo sapiens
ttggtctatgtctttttccaaagatgcttttgagggcttttgagtatttaaaggggacaagcaggctggaggagaaagagggaggttatggtcacataacagaattcacatgtggcaagagaaaaggagcaggcagaggaatagtccatgacatattaatcttgggctcagtgtcaggcatgctgcaccatgtggatgacagagtgcaaacaggctcagcagaagctgcctctcactgccctaccagctcatctcagagcatggggccttcggcttcactgttgtggaagagcctggcagaatgttctaggccacatgaaaatcaggctgctgcagccattcagaaggaagaagtggttgagtttttaaacctgctttcccaaatgccctgttcaagagggttagaacaaagtttcactcttgttgcccagtctggagtacaatagcacaattt

SEQ ID NO: 478935 - DNA, 587 bp, Homo sapiens
ccgaccgtgggtgcccgctgcgtgatctctatgtgatggatgcgataacctttttcttaaagtgaagagaatggttttatcacatagtttccttcggcaaaaggtgtccaatctctacagacccacaaaatctaatagatgtctttgtattcctcctcctggaacctcagaggatccagaacggcagctggtccttgctgggctgttcctgtccatgtgcctggtcacggtgctggggaacctgctcatcatcctggccgtcagccctgactcccacctccacacccccatgtacttcttcctctccaacctgtccttgcctgacatcggtttcacctccaccacggtccccaagttgattgtggacatccaatcttacagcagagtcatctcctatgcaggctgcctgactcagacgtctctctttgccatttttggaggcatggaagagagacatgctcctgagtgtgatggtctatgaccggtttgtagccatctgtcaccctctatatcattcagccgtcatgaacccctgtttctgtggctttctagttttgttgtcttttttttttctcagtcttttagac

SEQ ID NO: 478936 - DNA, 714 bp, Homo sapiens
catctgcagcttgtgagcaatgcatgaaagatgaatcacacagcagcaatgccttcagcttccagaactcttgtaggcttaatttaacctttatctcaatagttttagaaatgaagcactctttttcaaatactgcccacaattcatttttaattgctccttcaaaagcaatacttgaaaatattcccacagcaaaaaccaaatcactttttttttccttctcagaagatggagaagggaggagtcctttggcagaagggacacattcagtcagccacgtgattaaccagcgtgtaactcatgtggtcaagataatgcttgactgggattcaagttatagggagcatctaaatcacatgaaaagagttagtgagcttattgggagtcctgtggtctgggacttataccaatatcctctgcaaagatacagaattctcagtcgatagtttttccctcaaatcttgaaatatttcactccactctcttcttgctttcatggcttctgatatcattcttatttttgttgctctgtaggttttatataatgacttattttctcatctagacaattgctgatttaaataatgtttcaagctacaaacttaaagaacttaaaacatgagaagttacaagaaggcattaatatgaagaaacagagtgttgtcatttttccccttgtcaaggataggacttacattataattttatatcatc

SEQ ID NO: 478937 - DNA, 673 bp, Homo sapiens
aatgctgctatgaacgtggtgtacaagtatccatttgagtctctgttttccgatcttttggttatattactaggcaaggaattgggcagaggtgacctgcttagtgagcaggccacgttcagcaatagcagatcaaagacccgtatgtcttgtgatcttcatgaagtggctggcaaggccagagattctgatcccatcaccaccgcattcagtgctgtctctcctcctatttatctggctgcctgttgtctgcatggcctcctgctactcattgtgggtaacatcggagaccttcatctgcaggaagatagaaaaaggcaaaggagacaccaggaaagaggagcagagtggctagggcagtgcactgcagatgcatggacgaaagctcgcagcgacacaggtatggggtgtctaatcagggatgagtgtgagcagcagaatgaggagcatgctttcccagaggaagagaggaagccactggagagatgaaggatgccatggacagatacttgaaaggaaaataattgggaatgtagaaacaatgcaaacagtctgcggataatgacccacagagaatattaataaactagatagcatcatgaaatgtaatttccagcaataatatgatgatcatgtaaactataaaaataatatcatgttctaaaatggtatg

SEQ ID NO: 478938 - DNA, 1058 bp, Homo sapiens
ctggggtcaccctgcagctataccagccagcctgctgagaagattctgcatctcctaagatcattctctgcaaaatgccgctgttctcatcatcctggtccaagccaagttctgaatctgagagcgggacaccagcccgaagccaaagggatccccctcccccaccccgggcctgtctgtggcctgttaggaaccgggccgcacagcaggagaaaacctgtgggatcatctcctcccagtgtgcactgtctggtgggggtgtaattaagatgccttcctctctcttagcaaagggctgggtgaggccctcagatgctgaatggattgacacaaggacaagaggacagtgttgtgtgtgcatcagtgtcatggaagtccgcggcctatttttcaaggaagctacaaagcccccgatgcattcgacaccttttcaaggtttgttttttgccaatggactttgcaaggctccaaacatcactacttatacggagaaggcacagctctgaaccatattctttaatgctggagaacctgaagagaagtttgtctgacataattttcattgacttgtggaagcattaacaccttatctgctttgtaaatgcaaagagaagatcaacactctgctatccattctccttatcagacacttagcaaatgaaaaagccaaagatgctactgagatcatcaactgttgaagtgcttctgagcctctctgatcttcttaggatgctcggcggaatgtcaactgctagaccgccccagcctctagtcttagggtccccactggagctgtgtgataaataaggaagacagagaaagacttgcagattcaaaactgcctttgaagggctcttggacgaatgtttattcagaagtgttgaatcagattttattgtagtttgataggactactgattgcaagatacctgctagaggaccaaagaagggtttctagagatgagtcaaggaatatttagatgccggatgtctacacagttaagaagagaagtgacaatgtccccagaagagaaataatgaggcttagattttccctt

SEQ ID NO: 478939 - DNA, 527 bp, Homo sapiens
gcaactgatgcaaggcacatcctacacccttcaccacacggtggagaagatctttaggagcaaagaacaaatgatatgaatgaccacactgactgtcagcaaactgcagagctgcttaaccaagaaatagcgagactgaagcaacgcttgcagtcaaagaaggagaaggcggaaaggccagagcagggcaaggcaggaatcaaacaggccacaaatgttgcaggcagtagagaccacgtggaggatgaggacttagcagtggaggggaacaggaaagcagaacatactggttccccagcgtcccagccacaagtccctctgaagagtatggatgacaatggtgacttaggtccatccttcaaatgtcctgaaggggagattggaacagcagatgtacaattgtgggaagaattaacaaggagtaaagaacgcgtaacacaagaccaaagtctgaccagagcaggcctctctgcaggacaagggcacagccatggagggagctcctgaagctgcagctgaggcttccc

SEQ ID NO: 478940 - DNA, 671 bp, Homo sapiens
gctccggcctggcactgtcaccgccgctgcacgctcctcctactctcttcaatctctgccttctcagatgtgccaactgctgcagaggctgctgctcctgcttaaatggcgcctctgggccatggcctggttttctgattctgtaggtccggggtggggtccctggtaatgctgatgctgcttagagcaggaatccagatgagctatgccactcaggtcatgcagacaccagcagcaaatggtagtgggctattcaatcctcaggtggaagaagtggctgtaaaaagagcctcttcagccgagttcctgctttgctctcacagcttaggactctgcaagcttacacttggcccttgtgcaaatgagaagatgtcccctctcttggtggacacaacccttccctctgctcagacagtgcgtggcttgaggggcagaagaccctttgtgcaaagaacttcctggacaggtgcagacactctggatacccagctggctctgctcccctaccaggccagcatggtctgtgtgatggctcatagctccatttatgaccttagtccacagagtgccagacactgccaacaaagaggaagagccaaattctgacactggggacacaaactaagggagaaggcagcagatgtactgatcaggtgctgagcaagcaagca

SEQ ID NO: 478941 - DNA, 764 bp, Homo sapiens
gaggagagtgccatttgatgtcttcttgcatttggtttggacctactacactgaggagaccaaggtgtggcagctgcagccgagtgctagcagatgcaggagtgcttgccaccatgcagtcattcgccacagtgacagaggcaaggcggttgcagggagaacgggggcccctgctggaggagactgtgctctggagaacactggtgggagtagccagagaccctgactggaaggctccacctagtgaaaagaccctgagtgccttatccacacctccaacaagctgcagtcagcccaaggagaggagtttggactctccaaagcctgaaggatgtaatagccaagtggccaaacagcagaagtggcaccccttccacccctccctcgaggagctccatcccagggaggcaaaatgctgctatcggttgctggctgaaattccaagccattcatacaacggtgatattgcagaacccaggatctgcaatatcctgcaagtccaagaaagcctcttaattgtcttttggctgcagatcaagaaaaactttggatagtttttatcctctcagggtgaaaaaggtaatttaactagacggttagtggactcagagtatgtaggtagagacggataaagtgaaggaacagttggggttagttcagtcagagtagttttgtcatgtctttagtctgtggcttaagcttttcatttgttttttttgcaaagaatcttttaaggaggcaaattttgattcatttagtctttt

SEQ ID NO: 478942 - DNA, 655 bp, Homo sapiens
gtggcggagggcatgggcctctctcaaggcctgcaaataaaatcattctccatcctcacttggggtggccccacagcacaagagggtggcccacctgctgtgagtgtccctgcagaagccttcctgtccctgtctaatgttcctctagtggccttcctttcattcctgtggccctgtcatagctacagcgtgaacctggttggaggagcccgctcctcaacagagaggaactgcaggcttcccccgaacccgttctgctcagcagaaactgctgccgtccaccacttcctggtttgtcacagctggaggaaacctaactgtcctaaaggccacagggagcctcctgctggatttggcatcttgtggggagcccagtctactcctgtgggctttgcccatgtctcctacagggaagcctggcagggtacttgcccaccttcatccacagggccatggccagctcctcacccctagaggaagcacccatattgattagccaatgtttccattcatggaaacgacgtcttcagaaaaaaaaaaatgcctattgttctctcaggaatactagacacatacactccggtatttattccccaataaggtgaaacccaatcacacagacttttgaaagcattcagaaggaagggaagcttac

SEQ ID NO: 478943 - DNA, 795 bp, Homo sapiens
tccccgcgggaggcggtacacccccagtgatattgggcataatgtcatcctctccttccctggatattaggaacaatatcacagggtatgggaagtataaagccttctccacctgtggctctcacctggcagttgtttgcttattttatggaacaggcattggcatgtacctgacttcagctgtggcaccaccccccaggaatggtgtggtggcgtcagtgatgtacgctgtggtcacccccatgctgaaccctttcatctacagcctgagaaacagggacattcaaagcgccctgtggaggctgcgcagcagaacagtcgaatctcatgatctgttccatcctttttcttgtgtggcggatgttcccgcagttgcacttgtgggtacctgccaaaaagaattagaagccaggagtggaagagagattcgtacacccaaattcatagcagcagtattcacaacagccaaaatgtggaagcaacccaaggcctccaatgtgcaccatgcagggaggacagtggacctgttctccgtggtcatggcccagcagaggggaagggcagttcagtgagtgctgagggaccgtcgggagccttgtttgtttcctcatcctcaggacaaacaggagagtgccgtgggcagatgggaggagaccaatgtgcaaactgtcagctcagcagactgtggagtttcagttcttggttgtggtggggggtctctctcaggaatcttcttcaaaattttgcttccctcccccactggttgtccttttcatagacatctcacccacgata

SEQ ID NO: 478944 - DNA, 781 bp, Homo sapiens
tttctggatatgaggaagaatatcacaggggtgctgtacaattacttcgatattgggagtaatatcatcctctactttcctggatattgggcacaaaaacacagaagggatattacaattagtatcacagggtgtgcagccactgtgatattaggagcaacatctttctacgatattacagacaatatcacagggtggatccttttgtcttactataaaattgttccctccattctaaggatttcatcgtcagatgggaagtataaagccttctccacctgtggctctcacctggcagttgtttgcttattttatggaacaggcattggcatgtacctgacttcagctgtggcaccaccccccaggaatggtgtggtggcgtcagtgatgtacgctgtggtcacccccatgctgaaccctttcatctacagcctgagaaacagggacattcaaagcgccctgtggaggctgcgcagcagaacagtggaatcacagccatctttttatatacatgaagtccgcacttcgttttggaattccctgaaaattgacttcatggaagcaatgtacagcaggtcctccaacaccattggtgcgttcaaagatgtgtagttataatgttgcccagaaataacttctcacctatatgttcaaatgatttttcacatgagtgctaagaaagtccactggtggaaaagcagccttttcaagaaatggtgttggggaaacttgatttccacatgcagaagaatgaaggtggactctatgtcacaccaggtgc

SEQ ID NO: 478945 - DNA, 2094 bp, Homo sapiens
cgcttggtggtaggcttgggcactcagagtatccccggacaccatgggacaggccagtactaagtactcggcttatttaaactttataaaaactctccttaaagaaggaggtgtaaaagtctctactgataagttaattgcagtgtttgaggtcatagatctcctctgcccttggtttcctactgacggaactttagaactcaaagattgggatgagattggccaacaattcaaaattgctcataaagggggaaatattcctcccaccatttggtcaatctgggctttggttcactctgttctagagtccttgcagactcaggagaacaacatggagactgacccctgtttcctgtcctctgaggaggttgaggaagtcctcagttctctttcccctgaggaaactgcacagattgaggccgtcattttacagatgaacctccattctgacattcctttgaccctgccacctacaccagagcctaccgcgcccccattatcactttatgatgaacttttacatgatttaaataatctcatttccccaaaccagagaaatccaaccgaaatacattctcaacagctacctgctgtagggcccccgaccttccatctgcgcagcccgaatctggctctaaactacctttctatggagcccggtaatgaggctctcaactctgtccctgttcagccctgctgcagggccctcaactttccatctattcggcctggcaatgaggccctcaaacctgtccctctgcagcctgattatccatctctcacttttgtttctccttcagcaaatcaggctcccttgaagcctcagggtcccttgaagcctgtcccgcagttaccactgcagcctggacctcaggcccctgaaggacctgcccagcaggtaatctcacctcaacctggcttacaggttctcaattcttcctccgttcaaaatcctaacttcgtttctccttctggtctggtcactactgccgctcataagcaacaagttacatacatccctcaagatgatactcctcttatgagagccatcactcaggccagagaatatggggctcctgaggcctggcaatttcctgtaattttacaacctcctatacctgccgtccctgcagcacaaaatcagccacagcccgctgaccctgctcagcaggaggctgaccccgcggctcctcaagatctacagcctgagaatcaggtccctcagcctgagaatcaggctcctcaggcaaataatcagcccccacaactgcctgctgctgtggcacagccagttccagatttcaaagcatcagtgaagcagtacggcaccaactccccgtttgttcattccacattaaaggccctagcagaagatgcttgggataacattcagaatgatggtaaaatatgtccatcttttacggctgttacacagggacagcaggaaccctatccagactttattgcccatcttcaagatgcgacagagaaaaccatccctgatagccacggccaacgacttgttgtagaacttaaggcttatgaacaaacaaatgcagactgccaagtggctattcgccccattaaaggcaaaattccaccaggaggtgatatactcttctacattaaagcctgtgaaggcgtgggggaactctacatacagcaatggtcctggcacaagccatggccactattagaatgcctggacgattctctggcaaatgctttcaatgcggccaatcagggcattgtagaaaaaattgtccttggctttcaggctgccattcttttcaatgccaacaacaaaaccctatacagcaacaaatcttgccctccagtctgtgcccacgatgccgtaagggaaatcactgggctgctcagtgccgcgcaaaatttgacattgatggtaaccctttaaagccattcagcaactagggaaatggaaagaggggccagccccaggcccctccaaacaatggggaattcctcatatcaatagcctagacactggcccaaagaatatgcatccacagccttagttggtgttggtcaggcttcagaggtttatgaaaattccactattttacactgtac

SEQ ID NO: 478946 - DNA, 1071 bp, Homo sapiens
cctggtgtcactggaggggaaggtgagcctgctgtcactggtggggaagttgagcctggtgtctccagtggggaaggtgaggaaggtaaacctggatgtggaaggtgagcctggagtcaccagtggggaaggtggacctggtgtctccagtgggggaggtagacctggtgtctccagtgggggaggtggacctggtgtctccagtggggaaggtggacctggatggggaagtgggggaggtagacctggtgtctccagtaggggaggtagacctggtgtctccagttggggaggtggcctggtgtctccagtggggaaggtggacctggatggggaaggtgagcctggagtcactggtggggaaggtggacctggtgtcaccggtcaggaagatgagcctggtttctctggtggggaagatgaacctggtgcctctggtgcggaatgtgaacctggagtcaccagtgggggaggtgaaagtggagtcactgggttttctcctcgccttggtgataagggtccgcggataacagagcaccttgttttacagctttacaatgttctagtcagattacacagaaagggcactaatcatttctcttcctaactcacccttcaattctggaaaacagtagacaatttttaatactgttgtctctctgctatccacatttgcgtgaaaaaaaaactgcatattagtggaccctcaaagttcaaacccatgttgttaaagggtcagctgtaattccattagtaatattagctgcacctggagataaacacccggggaccctcgagttcaccggtgggggagattttcccaaactcttaccttcaagcaaatgtggagcagagcagacctctgagggaaagtcctgggtggggtttgctccatgttccttccactctcagggtgtggagcccccacaatctcccaaacctagagagagtaaactgaagcttactgtccaccaagactgaaggatgttccaccttgtaagtaactgacagtcggatgactctttagttgtcatggcaggtgctgaagggccagtgctaaactccgctcag

SEQ ID NO: 478947 - DNA, 989 bp, Homo sapiens
cctacctcaccgtaggaggagctgtgggtccagcagagagctcctttccctgctgtcccccttagatctggaactttctctagatattcatgcatactggacaaatagggcaagatctcctgctaccaagatgtacatggtccagcacatagtccagatttatgtggcctgtcgatgcacacactaacccttgctactgttagcagcagcaagagcactgactcttccttaagcatgatattctggaaaaatctacgtgatgcctgctccgatctggccatgtgacagtctggcagtgtcccctgcatctgtcccgtatccccggctttattcttgtcagtgggacatctcgatcagcctgcaagatagcactcccatcaccctacaaggaaacctcacccttatttacatcaccctcattgccctacttctctgcacccattcatggcagggcagggaggaacacccaaaagtgagtcctaatgtcctcaccatccatttcctgttttctctcgaccagacttccaccacgttctcacctccatcacccactaagattgctgtggtaggtaatgttgatggcacagtgtcaaatccagtgctgggcatggctcctggcttcattcattcctgcaccctggggcccatcagtaaggaacatcaggaatgagaaaggagttctgactgcagattggtcttgttcacctcttgttggctcaatcacgtgtgtttcattctgtgtttctttaaagcttttgttttgagattgttttacactcacagaagagctgctgaatacacagaattcctgtgtcccctttggccgccctgcccttgtgttagcattttacacttgccatcctacttcaacctcacaataaccagagggggaaaagccgttgatactcccacttcacagacaagaaaatgaaacaccccaacgcttagcagcaggtctcagttcacacaattggtaaataaaagagctt

SEQ ID NO: 478948 - DNA, 1301 bp, Homo sapiens
taaactttcccttataactgcttttgatgcatcccctttgccttctgaaggcggaccgtgcactgagaatcataccaggttgcctggtgactcgagccgaccaccttcagtggcgcttctgcggtcagaagagcagctcgcggggtcaaggaaaggctgtgatttgtgcaccctgccgcctgggagctgcagagattctctccggctgcccggtgtgtggcccaggaccacgctggtgtgcaggctgcagcacccgatggccttgtttgctttacactcagtgttgccacagagcatcctggaaccatcagataagggagccattctccgctgagcggaagctggagcagaggacggagttgtgtggtgtgtcggatgactgccccccagtgtcctggtatgagagaggagtgcaaaggggtgtgcaggatgcagccgttgcagcgggaggggagccctggggcggagggaattgtgtgaacagaggatacaggagggtggttttttcagaagcaaaacgccccagcggcagttctggagcgctgccaggtgtcagctgtttgcattgccctccgtggtacaaacgctgccgcgtggcatgtgttctctgggcgcctgggtaccccaatggtggtcgtggggtccacgctgcatcttggtgccgtgttctacctcgcgggagctgtgtctggaaggacaaatgtctgacctttgctggctcccggggccgcccgctggcccacatcgcacatgtgtataaacctctcaaaggcctcttcccaggagacttcccctctgctggacacagccaggtatcgggggctgtgagccgaacctggctacaagcctcccagctgagaaagcaagcagacttacacttcctcggctgtccggcggagcccgaagcagcaatccacctccttcaaagggtctgtggattctctcggcttttttggtatgtttctgcagtagttcttggagcaaaagtttacaatgtgggtctccacacactgccctgtccagccaagtaggagctgcaagttagtcctgcctcctatccaccatttttcttctactccagtgtgatattttgatacttgtatacaatgtgcaatgatcaaatcggggtaattagcatatccatcaaacatttattttttgagtgtgtgttgaaaacattcaaaatctgctcacctagctatttgaaaatgtgcataagctgctgtttattgtagtcaccccacagtgctgtagaaccctagaacttgttcctccaccctagctgtgcttttagatccatt

SEQ ID NO: 478949 - DNA, 552 bp, Homo sapiens
attttcaaatgcttattttccatctgctctgtctgctgggcaccccctgatgatccctgctgatggtgcctcaggattaccccagtgaaggacagtcttcaccttctcatttcaaaatacattttgcatccatccaccaactcagtgagaggccactggaggttcttcatgaccttgaccagccattccagagggtggagggggcagtatggggatgggggatggccgtgcaggagctggaagcagagatagcacagatagcatctgcagacagcactgtttggtgcataacaggtgagcacaagaacagctgttacctggatgaacctaagaacagccctattacctgggagaactctgggagactttctgtgggaatcccaggaggccctccagggccatgcctgtctgctcacagcagtgaccttgaccaggcagttcgataaccttctttcctgaacactcccaagaaaactagctgatggccgaagaagctttgcttccattcttctgtctggactgcattcccatgggcattcttggagaggacat

SEQ ID NO: 478950 - DNA, 624 bp, Homo sapiens
ttaattgagtaatgaatgatttgcgaatggggcagcttccagaatcacagcggattcagagactccagggatgcctcatggtcagaacatatttatagacaaaaaaagggaagtgacatacagaaattgcagggctgtgaaagtatgctgtatgatattacaatggtggatacacagcactatacgtttgttaaacaccatacaatatacaacaccaagagggaacatcagtgtaaacttcaggctttgggtgattatgatgtgtcaaatggtctcttcttagttctccatttaaaaggataccttatgcacctccagacctttctaccaccatatctcattcctactttctttgttgatgagctggatggactctgtgaagatgtgatcccacatactgcatctatcaatgctctccactttcaggatgttattctgttgctgttgtattgcagtgacatcaagttattttctcttggttattcaatcggttcttgagttttttaaaaaattgaatgcaggctcttatcaaattttgtagcctgtgcacttaaaaattctttcagactggattttatttttaatttgtgcatgttattttcttttaaggtttgcatagctgct

SEQ ID NO: 478951 - DNA, 1145 bp, Homo sapiens
agcagagaaaagggccacagcttagaacatgtaggaagggagcaaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctggagagtttgccagcatactggatacagtccaagtctaccatgcttccagcacggggcagggtctgcatccctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgcacattatttgcaacgaatagccacagcacaaggtctttggagtcagaactagattccagtcactgctggatgtcctcactgagccagctgctgtttttttcccactgttcttctc

SEQ ID NO: 478952 - DNA, 2021 bp, Homo sapiens
tgtaaggactcttccatttgcattcctgccaagttctcaaatgatgctgatgctgctggtctggggatatgtgatctttctgagcttatgcctgattgatattaatctaagatggctggttaaaatgcccaccaaacacccccacccacactccaagctaggtggtagagctgtccatcttggatctaacccaaatgcaggccctggtgaagaaaggatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcatggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtcggaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatc

SEQ ID NO: 478953 - DNA, 1625 bp, Homo sapiens
ttaaacacacaccacaaagaagaatcgacagaagtacatagatcagcatcaacgttaaatgcaaaaactcccccactgcgagttcatttttaattcaaagtttttgcatttgtatcacaatgatttaaactctaccctcctcacccttctacaagaagggaagccttgcaaagggagctgcaggctggaccaaagaacactttcaaggctctggcaatgtcagctgtatctgaaggcaaacctgattccgcaaagcatcaaatccatggccaggatttgtgatgtcctcctgatcacaaaccacatcgattttcagctgtgtgggctctgtgtgcacagttcagtaccagggagctggagatggcggcttggggtcaccgtgctatgcacgcacaagcaggctgctgagcctggcaaaactgtactcctaattttcagtggcaatgcattttccttccttgctgagctgccctgaacatcacctaagaataatgccaggtgtactttaaaagcataacagcacctgggatccactaagcgagacttttttgaaattgcttttgtagaggaggtctttttcctgaaaatatatatatgttgttgggtatatatatgttgggtatatatatatatacacatatatgtgtgtatatatatacacatatgtgcatatgtatatatatgtatatatacacatatgtgcatatgtatatatatgtatatatgtatatatgtatatacacacatatgtgtgtatatgtatatacacacatatgtgtatatgtgtatgtacacatatgtgtatatgtgcatgtacacatgtgtatatgtgcatgtacacatatgtgtatatgtgtatatgtacatgtacacatatgtgtatatgtgtatatgtacatgtacacatatgtgtatatgtgtatatatgtacatgtacacatatgtgtatatgtgtatatatgtacatgtacacatatgtgtatatgtgtatatatgtacatgtacacatatgtgtatgtgtatgtatgtacatgtacacatatgtgtatgtgtatgtatgtacatgtacacatatgtgtatgtgtatgtatgtacatgtacacatatgtgtatgtgtgtgtatgtatatgtacacacatatgtgtatgtgtatgtatatgtacacacatatgtgtatatgtatgtatatatacacatatgtgtatgtatgcatatatacacgtatgtgtgtatgtatgtatacacgtatgtgtatgtgtgtatatatacacgtatgtgtatgtgtatatgtgtgtatatatacacgtatgtgtatatgtgtgtatatatacacgtatgtgtatgtgtatgtgtatatatacacgtatgtgtatgtgtatatgcgtgtatatatacacaaatcttccactaccctatcttttcggtagttttgtctctttttgctgcttccaagatggcttttatttccctagtggctttttttcttcattgattgtccaaagacaatctttggtttactttttagtttagtttactttttaatggtatgctgtttaatatctacagcagttttagaattggccccatgttctttgactctttgacacttctcctcaaaagggtgg

SEQ ID NO: 478954 - DNA, 2172 bp, Homo sapiens
cgcttggtggtaggcttgggcactcagagtatccccggacaccatgggacaggccagtactaagtactcggcttatttaaactttataaaaactctccttaaagaaggaggtgtaaaagtctctactgataagttaattgcagtgtttgaggtcatagatctcctctgcccttggtttcctactgacggaactttagaactcaaagattgggatgagattggccaacaattcaaaattgctcataaagggggaaatattcctcccaccatttggtcaatctgggctttggttcactctgttctagagtccttgcagactcaggagaacaacatggagactgacccctgtttcctgtcctctgaggaggttgaggaagtcctcagttctctttcccctgaggaaactgcacagattgaggccgtcattttacagatgaacctccattctgacattcctttgaccctgccacctacaccagagcctaccgcgcccccattatcactttatgatgaacttttacatgatttaaataatctcatttccccaaaccagagaaatccaaccgaaatacattctcaacagctacctgctgtagggcccccgaccttccatctgcgcagcccgaaaatggctctaaactacctttctatggagcccggtaatgaggctctcaattctgtccctgttcagccctgctgtagggccctcaaacttccacctgttcagcccggtaatgaggctctcaactctgtccctgttcagccctgctgcagggccctcaactttccatctattcggcctggcaatgaggccctcaaacctgtccctctgcagcctgattatccatctctcacttttgtttctccttcagcaaatcaggctcccttgaagcctcagggtcccttgaagcctgtcccgcagttaccactgcagcctggacctcaggcccctgaaggacctgcccagcaggtaatctcacctcaacctggcttacaggttctcaattcttcctccgttcaaaatcctaacttcgtttctccttctggtctggtcactactgccgctcataagcaacaagttacatacatccctcaagatgatactcctcttatgagagccatcactcaggccagagaatatggggctcctgaggcctggcaatttcctgtaattttacaacctcctatacctgccgtccctgcagcacaaaatcagccacagcccgctgaccctgctcagcaggaggctgaccccgcggctcctcaagatctacagcctgagaatcaggtccctcagcccgagaatcaggctcctcaggcaaataatcagcccccacaactgcctgctgctgtggcacagccagttccagatttcaaagcatcagtgaagcagtacggcaccaactccccgtttgttcattccacattaaaggccctagcagaagatgcttgggataacattcagaatgatggtaaaatatgtccatcttttacggctgttacacagggacagcaggaaccctatccagactttattgcccatcttcaagatgcgacagagaaaaccatccctgatagccacggccaacgacttgttgtagaacttaaggcttatgaacaaacaaatgcagactgccaagtggctattcgccccattaaaggcaaaattccaccaggaggtgatatactcttctacattaaagcctgtgaaggcgtgggggaactctacatacagcaatggtcctggcacaagccatggccactattagaatgcctggacgattctctggcaaatgctttcaatgcggccaatcagggcattgtagaaaaaattgtcctcggctttcaggctgccattcttttcaatgccaacaacaaaaccctatacagcaacaaatcttgccctccagtctgtgcccacgatgccgtaagggaaatcactgggctgctcagtgccgcgcaaaatttgacattgatggtaaccctttaaagccattcagcaactagggaaatggaaagaggggccagccccaggcccctccaaacaatggggaattcctcaactcacagcctttggcagccagccagatgagcactttcccagcccaatccattcaacctgccccccagttcccacttcagccatttgtaccacaggatctaacgactcag

SEQ ID NO: 478955 - DNA, 2756 bp, Homo sapiens
ttccctgagagcctggtgtaatgggtctggactggggccagagaccaggcactgaaaatctttaaaaaaagtgaatccaggtattgacaggaagccccaggtcggctgccccaccatgctagccatgcccccacctccccgggcccctgagttttgtcatgatgtagacatcactggagacgctggagctgaagttcgggccacggttgtcaaaggagagatgcacagaatttcggcagcacggaaacctgcttgtgctcatttctcccggcatgtcctccacgtctttgactcctcacaaggcggctgtacaggcactttcccatgccaggcctcactgttggcctggcatgggctcccactcagcccgtgctgttccagcgagtccttcctggggcctgaaaccttagcccatggctccttccccacatacgcacaaacccgcagcacacagagctggccctgcccatccactgacacaggaaacctgagcctcgaaagcagcccatggcgcacctcagtgctggtgcactcaccctcttcagcctcctggttcttccacggagcccagctctggagcagcagagctcagggacactgtgttcctcctgtcctcacatgctgcagcccaccaccttgccaagctgtgtctgggcacgtttctggaacctggcttggctccagcactggccctgccagctctgtgcagacaagctcccaggagacgccctgggatttcacaatgagcctcgtgtgcccagtctacccctgccccccagctgctgtccgctgcaccttcctttggtttccagaccaggtcaagacatgggatgagcctgctcagaagggatgagcctgctcagaagccctgggccacacacaagccctggccagccacagtcggtgccctatgctcaaagagccacagcgctcttgacccagctccacattgctggccgcaggcacttcatttcttgtaaattaacccttctttctctctggaaacttcaaaaacttctctttacctttgaagttccaaaataaatctttttaaaatgcattctgccatgcgttggtgggcccttttaaataggactggctatctggtctgcagaacctggtgctaaactaaaatgtggaagtcctgttcaaaaagcaagaaaaaggcataacaatactaaaatatacagctttttcctctcttccagagtctctttcttgatgtgctgcatttttcatgttatttaatgtcattccaagttaaaattttaaagtattagcatgaattttatcatttgtgcaatgctagttttaaatgcaaatacaaaagtgtttaactcacatgaggaatcactgaaattatggtttgtgttatgtggctcgagcatgcatgtgtatttcatttctaccataacagcgacaatgctgctgaaaagtagctcaactgtttgtattttacttcttgctacatgcacgtgcgccagcaccctcttatcttcagctgactaatgagggagaaagcactgaaggacaggaactctgggttgccctgtcctcatctttcctcgtatgtcatcattttcaaagttcgtggttgtcgaatactggaagtagcccaggtaagaagggatgggataggatgccttcattgttctgtttcttagaaggcctttgccttctttaggcatttgaaacaagttctggttccaacagatcgtgtgtggctttgtacggcttccatatgcccctccttctgtggtagagcacgattaccttctactcgccttcagtgtcgctgaactgcaccggaatccactggaattctgtatgcatgggccttgggagcgtgaatggagcagcaaggaacggggacacatatatcacctgtgtctctgcacatgcacacggtttgtggctccgtcggacttcacttacaaaacccaagttcaaagatcaaattatgaagcatttcaagatggcaacagatgagaatcagacaagcatagagtccttctgagcttagagccttacgtgaccacaagggccacatatccaggaagctggccctgcttttgaactggaaaagttctgatcaattttcttctatcagttatttaattattttcctccctcaagtctctctgttctctcctcctggaactcctagtaaatacataaagaaacgtctagctcccgctcgtgtcaattgtctcttacttggatttctttgtccccatgaatgacattctacaagaaccccttggtctttcagttcactaatttattcttcaatcacgtctgttttgctaggtttcattaacaatcatcttttaaatttcaaagttttatagttcttttttgtaacagcctcttcttgtttcaaggatagtttacattctctaatcttctcaaacatgttaaatatgatcacctttaaaactttaaactgctgtgtttagctgtttccttgagcagggagagttccgtttgttgaagttgaatgccactgtttcgtagcattcattttgctgacatgtttgacagctctcatctatctgattatcttcctctttgagaatccctgaccagtcatgtttctccctgctcaagtgaaataaaggcctcaaatagatcagtggttttcaactctttttagcatagataaatgttgtaaaataaaattttatttgtggaaatacagtgtgtaaatccacagtggaaaggcaataattgaggcagagatgccctgcaaccct

SEQ ID NO: 478956 - DNA, 613 bp, Homo sapiens
gactttctgccatcacaatacaagccacacacaccttgaaaactaatagtctcacacttacggcagccatgaaaaccagcagccaccataggagaatgaatgtctttgtggcatccccaaagccctattcccagaaacttctctcacctctggctgaccttaaggctctgcacaaggaggaagtgaaggctaaggccgagttgccaattgcctgtcagtgtattgaaggcatgccccaacatagagagcccttcagcaagagctggagatttactggttcaaggcatttaaggaaatctgagtccagtcaagagctgaacactaaaataaccaagcagagacttcaggaaccacacacaacaaaacacacagaattagttcaggaaatgatagccattcaggtctgctatgttaactcttttctacaaacaacataccaaaacttacaggatgctgctaaagcagtgcttagagggaaatgcatagctgcaaatgtctatattaaaaggaataaagatctcaaatcaataacttaatgtcctatgttaagaaattagaaaaataaaagcaaactaaacctaaagcaagcagaaggaaggatataataaagttt

SEQ ID NO: 478957 - DNA, 967 bp, Homo sapiens
ggcccgactcctccacgcttgtacatcccgagttccttagcatcagacacacccatgtttgcagaggagtacctgaggccgttcctacactccgcaaataagcacttcatgacaggctaccgagtgatcttctacatcatggtggacgccttcttcaagctgcctgacatagagcccagtcctcttcgaacgttcaaagcatttaaagtgggcaccgagaggtggtggctcgatggccccctggtgcatgtgaagagcctgggtgaacacatcgccagtcacatccaggacgaggtggacttcctcttcagcatggctgccaaccaggtcttccagaatgagttcggggtggagaccctgggcccgttggtggcccagctccacgcctggtggtatttcagaaacaccaagaacttcccttatgagaggaggccgacctcagcagcttgcatcccgtttggacagggagatttctattatggcaacttgatgatccaatacgtcaaggtcgcacatgattcccagaggaaattatgaattacgccatgaggtttatgacgaataaatgaatcacggcaatttcttataaatgagggaagtcttaagaccttccattttttagagacatacaaatttacatccttcccaaataaatgtttcttcttgccattttgagccatcttatttggctaatgtaggataaagaataaaaggataattacttaatgttaatacacagtaatgttattatctatgtattgtagacaatgtgaaaatacatttgacatagaatgaatatttttaatggagaaagactctagttgagaaaaaacattcataaaatggaaaagtagttcacgcaaaggaaaaaataaatgccaggccactcactgagtagtcactgtgtttttccacactgggatatgtgtggcttgtggtcgacctcgcctattgtctcagtctgttc

SEQ ID NO: 478958 - DNA, 749 bp, Homo sapiens
ggaagagttgaggagccctagaaaggaacatgagtgtcaccgagccttggggaccggccaccctatcacctttcaaggtcagccctgcactggcgcccaaggtttccaccttgagcttctatacgggagctgatgctgcgtgtctggtcgtggctctccagggacctgggatcttatctgcctttgggattccctccaagggtccctgcagctcctctgaggagcccccagcccaagcgggccccatcaggcggggcactatgagggtggggccacctcgctggtccctgcatcacctcttgactgtctgggccctacctgcttccagcgagcagtgccctggagtcgcctcctgtgacacctggcttccaggggaggggcaggggcccaggccccccgggaatggcagtggagggctggaccaccagaggccccgaccagcttgtccgaaagggtgggctgctcggagcctcctgccctgcacttggctccgttctcaaacaccccttggcacgagtgaacggctctcggtccacttcagaagaagcatcctgccggccacgcggacacgagagcctgaagcaccgatggcatttcagacctgatgcctgcgcagggacacagggacattcgggacgtgtccagctccacaccaggcccgggaacgcaggatgaggaggacagcctgggctggaggtgcaggttggggaacaggccgctgctgttggcccccacaggctttcagaccc

SEQ ID NO: 478959 - DNA, 611 bp, Homo sapiens
cagcagggagctagaagagaatggtcaaaacaaaattcaacattacgttaactcctggtaagaagtatggggcatggagttggtgaggagcacaccttcaaaagtattggtagtgttcagctctcaggcccttctgctgcaggtctgctggagtttgctgggggtccactccagaccctgtttgcctgggtatcaccagtggaggctacagaacagcaaagattgctacctactccttcctctagaagcttcgtcccagaggggcacccacaagatgccagccagagctctcctgaggcagtctataccttagcagagctcaagtgttgtgctgggagatccactgctctctttagagccagcaggcaggaatgtttaagtctgctgaagctccacccacatccgccccttccccctggtgctctgtcccagggagatgagggttttatctgtaagtccctgactgggtctgctgcctttctttcagagatgccctgcccagagaggaggaatctagacaggcggtctggctacagtggctttgctgagctacagtgggctccacccagtccaaacttccgagtggctttgtttacactatgaggggaaaa

SEQ ID NO: 478960 - DNA, 517 bp, Homo sapiens
ccactgtgtgctcggatgacgatgagctatcttctccccacttggaagcatgccttcccccaagagagcgccgggttccaccagtggcattgtagcctctgtctccctccaccatatggacctgagaacttgccttctcagcctagtcctacagagaaaggggtatcaagtgggtacagctggtcaaagggagtcactgaagatttagaaagagataaagtctatgctgggcacaactttggtgaagatcaccctggtcaagggagactaaatgaattgaaagacagcgtccagaaaatcaaccaggagatggctgcagtaagccagggtgagggagtggaaccactacaaccaaaatggtaccaaaatgatgaaagaaatgtcatcacctacacattccttcagaggggccatcctgtccttggccagcagaactgtctggcggaagagttgcacatccgtagatacttggcataaaactcacacgaagagaagatgaagaagctaataattagag

SEQ ID NO: 478961 - DNA, 799 bp, Homo sapiens
gagactggcagacggtcttctgaaccctccaccctgtgtgtccggctcgaccacactccgcttttgtttaacgaggtttgttttggaagtacttggctcagttctctctgcaagcttacgtgatccagacagacttggctcacagctcgacttagcagaaaaatgatgtaaggatgatgatgctggtaactgacagcctcaggatcagtgagacaactgggaatggtggggactggggagagatggagagcagcctcttttggactccagaattcatcagggtgactttccagagtggccctaagtatcagaacatgtggtattcatgtttgctggacagatttgacttcattgttccagaaacaagggggatgcctgggagtgatcatcttagaacatgtgaaatattagtcacgtacccatccttggcccaagatttggacctaacagccagcatgccagaaactggctgggaaaacaatcccgaatctgcttccaaacaagctaactggtgcctacagggacgaaatccagattataggccccaaccaaacccagccaacagtcagatggagatcagatgtaggcctcaagcaccttgttcctgtattggcactggcttgtttaaacttcactgtttccagagctagaaccaaccctgaactggggggtgggccatttcaatcccaggtttggaagaaggttgggtgggacaaggcatcctgaatagtatgtcacttgcagtcttccatctcattcattcccataccctgaaagtctgtgtcatttgcatctgttt

SEQ ID NO: 478962 - DNA, 984 bp, Homo sapiens
ggggcactaccggtttcgcatcttgatggtagtggtcccccgagccagctgttttctctttatctctttgaatgagtcacttctccagcaggtcagcttctccagttgcactctgtcttccttccacaggggctcttatgcagaagacgacatatgtgaacgctgtagctctccttgcagaacatgtgaaggaaacgccaccaactgccattcttgtgaaggaggccacgtcctgcaccacggagtgtgccaggaaaactgccccgagaggcacgtggctgtggagggggagcttcccacaggagagcaaggctctgctgagccaccagttgggggccgattatctgagggtggatggcaaagagctgtgggaaccagtctccctaccattcctgaaaggtatgtctctgtgcctgtcatcagagaaactgaggagtgcatgcctgagttcttcctgcacgatgatatgtgccaccagtcctgtccccgtggcttctatgcagactcgcaccactgtgtcccctgccataaagactgtctggagtgcagtggccccaaagccgacgactgcgagctctgtcttgagagttcctgggtcctctatgatggactgtgcttggaggagtgtccagcaggaacctattatgaaaagcagactaaggagtgcagagaaacacaaggactttggatccattccaatcacccagattatcctgtaatagatagtacagacacctctaaaagtcccatacctttcctgaagcactggagcagaagcagcaaggcagttgctaaggtcctgggctcaactcctgatactaattagcgcactatgtattcaaaaataaatgcaaaagggacctttatttgtcaacagacaattaaatacattccaacaattgctgtattcgtgataagctcaagcctcctttaatatgaaatgtttccacacactttctttttctttcacaatatcaatgcttt

SEQ ID NO: 478963 - DNA, 852 bp, Homo sapiens
tctcccgggtcctgcaggagcagtctgcttccttcagagagtacgtgggtcctctcaggatttctggtttgttcttgcagttgatctggagctaaaatttacaatgtgagcttccgcatgctgttctggctgctttgcgcgagattaggggcggcatgggaacctagagtgggagagattaagctgaaggaagattttgtggcttccgaggtgattgggcagtgtcagtcttcagctgctaagccgagaagatctgggaaggagtcagtcagagagccttgggccagagttccaggggttctgggagtggctgctgggagagttggacagtctgatttccaatggggtcccgcacagatgggacacggcttaggaggaatcccgggctgtgggcattccttggtctggtggccagatttctggcacttgtggcaagctcctgggggtggtgggcctggaggaacacctggccactgcagtttaggcatttggaagttcttgtgtgctggagatgtggctggggtttctctcacagtggaggcaaggaattgcaactcagaaatatgttgctacttggctgcctctactctattactgtacaccttgaaggcaaggttaattaagtcctgttatggggtttgagggctggaatgtaatttttggagttttatttaatgtcgggagtggattgggtaataaaatgtatattgagaataagatggctttttgaccttttagggtctagggctgtaaagcatctcaaggttgctgccaaaagagccatgaactgagctgggtttttatatctgataaaaaagagcctaaatgctatctgatttgggataaagaaaa

SEQ ID NO: 478964 - DNA, 841 bp, Homo sapiens
ggcggcaggcgcctaggccggcttggagcagggagccattttctttttctttttcttttttttgggggcgcgggggacggagaaggtgcgtcagacttaaggcagcccaatctcaggaggtgaactggaaaaatggataggattcagtaggtaggcgggccatgaggtctgcttacaaatcattggaattcaaaacacaggacatgtgctttattaatggcccaaagatcagcaagaggaagatgaggagcagacatggaaaaggatccctgaaggaatccacctgcttcccctgccagcccatgtggttgagtgaggctgaatgtccacttcaacttcaggagagggcatgggatccaggtctggttagtgagaggaattcctggaatttcgactggagtgaccaggaagaggcactctcatctaggcttgctaaattggaagagtttaagcttggggctgctggtggccatcttgtcatcacaaatggagaaattattggtggaaaggaaggaggagtcaaggaagacactgagatttctggcttgggcacctttgggcaagggccgaaggtggtgctgagcagaaatcacaagaggaggaaattttcaaaagaagatgaattcagcattggagaatttgtgtttgagacatttggcatatttgagggaaaatatggaataggctgtggatattctggtcttaggtcaggaaaatgagagtcgtgctagagatataaatttgaaagatgtggtataaataaagctatgattgtagataagatattttggagtcaatgtgctaggtaagaaaaaaaggcttgattataaccctgagaaac

SEQ ID NO: 478965 - DNA, 1050 bp, Homo sapiens
cacaggaaatgctgagactgggcatggctagtgctggtgatcatactaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcccccagtcctagtgccggtgatcatgctaacagcccacagtcccccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagccctccactcctagtgccggtgatcatgctaacagcccacagtcatccagtcctggtgctggtgatcacgctaacagcccacagtcatccagtcctagtactggtgttcacattaacagcccacagttgtccagtcttagtgctggtgttcacactatcagcccacagtcttccaatcctagtgttggtgtaacagcccacagtcatccagacctagtgtgggtgttcacgctaacagcccacagtcggccagtcctagtgtgggtgttcacactaacagcccacagtcgtccagtcctagtgtgggtgttcacactaaaagcccacagttgtccagtcctagtgtgggtgttcacactaaaagcccacaatgctcagaaccctagaatgtacaaaaatcccagtggtcatgtgatttttaccattttagacacagaggaaaaggaggttctgagcagtcaaggcttgcccagagtcaacaaatgagtgacagaaatgtgaataggctagacctataacttcagccccggactctccactgagagctgtttctatggtgtcataggatcac

SEQ ID NO: 478966 - DNA, 1260 bp, Homo sapiens
cacaggaaatgctgagactgggcatggctagtgctggtgatcatactaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcccccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcccccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagtcctccagtcctagtgccggtgatcatgctaacagcccacagccctccactcctagtgccggtgatcatgctaacagcccacagtcatccagtcctggtgctggtgatcacgctaacagcccacagtcatccagtcctagtactggtgttcacattaacagcccacagttgtccagtcttagtgctggtgttcacactatcagcccacagtcttccaatcctagtgttggtgtaacagcccacagtcatccagacctagtgtgggtgttcacgctaacagcccacagtcggccagtcctagtgtgggtgttcacactaacagcccacagtcgtccagtcctagtgtgggtgttcacactaaaagcccacagttgtccagtcctagtgtgggtgttcacactaaaagcccacaatgctcagaaccctagaatgtacaaaaatcccagtggtcatgtgatttttaccattttagacacagaggaaaaggaggttctgagcagtcaaggcttgcccagagtcaacaaatgagtgacagaaatgtgaataggctagacctataacttcagccccggactctccactgagagctgtttctatggtgtcataggatcac

SEQ ID NO: 478967 - DNA, 705 bp, Homo sapiens
tgaagaggaggagtgaatattcagtctgcataggcctggggtggagcctgagcttctgcatttttaacaagtctctaggggatgctgctgcatctgggctgctaactacacttggagataggaggttctggagagcagaggaaagagcatgaaccataacctaggtcctgacttccgagccaaggtttgcctttatgtggctggcaacttgcttggactcctacctcaattctttgggcccaaggtttgtcctgcctcagaaggatgtcaagaaaattgagaagagcctcccagatcagcatcttctgtttctggatactctccctttgaaaatccagatttcagcaaaaagctttgctaatggtgaaattgcacaactgaaaccctatgggagcaatgggaaagatggagaaagaggtggttatatcatgggaactctaggagaacagcagattactctaaatccccagatggagatgatggctgatgcctttttgagagcaagagagtccccaggggaagcaagggtatatcagttgctcctatttcatgccaaggatcctcagtctttagaggctcagagaaggctgaaaggctactctaggctatcagggctaccattcattgtgacccatgctacagagaagctttgagctcagtgcaaatgagtgaccagcccttgagaatcaggaaaatttatttatt

SEQ ID NO: 478968 - DNA, 710 bp, Homo sapiens
ggggctggcattgggggacagcatgttctgggcatctctgctcctttctgctggtgcctgtgcctttgctggccgacgactcatagatatcagagccacaggacggccccgcagaacccctgcgctggccctgctgggggctggctttggtgcacatgcgacccgtcatcgtggtccccatggggcatctctgctcttctcgaggcagcttgggccttcgcttgcccctacgtctgcagagctgagcacctgccgcctctccccaggaaaggcaaccaaatgccaccaacttaaggcacccactgaaggccaccaactgaaggccggttgccgtgccaacctgatcgtgtcctgcttaggaagaaccaatcaggccttgagttccctccacgcgctgcccttccatttgtgctttcagaaaaaaacattgccacgatctaaggttactctgtgatgtcaagtcatatttcttatgccatacatattcatatttatattcataattcaaaatgcacatattcaatcaaaataacaggactaaaaaggaaattttctaaaatttatacactaagtacattatatttttctaatgatcactttgatagagcaaacttagaatctatggtttcaacaaatgaagaggcttatgcaagagaaaaccaccacctaacacaagattttcaatgtgatcatcattgctacttttcact

SEQ ID NO: 478969 - DNA, 805 bp, Homo sapiens
cctaagtgaattatcatggggacagaacaccaaatgccacatgttgtcacttttagcatattcttaggatttggccactgcaaacagccagggatgccagctgtggaggcgcagtcagctccaggtgccggcatggttgccagctccctgcatggaacggccacgggtgtgtgtgggagcataggatctggccactgcgcacagccagggatgctagctgtggaagggcgggcagttccaggtgccggcatgggtgccagctccctgcaaggctgtggctggaccaggcataccataagcagcttccatggctggcacctgggaatgcagtggtgtttggaagcctggagacaccaggaactgcagagccccaaagagggtgtgacagccctggctcagagagctcccaggtctgggatcctcaaagggccgcagctgcttctctccttcttgctgcctgcaatgtggcgagcaaggggcagtttcagctttatttgtgttacagctctttcagccctgccattcggtgggttccaagttcttgtcctgccattcaggaagaatgagcctcactcccatgctcatcggtgcccaaagtccagaagaggccaagatggcagaaggctggcatgccagcactgctccgagtgtgtgaacacccgcccaggctgcaacagcatccaggtttggccccaacctcacaccaagagtggagcaggagctgagagtggggagaggccaggaagcaggagcagacacctctgagcctgtgggaatgggggcgccttctcaggactctgagaat

SEQ ID NO: 478970 - DNA, 893 bp, Homo sapiens
gagttaatgggtgcagcacaccaacatggcacatgtatacatatgtaacaatcctgcatgttgtgcacagcatcccgttatgattaaaactctcagcaaaatcagcatacaagagacataccttaatgtaataaaagccacctatgacaaacccacagccaacttaatagtgaatggggaaaggttgaaagcattccctctgagaactggaacaagacaaggatgcccattctcaccactcctcttcaacatagtactggaagtcctagccacagcaatcagacaagagaaagagataaaaggcatccaaatcggtcaagaggaaatcaaactgtccctgtttgctgacaatatgatcgtttgccttgaaaaccctaaggactcctccagaaatctcctagaactgataaaagaattcagcaaagtttctggatacaagattaatgtaaacaaatcattagctcttctatacaccaacagtgaccaagaggagaatcaaataaaaaactcaacccctttcataatagctgcaaaaaataaataaataaaatacttaggaatatacctaaccaaggaggtgaaagacctctacaaggaaagctacaaagcactggaagagaaatcatagaagacacaaacaaatggaaacacataccatgctcatggatgggtaaaatcaatattgtgaaaatatattgttgattgaagtgtggattggtacagttatcaatgacaatcagaaaatatcctctacatttagaaatttcacttgttctttgactaacaatttcacttctagaatttttaatgtttgcatatatttgaaatgcatataaagaaatatgaagttaactgtaacactctgaagagattttttaaaaaaccttgtacac

SEQ ID NO: 478971 - DNA, 752 bp, Homo sapiens
ggcaacagcaagggaatcttggttttgtcctgtaggctgcaatggtggcttaagacaggaaataatggttttagacattcggaaatatgagaaagcagatttgaaagggagcatggcccgaaagagggtaaggccagcacactgtgatgacaggactgtgcagcagcggagctattataatgataatatctcacccaggacagcagagaattggaaacaatatcatcctggtgttgccagtgctaaagcacatcataaggattctgaatacaagtatcattatattcatgttatagctgagaatgccaagacttggagatatcaagtgatctgtacaagactgcagaccagtggatccctgaaccttacaatgggtacttcagccttgcagccagcagttctcttaacagttcattgtaataaaagatcttcccagacacctgtccttatcttcaaattacataacctgagggactcaatccttttgaaaagctgaactagttcataactctaatcataaagaatctttccaaacacagataagttgatcttcaatctcttatatcctttcttccacttgatcgattcggctgttcatacttgtgtatgtttcatgaagttctcttgctgtgtttgtcagctccatcaggtcatttatgttcctctctaaactggttattctagttagcagttcttgtaaccttttatcaagtttcttaacttctttgcattgtgttagaacatgctccttt

SEQ ID NO: 478972 - DNA, 1711 bp, Homo sapiens
ctctctccggtccgtgcctcgaagatgacaaagaaaagaaggaacaacggtcgtgccaaaaagggccgcggccacgtgcagcctattcgctgcactaactgtgcccgatgtgtgcccaaggacaaggccattaagaaattggtcattcgaaacatagtggaggccacagcagtcagggacatttctgaagcaagcgtcttcgatgcctacgtgcttcccaagctgtatgtgaagctgcattactgtgtgagttgtgcaatccacagcaaagtagtcaggaatcgatctcatgaagcccgcaaggaccgaacacccccaccccgatttagacctgctggtgctgccccacgtcccccaccaaagcccttgtctcacatccaggtcacgctgatgcaagaggtgggttcccatggtcttgggcaggtccaatcctgtggctctgcagggtacagcctccctcctggctgctttcatgggctagcattgagtgtctgcggcttttccaggcatacagtgcaagctgtcagtggatctaccattgtgggatggaaccatcctcctctctatgaaattagttataatgagggctaactaggtgcaaggagggatgtttaatgggttgattccaggggatccaaggttaatgtgtaatattttcaattattttttcaaacagtagctttaattttatatttttctgaaataaaacgagagcatgtcatttatgcaagctgtaagcaccttcttaattgtagcatcaattcagagatgaataaataattgagctaagaggtctgtcagagtaaggttaatgggattttttaagtgccctgaattccatttcagaattatgaagggaattaaatatttatgttacatggataatagtattcaatattcatcaaacgcatgcaaaataagcaattaagaatatgcaactgtatcccattatgaacatatccttgatacaccttccaaacttaaattccaaattctttctgctattcagctagaagtttttgctaatattttcttcatggaaaattgtattttctgaactgattaataattaataacaaaaaaatttccattttttgaaatagcctatttcttattaattttttaatcattcgtttacccccccccccagcatatacaaagaattatatagtaattactttttaacagttaacaagtcacagtaggtttgggttataacgaacatagtgtggcttacaagataatatggaatagtggataacccatgaatatagtgagaaaactttttaaaagttatattggagtaatcccttagctaataattattattgtagtttagctatttggctatgacaaagtaatactagttgaacctcacttgaaaatatatgatagcaacttagtacatggtattgtacataccttcacttggttaaacaacctttagaggatatgcttagtgattttatatttcaactctaaattgttagttttcaacagtagcttcaatgcattattggtagattttgcaacctaggtttttcgtatgctcattttggtagaatgttttcaacactcctattttgctcacttatcctctgtaattttagaaaaataaattgcttaactaagttttgttagattatttcagtcactccattatttgaaagacttaatggttcacaaaacatttttgtttctgcatttcaga

SEQ ID NO: 478973 - DNA, 716 bp, Homo sapiens
cttcacaaatactatggacaatgcccacattgttctgcaggttgacaatgctggtcttgctgctgatgactttagagtcaagtatgagacagggacagtcatgcgccggtctgtggagagagaaatccatgggctccacaagatcattgatgacaccaatgtcacttggctgcagctgaagacacagatcgaggctttcaaggaggagctgctcttcatgaagaagaaccatgaagaggaaacatccgggcccaataacgaagagctggctcagaagaaccgagaggatctagaaaagtactggtctcagcagattgaggagagcaccacagtggtcaccatgcagtccgctgaggttggagctgccgaagtgacgctcatggaactgacacatacagtccagtccttggagatcgacctggacttgatgagaaataacaaggccaattgggagaacagcccgagggagaaggagcagctcaacaggatcctgctgcacctggagtcggagctggctggcacagacccgcgcagagggagactcagcagttaaagtatgtaatagattagagagatattaactggaaaaagaaaatcagctcactagttaccttcacctttgaattaatgtaataattttgccaacatcttaaattctatattctcaaaaatcttatttaaaagttatgtgtacatagtaggtatatatatttatg

SEQ ID NO: 478974 - DNA, 623 bp, Homo sapiens
gtcccacaaaatcggtaggggatggggctcccgcctcttccaggcccccaccggctcgaagtagagcgcagccccggctgcacttcctctgctgcagccatcgtctttgcagcagccagtccagatgagtcgtcactgccatcacttggacatcagactccagtgccaaaagaggagacacagaaatgtagaggctttcttaacagctgttcaaatgcagtgccaaaggggaaaggggaaggcctggaatggcgattatccaaaggggactgttttggtggtaatggcaaaggtgcacatgcacaagcacacacaaacacatacatacacaaacacaccagaattacaatgcaccttgattttacaccaaaggctgcgtcttcttggtttgcaaattgttcactggaatatagtgtctttcctccaaattacttctcagagaacttttgttcaccctgtgacgaaacaagtactagaaaaaatcaaggaaataaatgcataaagggcctgttagaccgcatgtttcagagtgggggtaccccaaagattccaaactgaaagtatagtatatgtgcagatgccatttgaatatttctgacaaagataagcagtgcaacgagttg

SEQ ID NO: 478975 - DNA, 503 bp, Homo sapiens
gaggggttgagaggtggcattagttttgatatcaggatgatgctggcctcacaaaatgagtcaggtccctctgctgcaactctgctggagtttgctggaggtccactccagaccctgtttgcctgggtatcaccagcagaggctgcagaacggcaaagatttctgcctgttcctcactgtggaagcttcatcccagaggggcacccaccagatgctagtcagagctctcctgtgccactggggtatggaaaacaattcctgcagctagctttgtgtctgcccaaatggccacccagttttgtgcttgaaacacaagcccctggtggtgtaggcacccgagggaatctcctggtctgtgggttgcaaagaccatgggaaacgtgtatatctgggccagggtgcacagttcctcacagcacagtccctcaaggcttcccttggctagaggaaggagttccctgaccctttgcacttcctgggtgaggcaacggccaccctgcttc

SEQ ID NO: 478976 - DNA, 2730 bp, Homo sapiens
tggctttagcccaaggtttcacagtggatcactagcaatccagagcctaaactcatcctgcgtctagcatgagtgagaaccaggatggcagtaaaattcagaaagccaaatctcattcaatttgtccaaagaaataccaagctgtccactgtgggcaatcaacttcccaggcctgagctcaaacacaggacccttagaaaactacatatgtgttggttctggagctcattggagcatctgttccaccttgtccatcacttgactggctctaaagttgatactgcagataataaaacagtgctaaatgatgtgaccaaagtcccgcaaaggtctccaaaagaattaattctatatctcaggtctttttccatacagtgctctgaccctgctaatgcatattccactgaattccagaatgtgaaaattaaattacctttgtatgaagaaaaatctaccccttcttcatggcaggtaacaccctataccaaagtgtgctgacttggtaatgatatggtaataccattcacgaaggaagaaaatacaagaggaaatatttgtgtggccaaagttttttagctcagttccaaaatactaaattttctatacctgtgtggccaccaaagaaaaagaaaaatcaggggaaaacactatcacaaaacaaaagaaggtggcagtttttgaaataaaagagccatctccatatctaaagctgcagagatcaagtaagccaagaactgctgggcacctacttattttagcaattcagagatcactgacaaccttgtcaaaatcatttcctcctgatcagagggagagctcatcttccatggtttgaagggtaaaaatggtgttctcataaaaagagtagtttttttctttcaaaagagattattagacccaatgcttttattttacatgtcgaagctgacactcaaaagcaaacctgggtagtttgctcaagagcaaatatccatgtcagagattctgattcccgttgcaatgacccatgaacattatgcattcaagcaattagaatttcatttaattaattatgctgtatttaattgtgttgactatttaaggtattcatagttacattagtttgtcagttcgaacaaaacaaaatgatgaagtgtagacatactttaataatactctatcccatatgttaacacaaacacttgaactaacagcaaaatcatctccagtagacattatatgaatttcatttactataaggaacaatgtttcatttacaattacaagtccattgcatcaactgatgttatatttaaatattataggagagccagccacggtaacatgagcctgtaatctcagctacttgggaggctgaggtaggagtatcaggtgagcccaggagttcacgtccagcctgggcaacacagggagaccgtatttcaaaaaaaaaaaaaacactaaaaataaatgggcgatcacacaacattttaaagtttttatttttctttatattccttagagtcatatgaaaccaaaacatctgtagatttatttatacttcctagatatgaataagcctactaatgggacatgggctggtcaaacttgcaatacgacactgtgacaaaagatactgtcctgcttatttcataatagtctaaataataaagattcataatcttcatattttaaatttttaccttatttttcctttgaaaatagatcatatgacttccactttattatattaatttcttttaaaaataatgatatgataaatgcaggggctagaatttttatagttttgcaaactatttgaccttctgagtatgtgtgtacatgtgtgtatgcctgtggtttttaaaatatatcttaagtcctgatacaacctcttatttaatagcaatagctttaaacacatgatagtagttgaggataaagaagttgcttccaagtaatatatctacaatttaaatatcaaatttataaatattattcaatgtaaatataccaaagcaaagtctccttagatctgttcttaccccatcagtagggactgtttcttggaaagaatttggtaaaacttactgtaataccccatatgccttcactacagaagagtcttatccctgcagaatgatacaaaattttgaagctttatccttcaaaagaattaggtgtgaacatttaaatgcactgctaccatcatttaaatttaatattcagatcctaaatggacaattatacttttgaccaagtgattaaatttcctttcagtttctctttgatggaaattttattaactgtcctcatagactccaagttctattctgtaaaataactcagtatcttttctcaactacttttttaaaattccggttagacagaaatacattaagatataattgggcattggaaaattggtgcttttattctagtttttttgacctaaaatcagacatttaaaccaaatgattaatatttaaaatgtgagaaagattgaatctttggaattaaactagattttaggtatatcatttgcataatgttctttgcctaagtcattatgaatcattttttaatatatttgaaaacttagagtgtatagcacaattatgagcacctgaaactgtctcattgcaagaggaaaatacatttttccacactttactgacatattaaatgttatccctacagaggtgttgaaatttgaaacatgtatgaatttgcaacaggtagggatatttt

SEQ ID NO: 478977 - DNA, 456 bp, Homo sapiens
tttgggtcaagtcaatggtggcgcctgcatcccatgggttgatattaagaatgatgatggcatggcccacagttggacctcattcgattggcatatgcccaccccccaaccccaccatctccacagctctactgggaataatggagtctgaaggacccaactggagggcagcgggcacagcaagtgcaaatgtcctgagtccagtgcctgcccagcacatccagggaaggaggcactggagcagagcacgctcagacaccagtgcgggtcaggtcacacacggctttgcagatggtcatgggacttctactctcagtgcactggggcagaaggtgatggcaattcggaccagggtagaagggaagtgtcagggtgtagggcatgctctgcagctggaggtcctttgagagtcttggggcccgtcaggccggcgtgggtggtctgcctgcagcctcc

SEQ ID NO: 478978 - DNA, 678 bp, Homo sapiens
gctcggagaacacagcacagccggtgaaatgggcccattactcggcgctgtggcagccacagcctctccgcagtctttgatggagtactcctcagacgcagattttattgagagcctgcctctggtggttaagtaccgagtgtacactctcaaaaagcttcaggccaaatgtgccgtgctagaggccaagtacctgagggaatttcattctgttgaggactatgagtataatgaggtggccggtgattctaatgctcagatgtatggtgcagaggagaatccggagtatgaggacttggtggaggatcgtgaggaggatttcgaggatgtcggggaggtgtttggggagtatgaaggaatcgagggacataatagtcccttcttcaatgctctccagtggggcctagatgctaatgaggatgaggaagacttcttcatcgctcacaccttgcacacttttgtcatcccaagagctgtgttacactttacaggagaagcccttgaggcagagcaagatacgatgatcagggaatgtaataatccggtttatgacagaatgactcaggagaattgggtgactgcagtttatggtgctaaaggccaaaaccgaaactcccaggcagaagtcaatgattgttgaagcagaatggttggaggtacatgtgcacaatgtgcagg

SEQ ID NO: 478979 - DNA, 1148 bp, Homo sapiens
ggtacctcagttggaaatgcagaaatcacccgtcttctgcgtcactcatgctgcgagctgtagaggtaggaagaagtgtcttccgctatgccattgctgaaagcaatgtgcccactagtgtcatcttgttgcttttggagagggtttcagaggtccggaatttaaaaaaggagcttaagccattactggatgacccttatggagtagcagatcaaattgatcaatttttaaggcctgacataggcacttgggctgagttgatgtccatcaggggcatcctcttttcaggggaagaacgaagtatgattcggagggctgctgtggcagtctgggaacgtgagcaccctccgggtcaaaatgttcctcctgtggaccatgaatttcccgcccacgaccctcagtgggacaataacaatgcaaatcactgggaaaacatgcaggatctaagggaggcatgccccttggctgaggatagccgagatacatttgcttttgagtcagaagacccctattcggggcagagacaacaatatcgatggacagtcttgccccaggggttcacagactcccccaacctctttggtcagatcctagaacaagtactagagaaagttacagtccctaaacaaatacgtctgcttcagtgcatggatgatcttcttatatctggtaaagacataaaaggagtaggtgacttctctacacacattctcaatcacttgcaatgtgagagtttgcgggtctcaaaagggaaacttcagtatgtagaacctgaagttaaatacttaggccacctaatcagtgcagaaggtcatcttgtcatcgatgtaactcaggctagtcatcctttaacccttcagtttgatgtctgttcagccaccccgtgtggagatgagcaagctcaaaagaagctattccatgttgataagtatcgatgtccataccatgaagaatccagcagatgcccaggcactcctcaggaccaagtgttatcagtaccagctcacattcttttccttatttggaaagaggactaactttctagctcattacaaacaccccttccccttcctcaccactttcttttacgtgtccaccctatctaaaaaaaaaaaaaaaaaaaaaaaaaatcaactgtttagccaacc

SEQ ID NO: 478980 - DNA, 577 bp, Homo sapiens
ttaagacttctccactatagtttctagagctctccagagagaagctgcaggtttctagtgaggatgtgtgttcaagggtggacaatccccctttcactctttcacactttgggcactcacagatttctggctgtcttgcagtgcctgcaggagcaatctgctttcttcaaagggtttgtggattctctcagctttcctgggcaactgcagtttgctggaattgtggataacgcactcaacgtctttgttccttcttcagtccgagagtggcaaggacagtaccactgcagtggcagtggcagagggctttcagttatctctggtagctccatcttagagaaaaacagagacactgctactggaaatgtgcagccaccgagtggagcagattctctggtggcccaagctggggaccaaagtcggcaggagcagaactttggttatggcagtggttggtgggagtggggggcgttgtcagttgcctctgggatccccacatcagggaaacatagagccactaccagtgggtatgctcagtaagaagtgaggtgactgttctgtggtcccaagctgggga

SEQ ID NO: 478981 - DNA, 606 bp, Homo sapiens
gacatcaaagacaaaaggtagataaatccagaaagatggggagaaaccagtacaaaaaggctgaaaatttcaaatgccagaacatctcttctcctccaaaggatcacaactcctcggcaacaagggaacaaaactggatggagaatgagtttgatgaattgacagaagtaggcttcagaaggtgggtaataacaaactcctctgagctaaaggagcatgttctaacccaatgcaaggaagctaagaactttgaaaaaatgttagaagaattgctaattaaagtaaccagtgtaaagaagaacataaatgacctgatggagctgaaaaacacatcacaagaacttccgattggagatcaacttaatgaaatcaagagagaagacaaaattagggaaaaaagaataagaaggaatgaacaaagtctacaagaaatatgggattatgtgaaaagaccaaatctacatttgattggtgtgcctgaaagtgatgagaagaatggaaccaagttggaaaacactcttcaggatattatccaggagaacttccccaacctagcaagatggccaatattcaaattcaggaaatacagagaacaccactaagata

SEQ ID NO: 478982 - DNA, 1088 bp, Homo sapiens
ttttccgttcttgcattagtttgctgaaaataatggcttccaactccattcatgtccctgcaaaggacatgatcttttttccttctaatagtcagacccctaagctgcaggtctactggagtttgctggaggttcactccagaatctctttgcctggttatcaccatcagcgtccacagaacagcaaagattgctgccttctttttcctctggaagcttcatcccagagaggcacctaccagatgccagccagagctctcctgtatgaggtgtctgtcagtttctgctgtgatctgtcccagggagatgggggttttatctataagcccctgaatggggctgctgccttttttcagagatgccctgcccatagaggaggaatcaggagaggcagtctggccacattggctttgctgagctgtggagggctccacccagttgcaacgtccccacagtaagtgttttgtagaatacttgggattttccacatagacaattatgacatttgaaatagggacagtttaatttctttcttttctaaaagcatgccttaaattatttcatactttattgcactggctagaacttccagtaatatcaattataagagtggtgagagcagacacctttccttattcccaatcttgaagggaaaatatttactctttaaccataaagtatgtggttagctgtagaccttttatagattctcttcattaagttatggaatatttctgttattcctagtttgctgagcattttatcatgtgtgagtcctccattttgtcaaattatttttgtgttacttgatatgaatatatatttttcttctttagcttattgatatagtggattacattggttaattttcaaatactgaatgacaattttatacttgaaataaatcttacttgctatgatttataatcttttaaatacattgtttgctttgatttgttaatattttgttaacaattttttgtctaaattcatgacacatattgatatgtagttttattttttaaaatttgtactgtctgcctgattttagtatcatagcagcatttatcagggcaaattcagccccc

SEQ ID NO: 478983 - DNA, 591 bp, Homo sapiens
acagtgacatctgaatgtgttcagggtttttttgttttttttttttttggcatggctgacacctggctctacctggacccgggtggacccacctggaccagaccactcctgtgggcctgcttaagagtgattcagctcaagaggaccactttgacccatcatgatttcatctccaaaccaaccaatcagcagcaagcacgcatttcctacctaccaccaccccatcacccaaactgcctttgaaaaaccgccaaccaaaagagtctttgatgagattgatttgaataataactccatctcctacatgacatggcaatacgaagtccaaagaatctggagttccaatgtccaagagcaagagaagaaggttgtctccactccagaagaaagtgagcaaatttgtctttcctctgtgtttttgttctatccaggatctcaacagattagatgttcctgttcccattggatgacagtggatagtattagctcagtctaccgattcaaataccagtctcttctgggaacaccctcacagacactcccagaaataatgcttcaccagctatctcgataacctttaattcagttgaa

SEQ ID NO: 478984 - DNA, 525 bp, Homo sapiens
tcacgtaatttctgatgtgtgcctcaagatgcatgaccacacgactctgatggtgatcagagaggcaggtgtgagaaatcattgtgcaggtacaggtcgtggcacacatggccttgaccacgttagaaccaagcagcttgggaggtggaccaggcagttccctggaagtagcttaatgctggcttcattgagaacctgcatctatcaaggaactttgggactcaaccctggaagaagattctcacagcatattccagaacttctaacagataaagtgcaagaagtggtagcccttgggctgaacccattacccttgatagttgcagttctgcatcctgctgcaaaaccaattaaactagaacctttggggaagtggggagagtttgctggtcggagtatcttcaaacctccaaaaagcccaatacagaggatataattttaattaagagaaagtttgctcatttttgcatacatcattaaaccctgctatttccttttctgtcacttgcctgataaaacttttgg

SEQ ID NO: 478985 - DNA, 569 bp, Homo sapiens
tgttgcacgtcttgccaggggatgcagggaactctccaccgtacaatgataactttgacacaaaagtgtggtgctgtttgggggttttgtttgggtggaggaaacaaaccagcaggcttcccagatagcatcaaggagctgaaactcgccagatcaccacaattggacaatgagatgccagacccttcaggaatagactttgcctatactgtgactatacgactctcctcccatcaccacacacacagtgacccatcgagaggtgtatatggaaaaaaaaccttcatcctacagctctataagaacttgtgtcaaaaaacaaatccctatatgacagttgtttttgcagacacacacatacgaaagacttgtttccatggtgtctgtgaacagatagtgcctgtagtcatagcaggaggaatcgaggttgccaaaatgcagagtttgccactgggcattccgctgagtgataaaaacaccccccaaaggctcacatcaggtcaggcagcatcctcccttaatggtgagagggaagcagtggaactctgtctgcactgcctatgaaacat

SEQ ID NO: 478986 - DNA, 854 bp, Homo sapiens
agtgccagacctttggtgaggtccagtttgtcaactgataagacaatgatgaaattcagatataatagggattctaattggaaagaatctgaaaatttagctcctacacacgtgggattttcacagaatactctacaggaaaaaaagcaaaatcatcaaataaatacaacccaggttccaagaaataatggattcaattcaggaaacagtgaagagtttcacagacagactgttccccacttaccccaagtggataagaacatgaaaatggacctattattgacttcacttgagctcctgtgtccctccactacagcactgatgatgtttcctggagtgatttttcaaactacttctaaaagagatgccttgactcaggacagttttctgggaaaactaaactatgacttttccacaaaattcttacttttctatattaccattgacgaaaataaacatctctctttgatttaagcatgctttgtagaaaatttttagaaatattctatatctgactcattcatgtaagcagcaaaatattgctttgtgttctttctgatttctccaaattttagttaggaacatgggaaatagtggtttctaactttagggagatgcattcagtaaaataatcataaatttaaaatgaaaaagcatgaacaagtacctatttgcaatctcagcacacaaatattaattttttatgcaagaacactcaaattgtttatgaataagttttaacactgaaaacatcatttatatatatttatatacattatattttatatattatatattaatatatattatttatataaatatgttgtataaaatataagtattcatatatattt

SEQ ID NO: 478987 - DNA, 528 bp, Homo sapiens
tatagagccctgacatctacgtcattgtaacatttcttattatgccggcgttcaactgctgggtgcaattgacaagtgatgatgatggtgataatggtgatgatggttatgatgaagatgatgataatggtagtgatgatgatgatgaatatgataatgatgttggtgatgagggtgttgaccatgatgatggcgaggtgatgaagattatgatggtgatgaagaaaatgatgatgataattcttcacagaactgctcatgaacttcaagatctcaacagagagaattgtgcagagaaagaagatgggcagaggggagaaggagcccctgggaacacttctgaatttgtagtgatgatgtacatcgccaaatgtgcaatggatgttttatctcataattatgttacaagaaaggggtcctggtccagaccccaagagagggttgttgaatgtcacgcacgaaagaattcagggcgagtccacagtgcaaagcaaaagcaagtttattgagagtaaagtggtgaaagta

SEQ ID NO: 478988 - DNA, 759 bp, Homo sapiens
gctgattcatctgagcacgagagctaaccacctcttctgtgtcttgttagaaattctaaagttaagacagacatgcatgaattgtatcagtcatgaagaacacctggacaaagggaagacccatggaccctggcatgaactgtcaacaatgaaagtattacctaacaatgaaatcactgtctacagatttgattttgccaaggaaaaacagactcagcgacagagggttgtgtgcagaaagctttctggagagtgtttttgggaaatacaagtgcaactaaaaaagaaagaaagtcagattggactgaaggagaagctgtcctgcaatatggttgcaacagagacatcagcctacctggagacgtgggccgtggcttttcctctccctgatggattagagcaagaagtacaacaaagaaaaggggtagcaatttattttaaaatccaaaattacaacaaactttccataaccaaatgggctggtaagacagattagagttccaggagggtctgcgccagagacagcagcaaacatttctgtaaaatcaaattatcttcttctgataaatcccctcaaaggttcagactgctcaaaaaaaactgattttaagagggcatagaatagttttattaatgttataatttcatacttaaaaggtagcattaaaataatttctggtttacttttttaaaaagagcagttttttctgccagtccacaaatttaggaagaagatggttaaatttcaatctggtcttc

SEQ ID NO: 478989 - DNA, 1182 bp, Homo sapiens
tgttagtccaggtcagaggactaaaatcatgctggaagagaaccgtgtgagcccaaacatgcagaggcattgtagaaataaggagaaaaagggttcgtccaagctgatcaatgaaattcaggtgctcagtgatccaggattctttcattttgagctctgtgtggaaagagatggacaaaaaggagtggggaatcttggtttatttataagtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacatgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgt

SEQ ID NO: 478990 - DNA, 973 bp, Homo sapiens
aaaccacaaaaacacatgtgcatcatgttacctcaaccagatgtgcacttgaacaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactgggaggctgaggcagagggatcacttgagctcaggaggtcaaggctgcagtgggccatgtttgcaccactgcactccaacctgggtgacagaccgaaacctttatctttaaaaaaaaaaaaaaaaaaaaaaaaaaaaagcac

SEQ ID NO: 478991 - DNA, 979 bp, Homo sapiens
ttcccttctcctctctctgggtcttcattcatattggctccaggaaacgaaagaaggggagtttgggagataaggcgcaggtgggagggcagagatctaactgcggaaaagctcagacacagccgaaaaactggacctagtaatgttagaagacaccagagttgaatcacagctcgcagccacccctcactcaagccttcactggagctggcatctctcctctcctgtgtttagtgacaaaaaatgtggcccttctgctgcctggcaaagagtttgccttgactacattcagcacctcatcagctgtccttccatctgtgcctgccacctagaagttgaaacggaagagaagttgaaaccgggagttgcatatctactcaggtgtcatggacatcttaaactcaacattgtctattccaaagccaacctttcatcttcctcatcatacttatccttgctgtgtgtttctgtcagcactgccaagttctgggcaccaagtggacggagcccgcggcatctgccacagagctataagaacccaggcagcaatatgtccttgtggagtggaaagacaaatccaggagagcaggatagattccataccaaccccaaccaccaccagtgcccttctcaacttcctattacattgagaaacagaacagaagcacaggatggaatattttcaatcacagagctttgttggaaggaagattccaggtgaattaacttgtccattttttgcaaaatggcatttggaattttgataggcattggactgaattcatagatcaatttgcagtgtattgctatctaaataatattaagtatatcaataatgaacacaggatgtctttccatttatttaggtttccttaatatctttcaaaaatattttttagttttcagtttatgtgtcttgcatttccttattttaattcatttaagtttaaaaacctaataaagtaaatagtttataacc

SEQ ID NO: 478992 - DNA, 613 bp, Homo sapiens
tgtccctgcctcctgccagctccatggagcatggcgccaccctgggctcagctccacctcctccctgtgccctccctacagcagcagtgggcaagagtggtgacacaggacaaggttctggagcagcagaggctccagacctggaagcaggtcttgcctggccacatgagggtaggggtggtgcaatccatgctgccatcagcctttccacctttgtctgaggagataaaccctgcgctgcctgaggcaacagtgatggcctcctctgaggcagtggccaggcaagataatgttgattctcctcaggagccacccccaacagccctgtttgcttctagacctatagctagactaaagtccctgtggacccctagagccataaagtgggtcatgcacagcagcattccatcatcaaatggaagtggtgtattcattaaccaggatcgaatgggtcctgatggcacaaatgtgcaattatacactgattcatgggctgtagccagtggtttggctggatggtcagggacttgcaagaagcatgattggaaaattagtgacaaagaaattcggggaagaggagcttgacaaagggtacatgcgcacaatgtgcagg

SEQ ID NO: 478993 - DNA, 3163 bp, Homo sapiens
aggcatagagtgagggagagagtgggggaggcattagtggagcccactcaatcgatagtatttttttacagcagctggaaaagactaaggcacttaggtttcagtcttctctggaccatttatgtttgggtgtcctgagcaagccactgaatctctctggacttctgctgtcacctgttcagttggccaccaaaggatctcattctccactgctgctgctgccagttgttaccctaaagctgaacactcagagaaatctggaacaaatgtcaatgcaaagccacgacaactgttctgggcactgatttctcctggtgttaggtcaagagagactttagcacctacctcagggccagacctccccgagttatttgctccaaaacttgatacagtcctctccttagccatcactcctccccacccaccagctgcaggcagcctgcagagcttaaagaaggcaaaaataattgtcccaaatacattttccagacctaggatttttagctcatgtggggcaccagaatttcaatctaaatcttaaaaaattttagggcaatcatttttcttcctccttgaaagccacagacaatgatgtgcactatttaccccataagaagaacacgtattaaccagggcacagcttctcagtgtctccaaaaagccttatttgtttaagagattcatctttgacagtttaacaaataataataatgttagtcaatattattagtagatatagtactttcacctctagaaacagaaattgaccgcaaccttccaaatggtagctcttctaaaaaaggttttttaaattaaagttactttacattgggcaacttgctacacatgtatgtttagaacttcagtaaataagtacattaaattattgaaatatctctaattaataacagctaacatttattgatgttagcatacactacgctaagcactttatttaatcctcatggcaaatctataagattgatacagttatcatcatccccattttacagagaaggatattgagacataaaaggtgtaattgtccttggtcacatggtgaggacgtagaacatgctcaagctaaataattaatattctagctgatttttgttgttttgttttgtttttgtcagtattcttgttatcttctttttgcctgttttacgtaataaaaactttcatatttggtctaatcatttatcttctaacagaactttgattaattctgtaaactccaaatttagcttgacagttacttgtgagaaaatgtcagtgtgacatcgtggtaggccttaggggacaaattccaataattcagaacactatggtggaatcttttcttcctgtttgctggaaaaggcaagctcagggagccaaatccctcatccagataattagcaactatccaatctgttaattgaggacaaatatgccaaaccttcttggcaacttcagtcaaacagctgtagggtggtcagtcaggcaggcacagtttgatttgaactcgtaatggaaaaaaggaactggcattgaaaataggaaggcaagttcagggttaaaaatggcctaaaagagagcagaattcttgcctgccaattgtgaaaaaagcaattatataactctgtgtacattggacaaagacccattatgaaggaatgtgcatgtgagcctttcaaaattaaggtcagttttagtgagctgtaacttgctagtaaaaccatgtttgtcaaacatgtgaaaagtgagtaagatgctgccacaacttatgtgcatgtgaatacctcaactgtaacacatttgaaggatttttagtgtgttgttaactactttacagttttaaaaaaatagtacttgacatttggaagtgaaatgatatgtgcaaaacattagtcagatggtgcttcttgctttgtgaatgaactgtatgtagtctgaacaaattagatccaaggtttagtgccatcaactcctcagtcagaggcccacaaacaattatgctcccaaaacacctgatattttaactgcaaaaaccaccaaatttataaagttgctgatgatgcattggtaacaagagacagcttactaagtgaaagaaagaaaaaaatctcaagagaaggaaataatctatactgcaatggtaagactagctagaatataagcttcaacctcccacacgtcctgtcttgttcatggtggtactttcagcacacagtaggtgcacaataaatgctgatggctctagagttaaaatgcctgcttaaatcccggctatagcatgcatcagctgtcagaccttggtgagttactaggctctgagggtttgctgttcacattatgactgccttggaaggctgtggtgaaaataaaatggtatcatgcacatttgtgcatttgtagcacattgtgaatcctccataaatggttgcttttgtgatgaagataataatttgggtttatctgggtcctttgtttgaaaaaaaagtccacatctttcacacctacagccttcccactaggggaaaaattagtagtttaattttacctttactacatagagttgaagatatactcattttttctggctaagattttacaatgtaaagttcaggaaatggagtttgattgaaattctttttgaacactgacactttgaaaatgcatagactacaatgacattatgaaatgatataataatatctgtaatttctattcatctaaaataatggtgaaatcccactgttaaattatacatcatgactaattctagacagcaaattatcaagtatttattgagcaaaggtgacctttcctgacacaggtgtcgagttatgaagtttagctatttgagtacaatccctcccctctctccaattgttttgttctaaaatggtatcatgcttttttttgccaaaaaaattataatactcaataaatatttagtgaataaattaataaaaatgttctacctccatgaaatattttataattaacatctttttaaattgtattcaacaggtatttagggggcatcttctaagtccaagtctccactggagacactggatcatgcatgtgacatgatcctggaactgcatttagtctaggctcttctcacatatatcagtcctcagagcctcacaagaccttccgaaggctttgg

SEQ ID NO: 478994 - DNA, 745 bp, Homo sapiens
cgtggcggccctgccgggaggagcgaggaaacgagtggaaacccgaaagtgtgctcatggaatgcaggaggtaatgaatcctggtcaggttgcaaacacaccaaatgacgtccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttcaaccgccaagctccttgggacaaaaagagaacttcaggggctctgcctcaaactgtccttcgagggtggctcgaggatcgggttgtcccctgtatggcagcaggcatgtgggttcacacgcagctgccaggcttgtaagaggcaccccgcagccgcaccaaacccgaagcatccgcgaaagcgccccggttttaaaccccaaagagctgctcgcttcctcacgcagcagggaaactctgctcgctttccctgaggttagatttgtgttaaattctactaatttttctaaattactcgtcttaacaaatccaggagactgtttcttaactattgcaaaattatcaagtatactagaatgtgtgtgtgaattttccttctttctcttctccacttttctctactgtaggcagtacagaagtacagatttgagagctctgaaagagaaatgaatgggttgggaagg

SEQ ID NO: 478995 - DNA, 870 bp, Homo sapiens
agcggtgggctgaagggctcctcaagtgccgccaaagtgggagcccaggcagagaaggcgccgagcgagcgagggcttgccttctcggccttggcgtccactctggcagcgctcgaggagcccttcagcccaccgctgcgctgtgggcgctcctctctggggctagccgacaccggatccggctccctttgcttgggaggaggtatggagagagagacgccagcgggaaccgcggctgcgggcggcgcttgtgagccggcacctactgggtttgatcagaggctgggtcctgcgtggatctccgttctctcttcacggggtcgctagccacaatggagagtctccgtctgtttctcctttcttttctttccctcttggttgtctgggacgagctctcagctgctggagtgcctgggctaggtgccgcaaagctccctgccatggcttatggtcccaagaagcatctaaagcaggagatgaagaagagttgcatgcagcagttcattaagatcgatggcaaggtccgaactgacaaaacctaccctgctggattcatggatgtcatcagcattgacaagatgggagagaatttttgtctgatctatgacaccaagggtcactttgctttacattgtattacacctgaggaagccaagtacaagttgtgcaaagtgagaaaaatctttgtgggcacaaaaggaatccctcatgtggtgactcatgatgctcacaccatctgctaccctgatcccctcatcaaggtgaatgataccattcgtattgatttggagactggcaagattacttgatttcatcaagttacactggtaacctgtgtatggtgactgaaggtgctaacctgtgaagaat

SEQ ID NO: 478996 - DNA, 940 bp, Homo sapiens
caccgcaaggttatttgttttccttcttgccaggcccctgccatgaagaagagccattccattcttccccatggaggatccagatgtgttgcagcagggacaggccattcccactgcatcctgcctgaattctcgcctcacagaatccatgagcatagtagaagggtgttgcttcgtggcaccaagactggggtggcttgctatgtagcaatagataatagggctgaaaatctgtgcaatgtgtgcatgtgcatgcatttggggatgcattggaatgtggggtgtgagagagaaatcaaggaggactccaagatccctggcttgagaaacgggaaggagagagtcatgatcagccaaaatggagaaggctatggaaggatcaggtttgggattgggatagaccaggaaatagaagagatattggtaaaaaggggagatatttgactaccatttcaatatttttaatatttatttgttggttcaagttgattcatatgtctgttcaagtccaattccccttgcacaaattttggcattttatattttcctacacatttttaatttattttttaatttttttatcctatacagtttttatatagattcttaaacttgttagcatctagctcttcctaacagtcttttattattattaatttcgatctcttttaattagatttttccaagaacaaacttttggttttgttcattttctccacttttttccttcattatgtcattgattagtgggtttattgtttctttacttatttggggggatttgcgctgttttattctttttattttttaatttcttgataaataaatctgtttatttgatgcgataaatttctcactaactgttgttcttggctatgcccatagttttgacaagtactgtttccattctcatttacttctaaaatacttcttcagtaca

SEQ ID NO: 478997 - DNA, 600 bp, Homo sapiens
tccaactgggtccatgctcttctccttagcaaaagatgtgttttccttgaagatctgggctccaatcctggccccgtccctcatctgtgaaagcagtcacagaatccaccttgcagggctggtgagggaacagtgtgagatggaagcccgtgtgggtgccagtgggtatccattcccattgcttccccaaaaaccacagccttctgctgtgcccccactccccagaggctctgatgggctgcacctggtccgggaggtctcctcctcctgcccttctgtgccttccttagctccatgctgcatcctccttgccttccccagggacctacactcgccaggtgccaggctgtgtgctggcaccggagctctgggctgggtgcagacagtgatctctgccctgaggagctcccagtcttcccagtctgatggaagaagcagccacgaaggcccagcatcaccatgcaggggtgaagcaatgctgggcaggcacactggctcttccaggcaccccattctctctggtggttctgacccccaggcctgcctgcccaccctgactctatctctggccagaccacacttctgagcatcagtcatgtt

SEQ ID NO: 478998 - DNA, 561 bp, Homo sapiens
gctaggcacttcaaatgcctgattgctccgaatcgccacaaaactctcggggagctggaattgctttgaccacaaagacaccgaggctcagggaagggagacagcgaggaggccagtgtggacacccggtggaagtgacaacacagggaggtgacacaggaaggaatgaaatgcctgaagccagtgttaaggagccagctccaaggaccaggggcagatgggatgctgtagatgggatggaaagagcccagggcaacacacgggactcagccccaagccccggggaggatggtggagaacaggaagaacaggcttacgggaagactggaggtatggattttggggaggaccgcagagctaagccgccatttcgtcccatcatctcatggccacatgctgtccctgtcaaggccatgccctgggcaaaagcttagagaaggggaggagctaggcttggctgcccaccgcccttgctgtgccttcaggcctcctccctggctgctcactccttttgtctgtgtacatagagctccatgtttctccaggccccacgttcctctc

SEQ ID NO: 478999 - DNA, 572 bp, Homo sapiens
tacttgaatgactcccaggcatcatgggaagcagaaattggaaagccttcagaactgggagctgtccagctgtctgcccatcccccaccaccacactcctactcccctccaggcatggaagtttcttctttctatcaacatattgtagcataattcttaaagaaacttttactttaaatcacttttattgtaagcctagaaaagaaacaggaccaggagatgaacctagtgttgacaagaagctggatataaagttgaatgtcaacagaccttttcttcaaggagcacagtacatcggatacatccatggaagctccattaaaagacggagtttcactcttgtggcacagggggctaagaaaggctttctcaaggagacacttgagcagggagagaacttgtatggtggaaagggtcagaagtactgatctcagttccactctgtcacttagtagcagaccttgtacataccttgattgggactgagcacattgtcttcagaataaaatcaggcttctattggtgtagaaggaagtaagccaatggatggcaggccaacaactggtcatgtc

SEQ ID NO: 479000 - DNA, 740 bp, Homo sapiens
gccagcagttctacctactacgtaagcccccctcctccctgtgcaagttcccacagaggccgccatgtatatgcctgaaaaggggaggaaaattttacctgggagcttgccaattacacaaagaacagaaggcatcggtgctggaccctgcatgcttatctgttcagggcttatctatgccccctggccccctcaacccctgtccacctgtcaagaagaggccatcctgggcagcacattagaggcaaatggcccagatgcccagctgagggcaaacctccattcctggaggaggaggtcgcctctgggagcaggaggacctgctggaacccctgctcacaggctccttttcttgctctccagcacctcctgcaggcaggcaaacacctccagcagcagtagcggcagggccttcagcagcagggctgctgctctgctgaatgagagaagtccctctccagctggtcctgtgcagtcccagggcagcggcaggagggctctggagcttcctctagctccagcgctgtccctggaaggggctctgcccctggtgctggcactggctcaacagctggcactggaaatagctgtgtttctgcacctgaagcaggagctgcaaaaggagagaggtcaccaatatcactcactttccactggaatttccaaacatgaaaacaacctcactgaatttaaaggaatttcagcctgaaaacattgtccctggaaagacttccagactg

SEQ ID NO: 479001 - DNA, 562 bp, Homo sapiens
gtttctgtgagctgatttttcctggatgccaaacaagagctcaggagtgagtgtggatacaaaaaggcatgctgagctgctaacacttcagctgtctgaagatggcagagctaaaggagcactgtaatatgcccactggggcttcaggaatcacaggcaccccccctaaccccaggggctgctatggggcccacatggagtttgctcctgccaacaccccaaagctctcttcctggctcctatacctgctcacctgcatgctctctcctgcaagaggtggaacacagcagtgtgcatgcccagcaggacagaggaaagccatccctgatcctacctcacaggggacctcacagaagtcagccagtgttgactgcttggaaccaagctgctgtgagtgggaggctgcaggtgcaagacttgctttgccaagtgtgtgggagctgagtggggctaactgctgcctgctgctccctattcctcatacagatgcttctctgcagaagaggcagctgtggtactccctgcaacattactcctacagccagaggaccactatctgatc

SEQ ID NO: 479002 - DNA, 534 bp, Homo sapiens
tatgactaaacacaaccaaaaaggaaagctagaaagattatattagacacttacgtgtatggatcattatggccaccattgtaaaatggcagaggccaaaagaaagtattatcaattggttacaaggtcaagctcctaaggacataaaacaagatgaagaactgcagcaaggtttgttactgaccagtttgccaggctggcttgatcagcaaacttttggggtcctaggcctgcattctatcctaagtttaagggatgcatacaaagggagtgtcctgtggtacagcgacacaaggacccacccacaaagagaggacagaggaggaaaaaggagaaaggagatgttttttcagaagagtcctagtgattcaggaggcaatcaagagaaatatgggctgcagatgattggttactcacctaagaagaggggagcaaggcatccctagtttcttctttttcctagtaaatacctgagtgttttctttacctggttgaataattcagatttcaggccagtaggggtggtgtccctga

SEQ ID NO: 479003 - DNA, 476 bp, Homo sapiens
ctctggaactgcttacatgcagatgaggaggcctgaagactctctggcatatgaacagatgctttgggcttcctcaagttcctttccgactcctcagaggtcgcccccagaaccttccctgggaagctttccatgcccctggatagattttctggagcttcaccttctgtgtctccttgctgctttcacctgtggacatggaggactgccagggcctgggcttgcccttggcctgacttgtccctggagattcatcctgaagctgcatcagatccagagactcttggatccttccaggttgccccatgtgttgctccagttgtctccagagttcaggactgactggaaagttctcaggcagaatggatgtcaagctttcctggggaaggttaggagtggagacactaaagacgtcctgagatttttggaccctagaggttgcttcctcaacaaaggccattcagggtgctgagttt

SEQ ID NO: 479004 - DNA, 1723 bp, Homo sapiens
gggttttgacaaatgcataatgttagggatacctatgacttacaggaatgctgccactgtctgtacagaggtggaggggccctgtcttttgtacaatctagggcccagtggggacattgccagtaaggatgcagtcatccttaatagccctggaatggctgtctacaggtgttcccttggcatgctgcactctgccttttccttggaacagcatgccctgagggtcagaccctcagctctcctgggtccagctggccccatgtgggtgccacaatctcagtgggtgctgagggatgtctgcaggggatttggtgatgtggagacacaagaactgagattccctgggcaggatagagtcccaaaatgggtgcacacccagtgtggtgcccgctaccatagctcaaatttgggggttgctgacagcccagtgcagtgccctcaagaaattcccaaattgccgcccacaccgatgcataagcttgtgagggcagaggagctcttcaacagtttggaaactagcaatctgtcacaggggtgagggcaacccaaaacatccccacttaccctttccatgggaccccaagtccttcaggattcaatttctgccaaattcttgcctcctccttttttctgtgccctagcttctgcttgtgaattttccaataggccttcacactcgtctcttaatcttttgagttatgatttttcacctctaactttggttcttcttttttggggagattgggtgatcagtgtctccagtcagccatcttgaagctgccctaaaagttttacattttaactgagtccaacttatgcttttgatgtgttgatgtttgttgatttttatcaccaaactgaagattacctaaattttccctcatgttatctcctagaagttttattgtttacatgtgagtcaatgatttattttgacttaaaatttgtgaacagtgtgtggtctatgtctatactcatttttttgcatgtgaatgtctagtttttccagcaccatttgtcaaaaagattatcctttctccattggactgactttgcttctttgtcaaatatcaattgactgtatttgtgtgggtttctttctggtccctctattttgttccactgatcaatttgtttattcttttgccagtaccatactgccttgatcactttggttttatattaagtcttaaagtcaggtaatatcagtcatctgagtttgtttttcttcagtattgtgttagctactctgggtttttgcctttccatataaactttaaaaaaagtttgctgatatccacaaagtaactagctcaggttttgacttgggttgcacttaacctatagatcaatttgggaagacctgaaatcttaacagtattgagtcttcctatccatgaacatggaatagctctccatttatttagttctttgatttctttcaccagagtcttgtagttttcctcataaagatcttgtgcatattttgttagatttatacctaaatatttctttttaagttatcaattttaatggctgtaaaagtgcttaaaatgaaaaaattcaagatgcaatatttacaaccatcaatcttttgtgggcaggccacctgttatctatttgtggcttaccaaagtgttataacccattggttaggcatattttttggtaaagaatatcagttactatcactgagcgtgagacactaattaatctcacccat

SEQ ID NO: 479005 - DNA, 622 bp, Homo sapiens
gggcctctggcttcatcacatcatagtgagggggtgtttgaaggatggctaggagttcaacaggatctgttgaaaaattcctttgtaagaatgtctctaaagatgtggagacagaaaataagagcagcacgccctccacagccgtggagaggggcattccccacaagctaacaccgccctcccatctcatttacccctgctttccctttgatcagatcctccgttattccctgacaacattctatacttcccaaggctgttcctttgcccccggtgtctccttcaccaatgtacacgtttcccctatctttaccagtctcataagtcaaaggaagatttatgaccataaacaaaacacttctgatgtggtgccaatgtcggtggattggtctgaacttcacctgatacttgtcaaagattccagtttttgtgacagtgtcagggtggaatttgaagctaataattaactccctgggttaacaagactgaatggctggaagcagcacacttgtgtctcagacccgatgcagcagtgtttgagacactgggcatggcattttttatagtgagagggactcctgtgcttgcatcctgcagatgaggccaaatgtttagagctacc

SEQ ID NO: 479006 - DNA, 2620 bp, Homo sapiens
ctggagaactgacactatccaacttcaagatgtgctataaagctacagcaatgtatgctggcacctgtgttggcagttatgggcaaattgattcttgggccttcaggtggttttctcagatgctggtagtgacatcagtggaccaggcaggtgggaaggttcctgggcccctgggcagtcaatgtggtatgggaaacggcatctcagtagcaactgcccaggtttctgtaatgcctttgtttcggcactactgggacccaggacagcatgcagtctgccaaaggctaggtttgaaaatggtgacttgctgtagacacttgggtcttagaaagggtgtgggacccagtgcaagccccatccctggagcacttctgtcccatggcagcttcctatgttactatgaggccaaaagtacgattcataagagaaaaaaaattgataagtggaacttcatcaaaattaaaaacttctgctctaaaaaagactattgcagagagaattttaaaaagaagctacactagagaagatattcataaaatacatatctaataaaggaattatacccaaaatacataaaaactcttaaaactcaacaatttaaaaaatccaactaaaagtgaagaaaagatatgaacagacatctccctaaaaagaatattgaattgcaaataagcacaagaaaaaatgttcaacatcatatgtcattaggggattgcaaattaaaatgacaatgagatactactacatatgtattagaatggctaaaatccaaaactctgacgatatcaaatgctagtgagtatgttgagcacaagagcttttatttattgctggtgggaatgcaacaggatacagtaactttggaagaaagcctggtagtttcttacaaaggtaaccatgcacttactataaaatccagcaatcatgcttcttggtatttacccaaattatttgaaaacttatgtccacacatgaacctgcatacaaatgtttagagcagctttattcataattgccaaaacacgaatgcaaccaacatattcttcagtaggtgaatacataaacaaactgtgatatagccagacaatggaatattattcagtgctcagaagaaatgagctatcaaatcacaaaaaatcatgcaggaaaccggagtgtattttgttccctgaataacagccaatgagaaaaggctacatttctggaaaaggtgtgacattctggaaaagagattttcaactgtaaattcaaattattaaatagttaaggacccttcagttaatctatttcaactttggagagttttgcttttatgtgtttttgaggaactggttcatttcatctaaattgttgaagtacgtgtatagagttgtttgtagtgttcccttattatccttataaaggcatcatcgagagtaatatcccgtctatcattcctgttactagtaatttgtgtcatctctcttttatctttgactgtattgttaaaagttcatcagttttaaaagacaagatttttaaaagcaagattttagttggatttttttaaactaaggttttagttttattaatttctatccgttatggttgttttaaaatttgttgattttaaggtggaagcttagattgttgatttgagaactttattcttttccaatataagtatttaatgttcgaaaaaccttctaagcactgatttggctgcattttacaaattttgatacattgtaaatttattttcattcatttcaacatattttaaaattttcttgctgcttctttgacccatagattgtttagaagcatattgttaaactgctagtttggagactttcttgttgtctttctgtcactgatttctagtttaattttactgttattagaaaacatacattttacgattttcaattctttgaaatttattaatatttcttttgggacccaagatatgttctatcttggtgaatatatgcacttaaaaagaatatgtgttttgctattgtttggtggtattatataaatgtcaattcagttacaaaacaatcacaatcacaaattataatataaatgtcaattacagctaggtggctgataatactgttcagttcttctatatcattactgtttttctactaattagttatatgtattattaaaaaagaagtgttgacatctgtgactgtaattatggatttgcctgtttctctttttcattctgtcaggtttatttcatgtattttggatttgtattagttttctaggactgccatagcaaagtaccacagactgggtggcttaaacagaaggaattgattttctcagttttggatgcttaaagtccaagaccaaggtattggcagggttgtttcttcggaggcttctctccttgacttacagatggtcatcttctttttctatcttcacatgttctttcctttatgtatgtctacatcccaaactactcttacatagacatcagccatactgaaataagttccagcccaatgacctcatttaactttaattatgtatttaaataacttatctccaaatacattcacatttcaaggtgctggacaataaggtttcaaactacgaatatggggggaatgcaaattaa

SEQ ID NO: 479007 - DNA, 736 bp, Homo sapiens
agcggggatctcatgtaaaggggatggttaatgctgttcacctgaagagaaaaaagatgactggtgcctgtcctgttttgtttcagacacaaaagcaagtgacgccttggaaccagatcaaagagggctccaagtgcatgctgcacagagcaggcagtgaccctggaaggttcgatgtccctgggaacattcccactttaagttggacagaccttgaagcacatctgcgccagcatttgcacgttcatgtctcccttacatgcctttcctcctgtttgtttgggaaaaaagataaccaattccctgctggggccactgtctccgtggagtttgcacgttctgtccatgctttctccagagattctgacaaacaccttatttgtaagatgtgccccgaaggcaagtgcagcaaatattttgacaggagaataactaatctaccagttggatcaaggaacagaatcatctattataaagtggggaacataggactatagaagtttcagatggtggggttgctcttaaggtgtgaagttactgtctagagcttcctgttccccattcacaagagggtaaagatgcctgtacagatggcaagccaatggctcctaaaccatatagagtgtggcaaatgtatgacctagttgttctataccagttgctccctttgccaggaactgccaaagctcttaagctaaagccactaccagatatgctcaccccttgaaaaaggcta

SEQ ID NO: 479008 - DNA, 498 bp, Homo sapiens
aagatttttccctggacctgctgctgtctcctttatcacagtgccccttgacaaattccgatcagcatgatatctctgggcattcatatgaaggagacagtaggttctcgccaatggggtgctaatagacgtgatgcaagcaaaggcttcaaatgcgcttatgctcttatactttgccatgggaacagcctctcccacgtagccgccaccctgctgcctgggacccagaatgaactgtgtatggagtatatctttgccatctgccccacatctttaagcagaacccagcttacaagagctgatcaccagcctatctgcagccaggaggctggtagtctgaggcaagttctcattcctgttcaccgctgcctggaaatgaactcagtgctgttggcgggtgcacagtgggagtgggactcgccttttgggctgcatgggacctgggtgaggcctgtaactgctggttttcccccacttccctggcaaccttcatgacat

SEQ ID NO: 479009 - DNA, 2825 bp, Homo sapiens
cgatggaatacaaggaagcagcaaaaggaggcctcacaatcatggcatcagacaagagaaaagcttgcgcaggaaaattcccctttataaaatcatctgatctcataagacttattcactatcatgagaatagcatggtgggtctggacgtgtcatccagaagtcaggaactagagccaaaaaccttagaagtctgcctggtgttctattgtacagtgcatcagctggcagtcaaaccacaagatgcagtcttttccactcttccctccccttttcaaaggcagagaagcctcaccctgaagccaccaccaccccaggccatgatgagtactgccagattaccaccaattacctgggtatccctgctgcttatttggggcccaagagctcttcagttagcagataatgaatgctgccaggactgggtcctgtccttcaaggtagcagagtaactcccatgatagttcctcttccctagtcaactggcctcagcatttcccaggctatggatttagtatgaggtcattcagtgtcaaggtttgggaatgtgaatttctaaatccaaggccctccctccttagcttcactattctgggctctcacaacccaaaatcaagtatcacactctttgctgaccatcttgcttcattcctttccttttaagttgccttaagcatctatatacttattcaaaatgaaactaccctcagtattttaataataaacagggaaaataaatgcaaatttaatttctgttatgtgcgaggtactgtgctaagctatttacaaacattatataatcttcaccacaaccctataaagtagatgctcttttttatttctattttacagataaggaaattgagacttataggggtaaaatgtactttcaaatcttactctatacttcctttagtttttcacatttagtttgaatacttgcattaggtttagaatactttccttcatacaaaatatatatccttctattacgatttcacaaaacattttcttcatacagtgaaattgaatttcacaaatgccttttagcatacactgagatgatcacaaaatttttctttctttgttctcttaatatgatgaattgttttaataaattttttacttttacattttctttgcaggtctcagataaagtcagcatgtgcacaatgtattagtattttaatataatgttgtatttgagtcgatattatttatttagggtttttgaatctttattcctaagtaagctagctatttttgcaattcataaaatgaactggggaacaattcatctttttctaaacttaataaaatattaatagcagattattttaatacagtctatattggaattactattatttatttaggatttttgaatctttgttcttaagtgaactggctatattttttattcataaaatttgaattggggatcaattcatcttttcctaagctcaataacatttaaaataatacagaaattgcttttttcttgaaggtttggggaaaattatccttaaaatattctttacctggtattttcttcagagttagttctttaacaaccttcttaatttattctgtgattattcaaattttctattccctcttaaattatttttagcaattcacattttctttaataaaactgtccattttattaagcttgtcaaattaattaccaaaaaaggtgattaatgacatatacttttagtattttatctcctgcatatcttatattaaaatcattttctccatcaattgccctattgctgaccttctactctgtgcctagcactgctcagggtgctgggtaattactaatgaacaaaatctatggttccagactcttagggatcttatagtctagtgggcaagaacaatggtgaataagtaagaaaataaaacagtaattaaaaattgtgataagtggtacgaaggcaacaaaatacaataatagaaaataattggggtggggatacagggctcagggtagctcaaatgtagattaaaaggtctgagaagaccttatcacggggtaacaatgaaatccagacctggaaaaccagaaagaaccagctctttgaagaaaatgaagagaaaaattccaaaatatgccaaggcggtatagaacctgtcgtgtttggggtactaaaagaagtataagcttgctgaaacatgaagagtgatgtggggaaggactcgggaagattctaaagagttgagaagatttttgaagcatgctggtcttttagtggctgcctgagaatttctggaaaggtgattaggtactgacattttttaatcaaaaatggaaattgaagctgaatttgcaaagttctttgtgtaaaatggaaaacagttcagctatctatattcaagaatgggacaatttgtaataaacattgtgtggatcatgatagagtttatatatttgtaaaaataataaacttgacttttaggcagttgtaggtttacagaaaaaaatgagcagaaagtatggtaagctcccaataacacctttgtcttccaccctcatttactctcccatttcccacaacacgcaccccatacacaattttccatataattaacatcttccattactataatatacttgttacaattgatgaaccaatattgatacattatgaactaaagtccataggattttacattaggcttattctttgtgttgtacagttatatgggtttttaattttgcaaattatactttatcattttttctattattttgaaaaatgttttcatttttttcttttcaatttttttttaatttcaatagcttttggggt

SEQ ID NO: 479010 - DNA, 674 bp, Homo sapiens
agcgtagtatctgggccagaatgcaccatccctcacaacacagtcccacatggcttcccttggcagggaagggagttctgcgaccccttttgcttctcagctcaccttctgtgggctgcacccactgcctaccgagtcccagtgagatgagccgggtacctcagttggaaatgcagaaatcacccgccttctgcgttgatttccttgggagctgcagaccagagctgttcctatttggtcatcttgacagccaccaaaggccactgccaccacaggatcatggggagtactgccaggcttttgctaatgttcccttaaggccaagcccccttcagtcagcttgtgatgaatacttcctcttgtgggactcacagttaagggaagtaggctcccttgtggtttggggcaggtccagaaatgccatccaagagccaaagcctggaaatggggaccccaggagctctcttggtgctctacccaactgcggccaagctggtaactaaggtgtgatactatcaggctttggactgggggaggtggtcaatgatataaaagaagctgccctccctgccttcaagttacttataacagagtcataaacagaggcaaggctgtcacactgatttttgtcaacttttataaaatgccttaataaattctaagcacgataataa

SEQ ID NO: 479011 - DNA, 3113 bp, Homo sapiens
tctataatgagtttgtccctgaagatcaagatttaaaagaaagagctcaaaggtgtttcatctccgatatatgattggtatatctgatgaaggataaagaagtatttgatgtgagcaagttacctatacctgaatatgccctgtctcttgggcttgctgtggcaccatgcataagatttcttcagaaaatgcagaaacaacccaccaaagaattggtaatgagccaagccaataaagtaactgagccaagggctccctccctcaccaatgacaaagtggaagaatttagagccttcttcaatgagaaaatgtccatccttcagaaaggtggaaaaagactcaaagggacagagcacagactggctaatgatactagtgatgaagaacaggaggaagaggaagataatgaagaagaaatggaagagaaactggcaaaagcaaaaggatctcaagctccatctcttcctaacaccagtgaagcaaagaagatcaaggaagttcctatgcagttcctggacagagatgaggaggaagaagatgctgatttcttgaaggtgaagtggcacaatgtgtttggatttgactttaaagaggagaaaacattacagaagaaagaaccttctaaatccagcatcaagaaaaaagtgaccaaagttgcagaagcaaaaaaagtaatgaagagaaattttaaagcgaataagaagataacatgtactgatgaaggggagttggttcaacagtggccacaaatgcagaaatctgccatcaaggatgctgaggaagatgatgacacgggtggtatcaacttagataaagcaaagggaagacttcagaaagaggacaaatttgacaaagaagaatataggaagaaaattaaggcaaagcattgggagaaaagactgaaagaaagggaagccagaagagaagccaacacgagacaagcaaaggccaaagatgaagaggaagactttctggattggagtgatgatgatgatgatggatttgatccaagcacactcctagatccagataagtacagaagctctgaagattcagatagtgaagatatggaaaataaaatgtgataccaagaagaagcagggaatgaaaaagaggaagaacagtgaagtggaagatgtaggaccaacaagtcataacagaaagaaggccacgtgggacactttagagcctttggatactggcctgtctttagcagaggatgaagagctggtgttacatctgctaagaagttaaagctaaatacttcctgcgcctgccttctccttgaaaccttggttatgattgtgtagacaagatgctgaaaaacaattgatttgggggcacttagtgtttatgacaaatttctctatttgtaaaattctgaatggaccaagtaaaatatgtctacggtctgtgacccataggctgtcagtatgcaaactccgatataatggaaccaaatcaatctcatttcatatgattttatagtaccacatttcatgtgatattaaaccataaatgtggagaagattttaatttttgtgagagtaagttttacattccctccaataagagacccaaaatccaggcttatttagctctgacttgatagccaaagacctacacctgcccaatgtcaagagcacagaacttgtgctcaagaggtgactactgacacatataatgtgagcctttcagggtaaactaagacatcaagtttggaatgtcactcaagggagtacttcagaattcacaaaactacttcctttcaacatgaatttccaaaattcaaaagtattttggagtgcacagaaccagacattacagaacataaaggtttatatcaaaaattaagtttgatgtgaaagacaatgtcaagagaataagaagataaaccacagactgggagaaaatatttgcaaaggacatatctgacaagggaatgttatccaaaatatacaaagaactcttaaaactcatcaataataaaatggaataaaccaattaaaaatggtcaaaagacctaaacagacacttcactaaagatatatgaaagcaaataaagcaaatgaaaaaatgctcaacattttggtgtacattatatgggttttggcatgtgtgtgtgtgtgtagactgataaataacaaaatagtagtcagccttcaaaaagaaggaaattctgccatttgcaacaacatggttgaatctggaggacattaagctaagtgaaataaggcagacacagaaaagcaaatactgctggatctcacttatatgttaaatctaacaaagtcaaaattcacagaagcagagagcagagtggtagctaccatagactgggggtgaggaaaatgcagacaagttggtcaaagggtacaaagcaacagttatgcaggatgaataagttttgtaaatctaatgtgaagcatggtgactatactgtattgaatacttgaaacttgctaagagagtagatctcaccaaaaaaaaaaaaaaaaaaagataactatgtgatgtgataagtgttaattagcctgacagtagtaatcatttcacaatgtatacatatatcaaaacatcgtgttacacaccttacatatatacaatttttatttgtaaattatgtattttacaaatttctatttgtaaattatatctcccaataaaactgaaaaaataaagtgtaaaaaagaaaaaaataaaaataaaatgtaacaaagaaagaaaagacatggaggaaacttaaatgcatatttctaggtgaaagaagccaatctgaaaatgctatgtactgtgtgattacaactctgtgacattctgtgaggacagatcagagtatccatatgatactataattgtggatacatgtcattatatacttgccaaaacccatagaatggacaacatcaagaatgaaccctagtgtaaatgacagactttaagtgataatgatgtatcaacgtagaattcatcgattgatacgttttttgatttctgcaaaaaacatcattagaatttaaacagggattgcaccgaacctgcaaattgctttggaaagtattgccatcttaagaatattaaatgttgtaatctggctgggcgccatgcctcac

SEQ ID NO: 479012 - DNA, 675 bp, Homo sapiens
ggaaccagttccgttggacctggagttcatgctaccaaccttcatgccctcctgtgacagcaagagagagccaggagcttttcaaagagatgaccagggttataggtcacagatctgcatggagggcatttttagacacacaaatccaggcatgactgtagctgaaaaggaacaagggggaaggaagcaactagaattgcatttatcatcaatattgcctttggtccactttacatgggtgactaatgaatatctgaagactgccaaagaacaccagtcatcaccagaagctacaggaaagccatggaagaagttttcctccaagtcctcaggaggaactaaccctgctgacaccttgaaaatcataatagcaacccagtgtgaggatccaatggacttctttataaggggaaagcttctatgtttggctacctggggcttctggccttaagacttgcacccttccctgtcagcaatactgctgcagtttagagaccggtggctgttaaactgcagtacacatcagaatcacctggagggcttgttaaaacacaggaggactgaccccacctccagagttgctcatccaggaggtctgaagttgggccttgataacttgtgagtctaacacgttctcaggcgatactgatgctgcaggtccggagaccacatttc

SEQ ID NO: 479013 - DNA, 1314 bp, Homo sapiens
tacaaagacaagaattttacagctgggccaccgggggtgacatcacatatcgggcacaagatgcaaactagcttgttacgactatggctttggtttctgagaaacgggaaggcacagtatagtcacaaaactgaggtctggagtcttggtacttgcggaacagccatggcccattgggcaggaggtgcagcagctaaaatagttggagtgaaaatgggtgacatgaataacactggttctcacttcattctctacagagtaaccaaatttcttcgaaattctgtggacatggatgaagctggaaaccatcattctcagcaaactaacactggaacagaaaaccaaacactgcatgttctcactcataagtgggagctggacaatgagaacacatggacacagggaggggaacatcacacacaggggcttgtcggggggccttccagtgggcaatatgtggaagtggacatgaaaggcagtgatattgacaatcctggcctgtgtaggcaggcacaaagaagcttttctaagctctgtactgcaaaaaccagatttcttcacttatttgtcctagaattatagcagattcattcagtgtaaataacactctaaatattcctttgaaacagcattttatcattatgtgggccagcatcaataataagagttggaaatatctccacctatagctgtgcttttaagcacaattatctgtaacagtcagtgttggctgcaatctcagttggatttggtttcttaaaaaataaataaatgcaaagccaacaatgggaagcagtatgagatagatttaaagatgaataccaaaataaaggttattgttatgtgacactgatgggtttcagttctataaacttatgctattaattttcagacttattaagtatagtctgtacttaataataatttcattttgtggatagtttctattgaattatgtgaaatttactaatcttttcttctgcaatttgtatactacttttgtctttcaagtaaaataatcatttcagtttgtatttttcagctctagtataccttttgtatacatatggctctaattgcacagtgtgttgtgctacttgattacatttttagaaatttttaatggtcacctaataattttgcatatttgatcctttcttcatccttgacctttgggagttagattatttaatgtcttaatgtagtcttattggggttaaatcttcttggtgttctataattttcttttacttgaatgtttatatctttctctaggtttgggaaattctctgatattatctctctgaataaact

SEQ ID NO: 479014 - DNA, 538 bp, Homo sapiens
tcctcagataattgcctgctgacaattagctagtagaagatgtacctaaaagcaggcgaggggcagtatggacagggaattcttcagtcctgggcaactaaagcatggtctagaagtgcggggagagccttgccaccccttaaagggcaggttccagggcaagggccactcctgccaagtgctaagtgcagttttacctgagtttaagactgtgaagagttatgataaaccttaccttaaatcagaggtgtggcctccacactgtgctgtggaagagctagacttgtggacagtatacctgagctactttcaagatggagtaactgatgtgcccagagaaagtccaggccttgaaggtgacggagagataactcacaagctgccatatcaggactttggcctggcctccaacctagaaatgctcctgggcattgactgtggtagtggttttaggcacttttcattgaccaaggtggaaccctgtagtcctgtgcaacagagaggttgactgtgttagcaaaacaaaagggagcatact

SEQ ID NO: 479015 - DNA, 595 bp, Homo sapiens
ggaaattatatcatgccatgcctcacaccttgctccttcagagcatacgctggagtggtaagcatattgatcagacactggtggctgtggaggctcctgctgtctcttggagtgatggctttggtgaaaagcatctgggtggtgattttggctactcacacagattatctgtggaagctgaatctctggacaaattacctactccccaggacaggctgagctttggtgttgatcttactgctgctgcctctgaccatggagaagacatgggcctctctcctggtgccaggcagatcactagcctcagccaggcagtttctgtgagaagctggctcaggtacaggcccctgagtcctgatactctgcaattgcctcgaagagctgacttccatgactttctgagtttagtcagggtggagagtaacatttctcaagtcctggaacatctaccagggtaagactgcaggtagtctttttccatctctgggagacgtgctttcaggctgggtggccaacccttcccgttgccaagttcacttcatctcagacatggaaatgtcctcaggtcactctgctcaccatcattttgccaaaa

SEQ ID NO: 479016 - DNA, 644 bp, Homo sapiens
cctatgaccccatcaacccagatgcctcaagtagtcactcaccccattcccctaccaaattttctcagccaccttggaggattattgcccccagttgaagaatgtgataccctgagaggttatggagttttccaagaatcacacttaggaatagagttcagacaagtccctggtctcctaacttgctggccaacacattttctaccactgctccctgcattaggagttctgagaaatgagcccctggcaaaccactgctgtaagcccaagagtccaaaagctgaagaacttggagtccgatgttcaagggcaggaagcatccagcacgggagaaagatgaaggccagaagactcagccagtcagcttcttccaccttcttctgcctgctttttctagccacactggcagttgattggatggtgcctacccagattgaggatgttaattctcccaaaattgatctacagatccaatatgattccaataaaaataacagtaggttgtgtgtgtgtaaattgacaagctgattatgaaatttatatggaaatgcaaagggttgagaatagtctcaggtattcctgcatagcaacacaaaatggtctaatacacttcctaagaaacactaacatatgagggacccatg

SEQ ID NO: 479017 - DNA, 667 bp, Homo sapiens
ctgtacaagaagcatggcaccagcatctgcttctcataagggcttcaggaagtttccactcatggtgggatgggaaagggaacaagcatcacaaagtgagaggaaggaagctgcacatgtgtgggcaaaagaaagaaagagagacaggaagaagaagaaggaggaggaggaagaagaagaaggagaagaagaagaagaaaaagaggaaaaggaggaagaggaagaggaagaggaggagatggaggaagacagtgggcaatcggacagaagggctcctcacttcccagaaggtgccgaggctgggcagaggcgctccttactttccagacagttgggcggccaggcagaggagctctcagaggaccccgtatgcgttatgtatcaaatggcaagtctttttaaacgggtacgaatgaccacactattcgtgagagtacaaattggtgggcactgtctttcagcacgggagagtgaaaatggtttagtctttctggaagtgaaaatgcgggttttactgtagatgtggttaatatcagtttataattcagctaaatacttctattccccatggtcattttgactcattatacagtttaaattgattttattcttctgtaaagaaaatattgactatttatattcgtaaagggctactacttcaagacat

SEQ ID NO: 479018 - DNA, 481 bp, Homo sapiens
tctgagtcatagagctgcttcagactactgcctacattatgcaatgtcattgggtaaatattccctatccaaaagggagaaattggtcaaaagaaaggggctacaggctccatgcacatttgaaactcagcagggaagtcattaaatctaaaaattccaaaataatctcctttgactccatgtctcacatccagggcatcctggtgcaaggggtagactcccaaagccttgggcagttctacccttggagcttcccaggattcagtccccacagctgctttcacaggctggttttgagtgcctacggcattaccaggctgtacaggaagcacggctgcatctgcttctgggaaggcctcaaggagccttttactcatggtgaaaggaaaagtgggagcaggcatcttatatggcaggagcaggaccaggagagagaggggaggtgctacacactttaaacaaccagatttcacaagaactc

SEQ ID NO: 479019 - DNA, 646 bp, Homo sapiens
acggggtgaggctcctctgcctttgaaaaggggagtgaagagattttccacccggcaggcacttgtgatgcaggaatcgttttcttgtgtaggaacccaagtttttcagacttctaatcctggttcttactctcatgtgattcgctctgggctttcttccgttctgtcctatagttgcctaaagaaaacaattactattaacatcacaataaaaatgatcaacaacagtgatgtaacatctgaactcaaagttccattccctccacagaacaatgaccaacaagatagttgcaaaactcacagtggtccactatcaccttgctctgactctattccagtgaatactcaatcaaatcttctgtatgtcagcctcttttccaatttaagcaaaaacaggaaacaccagaaattacccagagccattctgttgatattcctcaaaaagtactgttgtaacttatatgcacacaaccaaatgaagaaaacatcatttgcccaactgcctaattttacattctgtgatgcccatacccacaaagtgcatgaaattttactatgataataatatcaaacaacaaaaataacacattaacaagagcaactaagtaaatctcttacaagggaataaatcttgttaaaattattt

SEQ ID NO: 479020 - DNA, 862 bp, Homo sapiens
ccaacagcaaagaccaaaggtaaatccacgaagatgaggaaaaaccagtgcaaaaaggctgaaaatgccaaaaaccagaaagcttcttctcctccagaggataactccttgccagcaagggaaaaaaactggacagagaatgagtttgacaaattaacagaagtgggcttcagaagttgggtaataacaaactcttccaagctaaaggagcatgttctaacccaatgcaaggaagctaagaaccttgataaaagggtagaggaattgctaactagaataaccagtttagagaagaacataaatgacctgatggagctgaaaaacacagcacgagaacttcgtgaaggtcacacaagtatcaataaccaaattgatcaagtggaagaaaggatatcagaaattgaagatcaacttaacgaaataaagtgtgaagacaagattagagaaaaaagaatgaagaggaacaaacaaagcctccaagaaatatgggactatgtgaacagacaaaacttatgtttgattggtgtacctgaaagtgatggggagaatggaaccaagttggaaaagatgcttaggatattatccaagagaacctccccaacctagcaagacaggccaacattcaaattcggaaaatgcagagaacaccacaaagatacccctcaagaagagcaaccccaagacacataattgtcacattcaccaagattgaaatgaaggaaaaaatgttaagggcagccagagagaaaggtcgggttacccacaaagggaagcccatcagactaacagcagatctccctgcagaaactctacaagcctgaagagagtttgggccaatattcaacattcttaaagaaaagaa

SEQ ID NO: 479021 - DNA, 498 bp, Homo sapiens
tgggaagcagcagcgacatcaccaggtcattgtcagctcaactatgtccatgatgtcaggcaacgactgtggatcactcctctacctgatccctgcccagcccctctccaggtttaggagagttttgaacttgctccagtattggattcctaatctaccttgggcacatcagctgccccagaacctgggctctgactgggcccttaagttcatatatcagacactcattgcagattccccaccttctctcactgtggtttctggtccacctgaaagggcctactggattcagaatccagaatttaatgacatagttgcttacaaattgcaaattgatggacggtttggttccaagagcttttcttcattttttactgtgattgtctttaacattggctacatacagaactttgttaaacatgtgcactgcagcaatgtaaaagacacagtcctggtttccggaatttagacttatatgaattacatttacctgtttaa

SEQ ID NO: 479022 - DNA, 3019 bp, Homo sapiens
tttgtcaacgagagtctgagctagccggataccccgctctctcccaagccatctctccaccctgggcaacttccatgcatctctctctctccattctctctctactctccctccttctgtcattctccctcccatcaatcacctttttatctcctggcattatccatgccccacatgtactcttcaccacactactcttccccactcgcaagggtggcaactgctcatgcgaagtatgccaggggacagcgatgggtcctgaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcagtggggcgggggaagtgaggagatgacggctgcagcggtgtcagcccaggaccagcagctctataagagatggaggtacgatttgcaggttgcagcaattggcagcagtaatgcatgcgggtgaggctgtgcct

SEQ ID NO: 479023 - DNA, 1227 bp, Homo sapiens
ataggaaaggcagaattttaagaaacctaacaaatcctatactcatctgatgttttgcagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaagtaagtacatatgaaagatactaggtctctgaagaggcaggcagcacaagtttgaattttacctccactatttactaactggatgacctcaggctggccagttaaactgctcccagcctcagttttcttacctggaaaatgggtataatgatacttgcttcacatgattgttatgaatattaagataatctacataaaggatatagctccatgcttagcacatagtacatgctcagtaaatatcatgttcttatccctaaatatctttattaaagtactatacttttccttagtgtgtcttcatggtatccatcaatttctggcccctgatcccaaaggcattgaacacttgttgcctatact

SEQ ID NO: 479024 - DNA, 630 bp, Homo sapiens
ttaagacctgaaggagttttaacccctgctcctctggccaccctccggatggatccctgtggtgccaggcaggaatgggctgcttggggacccagcgagctcccggggcctttctgctgcttcctctacccctgtatgtcactcggttctccaagctgactcagctccagagggtctgtgggtcctttcggcattgctggtttgttcttgcagtcgatctggagaaggcctcctctgaccactctgcaggtgaaggatggtgccgccttattacttccaaggagtctgggactccttgttacttctgggtggagagctggagaggatgtgatctcaactttcactggccactgattctaccaggaataggtcttccaccttggaaatcttggcaagattggagctaccacttgactgtgaacacaatgaagctgctttcccataacacagagatgtgcgggaaaagtcgactattcttttcaccagctaccctgtctgaatcctccctacagagtgggaattggggatggaaaacaggcggttccgggctgcttccacaactctatataggctttacatagaacagaactgtggaaaacgggatatgatgatgtttgccaactgccaaac

SEQ ID NO: 479025 - DNA, 613 bp, Homo sapiens
cagctccagggagtgtgcagccccagctgcgcagctggcgtgatggcggcagccactgccatcagtagttatacacgtacttgtgatattcaagttcaaagtttcagaaatggagcagttccaattaccagcaaagtccgggatgtggttacagttgaagcagaaaagagaaggtcgtcccaattaaacaaagccagaaactactgtgaatgcgacaaaaccagggactgtgtcttggttacagttgtatccccagtatcttgtacaatgccagacacagagcaggatctctccacttccggattcctggatatggggatgggagattgcatttggcttgggtgtctctttgtcccaattctcctcagtcctggacccacacagatggcaccagcaaacaattgtttggggatgagcaaatcctctgagctaactgtcctttaccacttccattgggagtaggtgcaaccacattgatttaattaaagatacaataaagtcaaactgcagaaaacacttagaatgatacttctctgccttgatacaaaccactgtctgtattgacttgcaaactggaaaattttggagggatcatgtgtatgcttcatttctt

SEQ ID NO: 479026 - DNA, 555 bp, Homo sapiens
acacagcacagctgctctgccaaaatgcagccagaatgcttaagttggtgcctgatcttgttcctcctgactgggagagaccaccaaacgggtctccagtcacctcctacagacatgttcaggctggcaaaagtgcccctgttcctccaaatgaccacaacacttctccagcaagggctcagaactgggctgaggctgacatagctgaaatgacagaagtaggcttcagaaggtgggtaataatgaaatttgctgagctaaaggagcatgttgtaacccaatgccaagaagctaagaatcatgataaaacaatacaggagctgacagccaaaatagccagtttagagaggaaaataactgacatgttagacctgaaaaatatacaagaacttcacaacagaatcacaagtattaatggcaaagtagaccaaacaaaggaaagaatgtcacagctggaagactatctttctgaaataagccaggcagacaacaatacagataaaagaatgaaaaggaatgaacaaaacctctgagaaatatggaattatgtaaagc

SEQ ID NO: 479027 - DNA, 1243 bp, Homo sapiens
acccgatcgtagacgacccttacatgatgggcaggatagcatgtgccaatgtcctcagtgacctctatgcaatgggggtcacagaatgtgacaatatgctgatgctccttggagtcagtaataaaatgaccgacagggaaagggataaagtgatgcctctgattatccaaagttttaaagatgcagctgaggaagcaggaatgtctgtaatggtcagccaaacagtactaaatccctggattgtcctgggaggagtcactaccactgtcttccagcccaatgaatttatcatgccagacaatgcagtgccaggggacaaatggaataagattaagctagtggtcaccgaagatgtagagctggccaaccaggaggcgatgatgaacatggtgaggctcaacaggacagctgcaggactcatgcacacgttcaatgcccacatggccactgacatcacgggcttcgggattttgggccacgtgcagaacctagccaagcagcagaggaacgaggtgtcgtttgtaattcacaacctcctggtgctggccaagatggctgcggtgagcaaggcctgcggaaacatgttcagcctcatgcatgggacctgcccggagacctcaggcggccttctgatctgtttaccatgtcagcaagcagctcggttctgtgcagagataaagtcccccaaatatagtgaaggccaccaagcatggattattgggattgtagagaagggcaaccacacagccagaatcatagacaaaccccagatcatcaaggttgcaccacaagtggccactcaaaatgtgaatctcacacccggggccacatcttaatctagacagaaatagctgtttggttttgtttttaaatagatctatttcccttatcacttcaactaaagactataaacaacaaaaatctcattgtgtctacacatcggggtgaccttaggtcagtttgtaagtggatacaattaataaaataaaatccactgcctttttttcctgttacattaactgaagatgcacctaatcttgaggcagcttctgaattgagaattatattgttatccaatgctgttgattcattttgaatctttagacacttatctcttgccgcataggctctttttaaaggtgctttcacatagcacagacattaccagtagtcatgtcaaatcgcagttggtgtcttcattttatgtatatttatcaagtaagtctgatttttttattaagca

SEQ ID NO: 479028 - DNA, 1203 bp, Homo sapiens
cctgcctccagtagcacaaatggatgtgtctactgaatctgctatgggactgaatttagcagacctgcttctaaggggtccatatccaggaccaaggttagcaggcctattacctaaaacatggtgtaggcatgactcctcttgggtttcttggcatatggattgggtggcagatccaagactaaacaggactgtagctgagtccacagggggcaacaatgtttctaggtctgtagccaggactgtggtgcccatagtgggagaaggtgagaccagccacagtaatagtgacactgataatgtgaaggtcaccatttgcagcataaagaaatgtttctctgtgttcatgcgtgtgaccttaaatttacttaagaaagccaggggacatccaaaaagaaggaaaacagtacaaaaggaatttgagttacctgtttgttacctgtgcttgaaatgttacccttggtatcagatggaaagaaacataggaaggcaatgataactgtcatagtgataactgtcatcactatagactggttgtgatattctgtggctgctttgtggggtttttttgttttgatattttattttattccaatcttttcacagagatatttttgagtgttgtcttgtttaggattttattattgctgctcttgtcattctgtgcattttttgttgaaaatttcagagtttatagggattgggaaggcctggaagaataagatctagctatgttaatagagattctttacagatgcaaatttttccccacaaagaacagctttgcaaggccatttcaagatatggcaaagaagcatgttttggagtaaaatattttaattttcttccttgtcttgtaatgttatgccagagtcagattggaaaatcataagttccatttgataaggtacaatgtctgttggtttattagccagtgcctaacactaccatttaatatgtattcaatgaatatttgttaaatgtattgattgaatttaaagtgactactcagcctacttctgccccttggagcttggattgtttcttcaaaggtattgatccttttgactattttaattatgaattcactaaagacatctggaaggcttattgtgtcaagcagtgccaaatccatggcttgatgaacctagatccatccccttcccctttccatatcacagatgacaacttgatggttggcct

SEQ ID NO: 479029 - DNA, 663 bp, Homo sapiens
catccgtgggaagagaccaccaaacaggctttgtcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagca

SEQ ID NO: 479030 - DNA, 607 bp, Homo sapiens
agcttcattctcctgtgttctccatggttcctattgtttctctggtgaatttcagcatgctctcttacatgatccactcgaaattaaacatgaaaaatgctgaggcccacatctacttgagtgggtacccacttgtaaaggatacccagtcccatatcctagatgacattgtcttggcccaaaatctcacctatggagatgacatagcttcagaggatattgccccaactcaaaactttactgctggctctggcctccactgctgccagtcccagaccctagctgtttgtcacatatacatagctgaggaccccaacagccctcataatctttgcgaaactcccacagctcttgacacaaaggaccatgcagttgccaatgttgtaggcatgcctgagctgactagactcggcccctatctgccgccacaccaccagacccagagccacactatgcccctgcatttggtttcctatggtctagacccagtgccacagtgcacctagtatgtctccctttttcctccttaggaaccaaatagccattctatgaaatgtctttctttcctttttctctcttgctcaccaattgactcgtaagcacttcc

SEQ ID NO: 479031 - DNA, 690 bp, Homo sapiens
ctctctcgccatttgatgctggctccctttcactatttgccatgattgtaagcttcctgaggccctcagcaggagcaaatgatgacactatgctttatgtacagcctgcagaactgacagctaaacaaacctcttttctttataaattacccagcttcagagctggcaggcaggaacgtttaagtctgctgaagctgctgccacagctgctccttcccacaggtgctctgtcccagggagatgggagttttatctataagccgctgactgaggctgctgtctttctttcagagatgccctgcccagagaggaggcatctagagaggcagtctggctatagtggctttgctgagctgtggtgggctccgcccagtttgaacttcctggtggctttgtttacaccgggtgtgaacggttctgtctcgctggcattccagatgccactggggtatgaaaaaaacctcctgaagctagctcggtgtcttctgaaacggccacccagttttgtgcttgaaacccaggaccctggtggcataggcaccggagggaatctcctggtctctgggttgtgaagaccgtgggaaaagcatagtatctgggccagaatgcaatgttcctcacagcacagtccctgaaggcttttcttggctaggagagggagttcctcaaccccttgcacttcccagctgt

SEQ ID NO: 479032 - DNA, 2207 bp, Homo sapiens
ggcactttgggaggccaaggcaggcggctgggaggtggaggctgcccgccggacccgcgctagcagcgtggcagcagcgtggcagcagcgcggcagcggcggcggcggcggcgggcggtccagcgggtgtttctctcgggtcgcagggtctcccagcagcgtggtggactacctgatcagcggtggtaccggctacatgcccgaggacgggctcatcgcgcagcagctcttcgccagcgcctaaggcctcacctaggacgccttcctgattctcccaggactcatagacttcatagctgaggtggaccttacctcagccctgacccggaagatcacgctgaagacaccgctgatctcctcccccatggacactgtgacagaggctgacgtggccatcgcgatggctctgatgggagatactggtttcattcaccacaactgcaccccagagctccaggccaaggagctacggaaggtcaagaagtttgaacagggcttcatcacggaccccacggtgctgagcccctcccacactgtaggtgatgtgctggaggccaagatgcggcatggcttctctggcatccccatcactgagacgggcaccatgggcagcaagctggtgggcatcgtcacctcccgagacatcaactttcttgctgagaaggaccacaccaccctcctcagtgaggtgatgacgccaaggctcgagctggtggtagctccagcatgtgtgacgttgaaagaggcaaatgagatcctgcagcgtagcaagaaagggaagctgcctatcatcaatgatcgcaatgagctggtggccattatcaccggcagcgacctgaagaagaaccaagactaccctctggcctccaaggattcccaacaagcagctgctgtgggcgtcgacatcatagtcttggactcgtcccaagggaacttggtgtatcagatcgccatggtgcattacatcaaacagaagtacccccacctccaggtgattggcaggaacgtggtgacagcagcccaggccaagaacctgattgacgctggtgtggacgggctgtgtgtgggcatgggctgcggctccatctgcgtcacccgggaagtgatggcttgtggtcagccccagggcactgctgtgtacaaggaggccaagtatgcccggcgctttggtgtgcccatcatagccaatggcagcatccagaccatggggcacatagtcaaggccctggcccttggagtctccacagtgatgatgggctccctgctggccatcaccatggaggcccctggtgagtacttctcagacgaggtgcggctcaagaagtactggggcatgggctcactggatgccatggagaagagcagcagcagccagaaacgatacttcagcaagggggataaggtgaagatcgtgcagggtgtcttgggctccatccaggacaaagggtccattcagaagttcgtgccctacctcatagtgggcatccagcacggctgctaggatatcggggcccacagcctgtctgtccctcggtccatgatgtactcaggagagctcaagtttgagaagcggatcatgtcggcccagatcgagggtggcgtccatggtctgcacttttatgaaaagcggctgtactgaggacagcagtagaggccaaggtgatggagggggcacagcctccccccataactgagtggtccacagatttgcattacgggttccccagctcctttccagggagagaggaggggaggccctgaagggtctccgggccctcgctgggcatcccctgcagagtcagggctgctccctgggccaggctgccctgggagccccccgagcccagccagccaggttctcaggccctgcacctgcctcaggtctttcttgctgcagcctgctccagcccagcccccatcccaggggcaggcagcccctcctggtttctcctgtagggcacctccctgcccccagcccccccaggaaatggtgctctcctggccctgcctctggcccttcaacaaagagaaggttggaagttttgtaaaaaggaagtgttatgtattgctcttcaagaaagttcactggcactagtaaggttttggagagctggcaagttttgattggttgtgaagatgaagtaaaggaactttgagaaagagactgcagcagtgcccagtgtgcccctcttggcactgacagccca

SEQ ID NO: 479033 - DNA, 2315 bp, Homo sapiens
gttcatccgcaggtgaggaatgcaaagccagactgacacagagagcatggcttgccctgagaaacctgtaccccaggtgatcagtagatggcaagcgcaaggcaattacgtttgtcgaccccagctgctgggggctaaccctacccttccccaacctggcctaactgctgatgtcagctctgtccaggctgttcgcagctctggagccaagcctggcccagccccctgctttagtgggaaacttgagatgctgagagggggcagcagcatcagggccagggtttcttgggacccaggcttgcatcactcagtgccaccctccccaggggaacaggctccaagctgtgcctgctcctctctggtgactcacaacacgactgatctccaagatctaaacctgattgtgcctggaagtgaagaaggaggacaaactgtggtctgctttgacgtcagctatgcagatgtgctgaggctgttcggcatgttggttccaggcctgggatgcagccggcagcaccagaggcggggagggaggggacactaggggcagcctctcgctgaaggatgcccagaggcaccccagtgtgtgaaaaaaaaaaagagtaaatggaactagatgtgtggagcaaacttcgcaacctttgggggaaggtctacacttaggggttaagcttctttccagattccctgcttggagaagctgccttcatagagggcagtggttcttaaactttccttttggttacttacttgagaattgactaattgttgtgaatcctcttcctagaaaaattcacttacaaatgtgagggaataaaacaaagttgcttggtatttcctttatgtttggtattctgaaatttgatcatagttaatctgggtgtaagtcttttttgttttgttttgtttattcttcttggtctacagtgggtcatttcaatgtgaaagcttttgtgttttttcacctccagaaaatattccattatttatttctttatttttcctcctccatttcctctgtttccttatgctggaattcctgttaaatatggggatagttgctacctggggcattcactggtttggtgcggagaaaatctccactgcagctggctgattagtacaagtgtcagaagtaaggggacagttggcacaaatactctagatacagttgctcaattaagcaccccaaggagtagcccaaggccctcttttctttgtatcaaacaactctgacattagggtagagttctttcttaactctatttctatttttgcacttttgaaatagtcttctggtgcaggactttttttgcactactatcaatcttttccttcttacctgccttggtgttaaacttaaaatgatctgtattctccctcctttccaaaattataaatttcctattttcttattttactatttttatgatttcatgttttacattcaaatctttaagccatctggaatttattctagtgtcagccatgacttggggccctaacttaattttttctaatgaaacactgttttagatgtatctcttgcacatgacactaattgcattttattttgtgactccaggagttgtttctaaaaagtaagattactgggtcaaaaataaagaaagcttttgtagctcttaaccctcatgaccaaataaattgtttttcacaggttggaccactttagcttgtcaccagccatttagaagcaagccatttccccacccctgccagcacgactattatagtcctgcttaaatttttaataggttaaaatgggacctcactgttcttttatttgctttccttggcttcatcaaattttactttaacgtattttaactgggcccttgattgccacagctgcaagctctggcctcccaattccaggacctgtgctgatggagtcaggaaacatttgaatagcctcggtacagcttattctaccgccctccccaaccctcctgcccattctctcccatttcatcccacacaaacacacaaatctcaagagctcaacactaatccctcccagacctgggatctgggatgctacccactggactctcttgaatcacctctgctgcagttcatacccaggacactgggctcaggaaaccactcaggctcctgagctgtatgggggacctgcttttcctgtccctagggcttggggctcaccacacacatctgtgatgtccctaaattattagaggggctctagatctactggccaatttgctaaggtgctttgcctctgtctctctgggttcccggtcccaccctaggcacctcctccaccttcctgc

SEQ ID NO: 479034 - DNA, 3376 bp, Homo sapiens
ctcggaccaatgccagttttaggagagaaacagcgagctgcagagttcctgtcagaaactggactccatggccatccccaagtctcagcagggagcatgtgtggttgaagcctgggtccagggacccagggacggcgctgcagcgaagccaccctgctcaccctggctgtacggcacgcagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagaatacgaacgggccatttctggggccctgtcacctacatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctgatcatggagccagtatttttctgacgggggcctgggtggtctgggggtgctgacatgttagaaaatgcgccctgttttcccctctggagcctggtggtgccccctttc

SEQ ID NO: 479035 - DNA, 424 bp, Homo sapiens
ctactgtcttatggaaactgcctgggacttgcacctgacttcctccagttgtgttaatttaatctctcaccaagctccagacacaatctggcaccatgaagggcaaatagaaggcttctgtagctgtagctgtacgtcagtgtttcaggcttttgtccgccttgcagctcttcccactttgaccatgatttcatggctgtttagtatctggtcttcaactcattcctctctggatgcttctgtattcctgaaaagcaggctctcagagactgagctgtttgacatcagctgccagatgtttgaatgtggagaaaagggccagagggatgtgacagagttgaaaaaggaagttccaaggtgcagcctgcatgtcgatgtttggtatgacaaggacatgtgagtgggatctgactgaaggtgagtt

SEQ ID NO: 479036 - DNA, 676 bp, Homo sapiens
gggcactggctccgagagctgatagatgtgggtgagttttctgcaacgtgtctgcttcctcttcgccttctgccatgattgtaagtttcctgaggcttccctagtcatgcttcctgtacagccctcagaactggctggagaacatatggaaaacttcctgaatgaacagtgcatcaaaggatgggaaggattttggagcaaggccctgccatcttctgcagataactactgtccttttgagagatacctcttggcctgttactgggctttggtggaaactgaacgtttgactatgggcactacccgaaagtggatagctgcagcaccacagcccctttctaggaaattcctgaaggacggtggtgaaaaggaatctttccagtgggcagaacttcaagaagtgcacctggttgtgcactttgcatggaaagagaaatggacagatgtgcgattatatactgactcatgggctgtagccaataaccatcaataaccattggctggatggtcagggacttggaagaagcatgattggaaaattggtgacaaagaaatgtgaggaggagggacctactacttcagaaattcgtatcaaattatgcacaaaacagtatgaactgaatattgagttaatgctcttgagtgtctattaagtatacctgagtgcagatgtatc

SEQ ID NO: 479037 - DNA, 704 bp, Homo sapiens
tcggatataagaagtaaaataaaaatgatatgtcaagaaaagcagagaaaagtttcaaaaggactgaaggaattgacaatatcaaatccagcaacagcatttccccaaagatgcacagagaaaatgagttacagcttctatttttgtcccgtgctggatacttcctgccctgaaacatcagactccaatttcttcagcttttggactcttggacctgcacaagtggttcgccagggtgtctcaggccttcggccacagactgaaggctgcactgttggcttccctacttatgaggttttgggactcggactggcctccttgctcctctgcttgcagatggcctattgttttgcacgtggatacccacttgttccagcaccatttgttaaaaagacaagtttttcttcattgtattgcctgtggccttttgtgaaataccagttgactatgcaggcatacctcagagatattgttggtttggttctagagcactccaacaaagtgaatactgcaataaactattgtaaaaggggttgagttcttcatttgattctctgcttggtcgctgttggtgtatagaagagctactgatttgtgtacattaattttgtatctggaaacttgtatctggaaactggataattcttttatcagttctaggagctttctggaggaggttttacggttttcaaggtgagacagaa

SEQ ID NO: 479038 - DNA, 879 bp, Homo sapiens
tccctgacacctccagttccagccttgctaaggacatgctgtatcgtaagaaatgaataaccgacactacatcatcacctgcaatggtgggaaaatctatgacatcaattgccaaagtgtttttgtggcaagaaagtttggagtgaatgaaggagaaaggaaaaaaagacacaagggaaataaacacttttttcctgttccatttttgactttgaagttctaccataagaacacaatgagtaattcctcttacacttttgttaggttctgcgaagtcaggtgcaatggtagcaaagacccaggaatggcaagttgccactgtggcttgggccccaggggcaggaagcagcacagtgctgactctactacctggagaggcaagatgtatcagcatctcagactgcacaggactagtccaattccaggtaggtggaatactgtggctgttaggcctggaggacagtccagccaaggctctgatcttctaggacatgaggagttacatctgattgaccccagaaagtgtgcctacacagaaataagctggtttccttctgatccagaaaataaacttcaggtctccttaggaatgtactgtgggaagggaagatcctggtgggataaaagataatttggcatcacatatttaactgtcaccctaaatgaatctgatgtatgtgaatattcaaagacaataatttgagaaatactaaaaacagtgatcaaaaaagcacttccagctctaaaattatagttctgtaatacaaagcagcaacaatgtgactaatatattaatttgtattttatattctttcatcaaggattagcatgctaataagattccaaaaagggcaaagatgttactaaattattttaaaa

SEQ ID NO: 479039 - DNA, 655 bp, Homo sapiens
tccgtttattcccctctagggcctgtacatgggttgattaacatgtgcctttccttaaatcaccgccatggtttgcaggtgaaaggcaaacaccatgaacccattttccaagaaaagaagccaggatctccaggaaggtggatctcccagagagagattcaggtggaagagacagatccctgtggcaccaccctagacaccaagtttcgctcagtggcctgtcccctgaatcttgccagagcgagaggccctagggaattagtcgagaaactacaacaagagccaaatccatttggggcctcgtctctcaattataaggaaaaaacaagcctgtgtttaaagatacagcagctgcagttgaaaattgttgaacttggttgctccaacgagcttcttccagatcttcagtgtaatagacacagccaatctggattgaggactggagtctacaccgccgtgaaccactggagttgtcagatgaaggtggatgatgtggtaatacccttgtgattattactcatccttgattgagtttacaggaaatttgtttatgggaggtctagggtattgcaacaaatttattgctatcctatttattatgcagataatgaatatgtcagtgtgtattgagtctaaactcattgccaagagtttc

SEQ ID NO: 479040 - DNA, 774 bp, Homo sapiens
ccaacttggtacagacaagaacctggtgccgatcagatccatgatgagccatcagcgtcactccggactgatcacgtcacgtcatagaggcacaacctgccaaatgttctcatcttcaaaagtaaatatcatcaccatcatttcattgtgtatgttagaaacccaggcatcattcttaatttttttttcctcttttagcaatctcctgcatccaaaccataatcaatataacagatatatcagatacgtgtcatcacttccaaaatacatcttctttccactcctttccattgtcactgccagtaccttaagtggactgccatcatctcttgctagacttacaatagtcacccctgacagtctagaaaaatttagtcctagaaattctgatttaacccagaagaacttgaagaggcaggacacgcttgacccaaaagcttgtcttcaagaatgtaattggaaaagttacacagtggagagacctccaattaaataacgagccaatgctgtctttcatctttctggctccagtggtggtctaaataaatcatttctaaacaaatatgttttaaaaccttttactctatttaaaatgataggcttgactaaagatttgtaactcagatttccttgagggaggaaacttggcattcaaactagtgagagggagtgatggttattcattagtattacttgctccttattttttaaagtgccttatttccaaacagaattatagaagagcaaacaaaagcctgaagtaagttcagggct

SEQ ID NO: 479041 - DNA, 518 bp, Homo sapiens
gtacatcttcagtccagacctctcccacagacaactcctgagaggttcttggtcttgctaacttcaagaatgaagccgcggacactcgcggcggcgcgtctggagttgttcgttctttccagtggcttcgtggtcttgctggcctcaggagtgaagctgcagaccttcacggaccccttcagccgccgctgcactgtaggggcccctctctgggctggccgaggccagatctggctccctctgcttgcagggaggtgtggagggagaggcgcgggcaggaactggggctgcacgcagcaattgcggccagcgcgagttccaggtgggcgagggctcagcgggccccgcactcagagcctctggccagtgccaccggccccaggcagtgaggggcttagcacccggccagcagctgcggagggtgcgccaggtcccccagcactgctggcctgcccacaccccactcgaattctcactgggcctcagccacctccccgcggggcagggctctgaacatg

SEQ ID NO: 479042 - DNA, 1103 bp, Homo sapiens
ttgagttccgtttcttgaggttacatcattcgaatccaccaccttcttgtggagatccagaagtgccctttcaaatacctggagctgggcagcgggagtggcagtcatgttggtgcaatgtggccttgccccagtgtcatctgattggaccggaaagagacatctgactcaggctggccaattagatcatctatcccaagaatttttcactggagagaaaggatgcaaatctcatgatagctcactatcacaagaacagccccgaggggatagtgctaaagcattcagaggtcgcattcccaatggtgcagatacaagatggtgtaacccatatcaacctgtttccatgaatgtctgtgtggagcccaatgcccattcacccacactggcaatgataaggaaactaaactggattaagtgctatcatcttggaggtgcaaaggcaaacaaggagaaagaagtgattgaagagcacttcagaaagcttggtacattcaaatcagcagggcttgattactcgcatcccaggacacttaaggaattggcaaatataattgcaagaccaccagcctttattttagaaaatgaaggttggacagaagaaggtcctgacaagtaaaatcagcagatggagtacctgttttttaaaagagggaaaaggacagctgtagtaattatagactattcagtttatcttggatacctgggaagatacaagagcaaatcatcaaacaatcaatttgcaaccacctagaagagtacaagctactgggtcgtaatcaacgtgattttgtgaagtgcaaattatgccacaccaatttaattttatctatgatagagtgatgagcctggcagaagaggggaaagcaatatctacaactggacttcaataaggtttttaattttcatttttttatttaaaatattccatttcctggctttttcagcatcaatcttctgagaggatgctacttgaacagcagttggccttgttattccaacttatgtaaaatatgagcatatcataaaagagcagtatttattttaaaagttttgggtgagagagcctctttacaactagaaaactaaaagcagaaatgttt

SEQ ID NO: 479043 - DNA, 552 bp, Homo sapiens
aaaatatcccaaagatgtcagctgacaaatttagtacatcttttacccgacattagggctaagtagtattctatgtgggtacatgtgctgctttgttacatgggtatattacttgatgctgaggtgtggggtataaatgatcccgtcacccagagagtgaacatagtaaccaacaggaagtttttcagccctttccccatcccttccaccctccttgtggagtccccagtgtctattgctcccatcttgatgtccatgagtacccagtgttcagctccctcttacagggaaatgatgtatgaactcttgaagaagaaacagaagtgcaatgggctgaatagtgagagaaggcagtgtatgcagaaaatgcaacgtggaaacgtaaaaaggtttgaagagcatgatatagggtggaatagcaaatcacttggtgccactatgactcagtgtgtagaatgggtatgacttgaaatggaatggaaattgttgacagaggtgaaatgatgaggacacgataaatttgaggctagaaattcagcatcaaggtgtcag

SEQ ID NO: 479044 - DNA, 587 bp, Homo sapiens
gtttttttcttgctgattcgagttccctgtagattctgcataatgtctgttttgctattggaagattttcaggaacaagcaagtaaaaaagccatattatttacagatgtgtgttaccaaaaagaaaacaagaaagcagagtactcaaaccagaaagacatttgtctttataccaaaaagcacttctcagaaaaggcaaaagactttaatgatctaaggagaaatgtaaagtcttttattaaggaggtgcttataaccaaaccaaatcctaaatcccaaattacaaccctactgaataccaacaaaaagtatctaccaaaaagagaaaggcttagcctgagagaagactcaccagggcaaaaaaatgagccatggaaacagagaggtcaaagcgttcaagtgtttactgcataccagttccaagtgttgggagcaggccccccaaaatctagccataaactggccataaacaaaatctctgcagcactgtgacatgttcatgatggccatgatgcccacgctggaaggttgtgggtttactctctaaaaggaaatgattttaattccagaacaggacattgcaatcc

SEQ ID NO: 479045 - DNA, 1244 bp, Homo sapiens
gaagagctcctcaagcacggccagagtgggcgctgaggccgaggaggcaccgagagcgagcgagggctgtgagggctccactccagccatgcccaaaaggggccaacatacagctctggctgtggcttcagagactgggagccccataccatggcaccttccacgaggtgttgagcatgggggtatacagaagtcaagaattgaagtttgggaacctccacctagatttcaaaagacgtatgaaaatacctggatgcccagacaaaagtttgctgcagtgatggggccgtcatggagaacctctgctaaggcagtgagtaagggaaatgtggggtcggagccctcacacagagtccctactggggaaccacctagtggaactatgagaagaggcccatggtccttcagaccccagaatggtagacccactgacagcttgcaccatgtgcctggaaaagctgcagacactcaatgtcagcccatgaaagcagccaggagggaggctgtacactgcaaagctgcaacagcagagctgcccaagaccatgggaaaccacctcttgcatcagcatatcctggatgtgagacatggagtcaaaggagattattttggagctttaaagtttgactgccccactggatttcagacttgcatgggccctgtagacgatactccttgttcatatccatcctgtttttaacctctctgtgaaatttcttgagatgacaccttactattttcagtgcaaactaaatggacctctctatgattgcaccctataatcaggttaaactttaagggagaaaaaaaaaaaggaagccactctctagtacaaatattctctgcctcttgtttgaaacatttattttataacatgaaaaaacaaatgacaaagaaaagttataagaagtttactttgtataaacataggatggtctctagtgggaaatccatttctactttaagaatgtaaatgaggaaaatgtcattcgtcgagaatacttacagggaaaaaaaatacggactgtaaaagtacactgatgtttaaatcctgcatctattcaatgctagctggatgatcacagggttaaaataatcttacctaatcatgtctgtactcaatttccatatctttaaaaaatacaaatgtactctattttatatgcatacttaatggaataactaaaatagcattattagcaattaatttccaaaacagaccttcatgaaatgcttattatgtt

SEQ ID NO: 479046 - DNA, 674 bp, Homo sapiens
ttggttcatgggcaggcctggaaaaagcaccatttgatcggctgaaagacatcaaggaagttctcactctgggtggtggattctacctggaactggcagccgggttttcaggcttcaagctgtctttggcttgaaggggagcttcacacctctggcacctctgacacctctagcactttcacacctccggcaccttcacacctctggcacctctccacctctggcacctctccatgcacctcacatctttgctgctgtgtctaaccccttctggtgcttcaaattctgaattcttcctcctcagctcagcacaaatgctctgctctcctcagatttcaactttcggtgccatcattgaaaaatttctattcttccacaataaaagtgacaaagaaaaaaaagatgcaaatatacatggagaaacaattgttcataattctagagttggatttattattattaactctcccaagcaaactgtgaaagtgcatttttgtgatccagagaactgttatatgataaaaacagtgaaacagaaggagaattctgatatccttgtgatggcattactcggaaagttggacatagcttcggtgactccaattacaggctgtattatgaaggctggcacaacgccatgcgagaaaaggctcaaagaagaaagataagtcatc

SEQ ID NO: 479047 - DNA, 620 bp, Homo sapiens
gctgcaggggtggagccctcatgaagaacttctactagggcaatgcagagaagaaatgtggtgttggaggccccacacagaatccccactggggcatggccaagtggagctgtgaggagagggccactatgttgcagaccctgcaatagcagatccattgacagtttgcactgtgcacttggaaaagttgcaggcattcaatgccaccacatcaaagcagctgcaggagctgtaccctgtagagccatagggttggagctgactaaggccttgggggtccacatcttgcatcagtgtgctctggatcaagctgcttcctttgcagtagatcagatatttctgctagaggctctagaaggagcagcaaagccacagatttctatcatgccctcattgatattacctaatacctcattttactatttaggaatctgggaagatcgactgacttggctgtaaaacccttagttccagggaagactggggctttaaaaaccatttcctcttatgcttttaaaatacatttccctttctggaatagtcatgatgagatggtatgctttcatttcaacacattatttcttttttcttgctttaaatgcagcatggatagcagtata

SEQ ID NO: 479048 - DNA, 677 bp, Homo sapiens
ggcatccaggaaaaatgtcgcacaaactaattgaaggatgataaatgcaggggatcttgttgccaatgaaagtggctctgagcaggatggggagctgtaaagggaatggggcagtacgtgcatacttggctgacaaccatgacataagagctgctcaaagtaaggcaatcccaaagggaaatgtggagttggagtccctacacaaagtccccatttgtgcactgcctcgtggagctatgggaaggcagctgccaccctacagacaccagaagggtagattcagcagtagtttgttccctgcatctgataaagctgcaggcactcaactcaaacttgtgacagcagccatgggagctgtaccctgcaaatccacagaagcagagctgctgaagatcttgggagcccaccccttgcaccagtgtgccttggatgagggacataatgagtattttggagctttcatatttaattaattttctgctggacttcagacttgcctggggtctgttatccctttcttttgaccaagttcttccttgtgggatgataatatttaaccaatgcctatataggcattgtgtcttagaagtaaataactcagttctttaactcacaggtggaagaaactcatctccagttaaaactttggatgttagacttgaggctggaaaaagtta

SEQ ID NO: 479049 - DNA, 1339 bp, Homo sapiens
caggacagtgggtgcagcgcaccgagcaccagccgaagcagggcgaggcatcgcctgaccagggaagcacaaggggtcagggaattccctttcctagtcaaagaaaggggtgacagacggcacctggaaaatcgggtcactcccaccctaatactgcacttttccaatggtcagcaaatggcacaccaggagattatatcctgcgcctggctcagtgggtcctacgcccatggagccttgctcattgctagcacagcagtctgagatcatactgcaaggtggcagccaggctaggggagggggcgcctgccattgccaaggcttgagtaggtaaacgaagcggacaggaagctcgaactgggtggagcccaccgcagctcaaggaggcctgcctgcctctgtagattccacctctgggacaacaaggcatagccaaacaaaaggcagcaaaatctctgcagacttaaatgtccctgtctgacagctttgaagagagtagtggttctcccagcacacagctggagctctgagaacagagagactgcctccttaagtgggtccctgacccccgagtagcctaactgggaggcacaccccagtaggggcagactgacacctcacatgcccaggtactcctctgagacaaaacttccagaggaacgatcaggcagcaacatttgctgttcaccaatatccgctgttctgcagcctctgctgctgatacccaggcaaacagggtctggagtggacctccagcaaactccgacagacctgcagctgagggtcctgactgttagaaggaaaactaacaaagagaaaggacatccacaccaaaaccccatctacgaatggctaactagaataaccaatgcagagaagtccttcaaggacctgatggagctgaaaaccatggcacgaggactacgtgacgaatgcacaagcctcagtagccagaaaaaaaaaaggaaactcatggcagttcaacctctaaggattgccatgacttcaggaatatttattagaggcttctttggataattaaaaatcgagtctttttgtttatgagtcatcagaaatgagaaattattaggctgtctatgccataaaagatctttagtttgaccttgaaatataacttcttttacttagggagggcaggaggcaaataagcagaacttactgaccttaggagagcctgccaacttgccagactgttaatgtttacactgagattaggtccccactgatgagcgacacttgcgaaaaggcaaggctttctaacctcagcagcaacacctgaacaacaggtcaagaaaatgccaagtgccttaatgttgct

SEQ ID NO: 479050 - DNA, 2857 bp, Homo sapiens
gactatagtactcctattgtgctatcaaataagtctctctctctctctctctctctgttctgagccacctaaactgggggcagagtgacacaagcacccctgtggccaccaccactataactgtgctgggacagcactgagttcagtgcctcataattgctgtgctctccctctgccagcagccagacatgctctctacaacaggccacctctgcagggggtggacatactgctcatctgcaagtttctctccttcctacagggctgcctgcttctcagctgtgagaagataaacgatatgatggtcatagacaggaaaggaggaatttactataggaaagttggagatcctgttgctgacacccactggggtgctggtagagatgagaagtggccggatgtcagggagagacaagacttcagaagagagaggaagagaggcagcttgacttcaggggagagtgaccttcccttttcatcccctttccagctcccctatccactgagagaaactttcatcaccaataaaattctatgcattcaccatccttcaattcatccatgtgacctcattcctcttgggcaccagacaagaattcaggatgcacaatgtacaagtaaccaaaaaggctgtcaccctggccctttgcccttgctggtggaagttgtagaagatttacatttccgaggtgtagggaaaatattttcaactgaaagtcatcgaaagtaaatgcactgagaaaagagagttcagaggcttatagctagaaagaagcctatctaatgtttagtcagggtgagggaagtgttaaggttgtcttggattaatcacatgtatttacttatgaaggtgagaatttcaaatatagtcctgaatcacattctgaaatgcattgtggtatgcaaagggaaaagacaaacacataactattacatattcttaaaaacaaagggaagaaagagcaacagaaaacatattaatgtgattttatagccgagatttttaaaacaagcatgatggaatgtaaagttatagtcctcataggaatcataactgggctgtaaggcaaatatatattaaggcataaatattagagtctatataataatagaaaatactacaaccagatatgccaagagactaaattataattggcatgggaaccatagatttggaacttcttactgcttagaatttaaattgctctgaaacactgaagtcatatgaagccgtccaggtatactaatagtactaatttgaggcaaatggtaatgatcaaattaattggtttgtgtcactctatcaatataggtatggccagtacttattgatccttttcaataatgtctctttctaagactctgttaaggtattttatgggaatgattaaaacaaaaggcaaaaaattaagtattattcaagaaagaatgtattaaataaaataatgctactattgagttctcatgtaaaataacattcctttaatatttcaaagtcaccagaagtcaagtcaaatcaatgcatgagtgaagagagaaaatggtaaggttagggcaatatttttgccaaactttgttctggaagttcttattaaaataaaaaaatgacctaaattatctttctatgtattctatttaaacatttgttttcctttgaattgggagggaaactgcaagtcaaattagggagaagtgctgtcatgctgatggagacaataccaaagatttatctacttagacaaatgaaatcagagtctgtagatctgaaatgttttgatgcctctgcagaaatacaaaaagttgtaaacaaatgctattttactgtagtcaaatttggtgccgttttctagaggctcctgattgtcaaaagttagctttatcaaatcagttccacggatttcaagagactgaaaaataaggttattacagaaagtgtagattgcacagttaagactgacttttagatgacaatgaataatttttagtataaatatatcctgaatattctttctatatatgtgtatgtgtattttacatatattccttcttttatctatgtatcaactaagtattatctatctattctatcaacaaaataaccaataacagcttctggatattatttttctttaatatattgtttgacctaatgggccaaactgattttcattttgagtatttatattttcaaatagttcattcataaatagtcattttaaggctatatctacagaaaaaataaagagatatacttcatacagatatctggaggctgttaaaatactgaatgaaagcaataggctaggcaataaaatcgtgaaattatccaaggagtcttagccacaacaactaaacaaggacataggcatatctttatggagctgtttgaaaatggaagattggcttattctatttcaaagatgtttgcaaatgagttactttgcaaatagaaatatctggaggatgattcaatagagccactaaagcaagtaacttctagttttgttagtaagttttgaaaatattactggcttgtgtcatgcccttatatactacattctgtccttcttctgattttaagattggatttgagcatcggaaaatatttacccccacatgtacatttttaaatctcatttcatatttcattttcctcatttctacaatgttgaccataacacttatatgacagagttcttatgcacactaacagtataaaataaattcaagtctttataaattggtaagaatacattaacatgaactgttactattttctccttggtaaggatttaaacaaatggaagctttcatgaccaatctgccaagtattcaaaaaaaatgtaaatgtcaataa

SEQ ID NO: 479051 - DNA, 605 bp, Homo sapiens
ccgagcttcaggtaaatcttatgatggaaggccaagatattttaactaaattatccacctccctgactattcctggaatgcagccacatctcatagctactcctctatccaattccaatcctcccttgcaacctcccctttcatctccccacctcaaccctaaagtatgggatactttcactccttcacttgcaactgaccattcaccccttatcatcccattaaaacataaccacccctatcctgctcaacgccaatacccaatcccacaacaggctttaaggggcctaaagcctgttattacccatctagtacagcatggcctcttagtttctaccaactccctttacaactctcccatcctacctgtccaaaaaccagataagtcctacaggctagtccaagaccttcatcttattaatcagattgtcctccccatccatcctgttgtgccaagtccttgtactctcctatcctcaatactcccttccacaactcactattctgttattgacctcaaagatgccttctttaccatccccttacatccctcccaaacaacttctttacttcctagaaaaattcagcaaaaactcccctgatat

SEQ ID NO: 479052 - DNA, 868 bp, Homo sapiens
gacttttatgcaagagttgctcaggccaggacctccagtaccatactgaattgaaatgggtgagtgcagtttgaagtccctgctagtgccaaggagaaagaggaagagggtgggaatgttgaaagctgtcaatagccaaacatcaaaaatgaattcaggctatttattacatttactaggacaactggggatgagtcatttctgtgtgcttggagccattaggaacagcttggctggctgtcggctgcacacctccatagagcaccattttcacagggcaccattttcacagttgcaacatggaggtcctgtgtgtgcttctcccacttttcctatgtgcaactataataaatgtcttattttaaaaatctgggtctgtggacttcatttccaaaactttgccaatgtttatgaatttaaaccatttagataggaagactttattattgatccaaactagtgtattttattatgattgtggtacattttcagagatggtaaaacagatcactaacatttatcagacttttacttgcaaagtagatttcagttcacaaaataaaattaaatgtatgcacatatttgtcactcccttctgtcacctcatttacaaatgagggaaatgaacctcaggaaggtgaagaggctagctcatgatcacataaccaagttgctccgagtcagacttaggactagaaggatatcaagtcaatgttgaaataatatttatattaatcatgatgactagaagccccatgtggcagaaagctcttagggaggtgagttatctttgataagtaaagtgggaaaataaatttatcatttctttaatttgtataattactgaatgtaatacatgaaggacaga

SEQ ID NO: 479053 - DNA, 754 bp, Homo sapiens
tatgataaggtgattctaaaacctggatgcacattagagtcacctggggagttggaaaaaaactccatggccaggttgcaccaattaaatcagaatctcaacagctgatttttaaagctctccaggtgattacaatatggtttgagaccctcagaggtagagagcccttgagagacagcaaggatataatggtggatgggagagggaaagtaggaaaggaccagctcatggagggatatcgtcataatcaaaggtccttcgacttgtccatgagtgaaatttctggcttttggcagagcttcagtctcgtgggcatgggtatcttgaagccctttcactactggctctttcctctacctcacaagagcctggggagcattaggcagccatatgtgtctctggatgattctctggctgacaataacttcatgagtttcaggctcaagaacagaagttttggtgatcagggaatatttgattcaacaagaaagtccctgaagtgttccctagaagcaggtcccataacaggattccttgcaaatgacttattaaggaaagaatcatgggagactgggcttcagcagcattaacacctatgaaaagctgacatcaaaaaaccaaaatactccaaattctataggctttaaaaaagaacttcattataatttacatatcataaaattcactcatttttactgtacaagcaatgatttataatacctaggagtgtaattgctgaatcttacaggaagtc

SEQ ID NO: 479054 - DNA, 1281 bp, Homo sapiens
ctactcagcaatgggcggatggtcaagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggag

SEQ ID NO: 479055 - DNA, 689 bp, Homo sapiens
aatcagaatctcagctctcctatgaatcacctggatgaccatgggagcaaaagtatgagaagaggaggaagaggaagaggaagagggggaggaggagggggaggaggaggaggaggaggagaagaagaaggagaagaaggagaagaaggagaagaaggaggaggagaagaagaaagaagaaagaagaaggagaagaagaagaagaagaagaagaagaagaagaagaagaagaagcagaagaagaagcagaagcagcagaagaagcagcagaagaagaagcagcagaagaagcagcagaagaagcagcagcagaagaagcagcagcagaagaagaaggaagaagaaggaagaagaaggaagaagaaagaagagaagaagaagaagaagcagaagcagaagcagcagaagaagcagcagaagcagcagaagaagcagcagaagcagcagcagcagaagaagcagcagcagaagaaggaagaagacggaagaagaaggaagaagaaagaagaggagaagaaggagaaggagaagagaaggaggaggaggaggaggagaaggagaaggagaaggagaaggagaaggagaaggagaagaagaagaagaagaagaatttccttggtaggtagtccctggtggtggggcaggcagttagcatcagattgccaatgtggcaatccagactgaagact

SEQ ID NO: 479056 - DNA, 988 bp, Homo sapiens
tcaccactctattttctgtctgtatgaatctgaagactacatatacctcatgtcgctcttctgtagggctgctgtggtttgctgggagttcacttcaggccctattcatctgttttgctcccaggcctggagatgtcactcaaggaggctggagaacagcaaagatgagtgcctgctccttcttttgggatctttgacctcgaggggcaccaactttatgctagtaggatcagtcctatctagggcatcttacaaccctgttggagggtctcacccagtttggtggcaggggaacaggacctgtttaataaagcactttgactgtctctttgtggagggggtgtgcttcactcagggggaacccactagtctgggctgcctggctttctcagaactaccaggagaaaaggctaagtctgctagtcagcagagactgtggccacccctgcccctaggggatcaggcccagggagatcagggtcctgtccctgagcctctggctggagttgttggagttcctgcagggaggccctgcctagcagttatgtgttccagtgctggctgctgctcctcccgcaaggagctcaaatggcttagacagcaggcagagtctgttgagaatctgcgtggctccagggttgggaacctaggccctggtggcatggaagctgacttctcatgggcatccgggacaaggagcatttgcctattattaatgcttgtgactaaaagtactgctatcagagtccacagacatttcgggaacaaaaggtctccttccaggagtgatcaggacacttttgagatgtccttgagttgtgccttggaaaaccagaggcagcaaccacaaatctatttgtctgttttgcgatgttgaatttgtgacttgactgttttgtttttaactgctttgtctttaaaatcaatcaggaaaactcattttatgctgccccaagtggtgggagaaattttagatcacatatgtatt

SEQ ID NO: 479057 - DNA, 563 bp, Homo sapiens
ctgaatatctccttaggattaattcctagaagtagatttattatgtcaaaaacgatgacagttctaaagaccttttacacatattgccaaataactttccaggaatactgcctatttatatctggaatatttgacccacctataactggccgaatttctgcattaggaacttgctattattggagcatccattcttttcccactgatttgaaatgtcacttttatcgccttgtgtttataactctaagatcaggctgctgccattcatacaccacaaacctctttaccacggttttctataaggttgtgagtgaactggaacagtggcctttaacacatggacaagttaaggagagggcagataactgcagggggggttggcatggtgcaagtggcatccccatgacagctagggaagtgaactgctcagactgcacttccaaagaaacaaaaaagcaaaacttagctgtgagaagcacaattaactggcagctctttcagggcagcccctagctactgagcatggtgacaacaccagaatctggcagttttgtccactgact

SEQ ID NO: 479058 - DNA, 621 bp, Homo sapiens
aggaaaaccagagacctttgttcacttgtttatctgctgaccttccctccactattattatgatggaggcagaaaccaaagtgctgcagctgcaagccacagaacgccaaggatcgttggaaaagcaccagaagctagaaagagatgaggaagaattctcccaaatctcagagggaatacagccctatcaacaccttgattttgaatttcaagccaccagaaatgtgaaaatggggcaaagtgaggagcagttaccagaatcacctggggaaaagccacccttcagaagcaatgaccctgtatcaagtgcactgccaaactcaaagaggaataaattccctaacttcactctcctccctcaaacctatctcctgcagagatgccccaggaagccaattgcggtagtcctacagatcagccttcttggggctaatttctgggtgaagaaggagacaaaaataatactggggtaacagttgtagcaggaaacttttaatattacaactgtacagcatattttaaaatattttcacattttcttacaactgttgtaaattataactaaaatgaccttaccatgctttcaaacaacatgtatagagtatccacattgtgctagct

SEQ ID NO: 479059 - DNA, 617 bp, Homo sapiens
acatacctaggtgtggaatggctggaccccatgatattggcccagtgaccctcacggcggaccccacagtgtttcagagggagctgagagaactctacgtgcagggaggtggtgactgcccggagatgagtgtgggggccattaaggctgccgtggaggttgccaaccccggatccttcatctacgtcttttcggatgcccgcgccaaagactatcacaagaaggaagagctgctgcggctcctgcagctcaagcaatcacagggtttggaagacctgtcggatcccttgcttctggcttttgcagtggtctttgtgctgacgggggactgtggcgaccgcacccatcctggctacctggcttatgaggagatcgctgccaccagctctgggcaggtgttccacctggacaagcagcaagtgacagagaacatcctagaacaagcttgtaacagcagttacgacacagtagcgggtgtcactcctctgggtaattgtcgactggtgctttgctcagtgatgcttccctcctgacccctgacaaggcctggcccgggggaaggggacggtggtaacggacctgcttctttgctgttggaggagttgcctcacatgttc

SEQ ID NO: 479060 - DNA, 678 bp, Homo sapiens
gccggtcagaggcacaggacaagggtctggggaatgagttctgagtgtctacagcttcatgggtggttgacagcttgcaactggggcttttatgagcaaatgcacgtcaaatgcttagaacaaaacttggtgcttagtaaacatcaaaacaatggtaacatcactattaccaccatcatcatcaccaccaccaccatcatcatcaccaccaccaccaccatcatcatcaccaccaccaccatcatcatcatcaccaccaccatcatcatcaccaccaccatcatcatcaccaccaccaccatcatcatcatcaccaccaccatcatcatcatcaccaccaccaccaccatcatcatcatcaccaccaccatcatcatcaccaccaccatcatcatcaccaccaccaccatcatcatcatcaccaccaccatcatcatcatcaccaccaccaccaccatcatcatcaccaccaccacgatcatcaccaccaccaccatcatcatcaccaccaccacgatcatcaccaccaccatcatcattaccaccaccaccaccaccatcatcatcatcaccaccaccactatcatcattgcagtatagtcagtggcaaagggaacaggcattggaatgaaacgtttgtggatctggacattgtacaaggttgaaaagtgttcttcc

SEQ ID NO: 479061 - DNA, 960 bp, Homo sapiens
cacaggggcttctggggcaaatctctccatctttgctgtttaatacagaggaaatggtgctaatggtggaaatgacccgcctcgggcgcccagcaggcggacccgccgcgcgcccctatccctcgcgcactggccgcggcccgacggagcaaggcactgcctgcagccgccgtgtgcaccggggcggccggctagctccgacctgcgcctccaccgcagcacccgcagccagagccgcgctcggcatgatgcccggggcgccgctcctgcggctgctgaccgcggtctctgcggcagtggcagtggcagtggccggggcgcccgggacggtaatgccccccaccacgggggacgccaccctggccttcgtcttcgacgtcaccggctccatgtgggacgaactgatgcaggtgatcgatggcgcctcgcgcattctggaacgcagtctgagccgccgcagccaggccatcgccaactacgcgctggtgcccttccacgacccaggtagcgcccccgcacccccgcccgccgggcgcccccttcgaggctcatcttaggtatttcctgcctcagtccttgaattcgctatttctccaaggagccctgcttcctgtgattggaaaccaggatatccgtgctaagtgtgtttgttggtactgaggtgctgttacttctaaaacctcccttagctgacagggcaaggagttgtatgttgtatatataacctgtgtttgtacttgtatctatacatagttttatatgtaatcatccgtgtctatattaagctaaacatgagttcatgctgatatcttcaactctaatttatattcgatattggattagatgtattaggtatatggagagtcaaacctcttcctgttccttatctagaacctccacgtctaacagtcagaaatctgtctcctgccacccaccatccctttactttactgtttagtt

SEQ ID NO: 479062 - DNA, 625 bp, Homo sapiens
tggtctgtagcgtgctggatagaaatggttttgttacattctcctggaatgagggatcctatggggcacatgccctgtgtggctgaaaaacagtggagcccattgaaggagagggatatgaagactgtccagactgggggatgcgaggatgccctccagtcggcctcccggagtctccggagccgtccgagcgctggggccgctggcgcggacttcaaagcccgccgcccccagccagatccgccgggcgcagacctcggggaggcccggcgcgtccccgctgggcaagtccctgcagggcagcgaccgggaacggagggctggggacgccacgaggccgcgccgcagggcgggggaggcctgaacccagactgggggcttcggacccgcctgcgctgggaggtgagtccaggctgggaatttggaaagcagacactgacataacgtggggtgcaggcgcaggagtagtatcacccccgctttacagacccagaaacggacaccgagaggttgcgaagccagacaaggggcagagctgggtattgacgcagatttttggggccccagagacttgaggtttagccactgcctctggggtgagaggggcagggcacttactgtgtgt

SEQ ID NO: 479063 - DNA, 1164 bp, Homo sapiens
gggtgcgtatgtaatggctgcctgcagggctggtaggggcgggagcctgccgcagcctcgagcaggctgagatctcctggggcccttgccaagggagcctctcaagcgcctctgaggttactgagccgtgctgcgctcctgtgtccactgcgtgcgctcgtcgcagctgcgcctgggcctcttttctaaagccccgcggagggaatcggagcaagcgcagcggcgccagtggggagagggccgggccagggccgcccaggagggccgagcgccgccagtgccgagatgcccgggccgccgtccagctccgatcgcctgccgcgttcctggcaaccgcgcgcggcttcccggcggaggcggggcccgcggagaggttacatctgcaccaagtgcctgggcgcagccggcccggagggcagtgatgtggggttcgggtgggggaagatagggggccctggagggggcgcgagggcggccggcgagccgggcggggagagggaggaaaggctgcggcggcggcgcggtccgggccccggaaacattcctccgaggggcgcccccgcccgagcttctgggaacgagcccgcctggagcggtcgcgtgggctctgacacgggcaggagggctgccacttgcgcccaccccctccttccctcgcggtccgccgggtccgcccagctctcgtgggattgggctggtgtcttctgcacccaatcaggtggtgtgggcaccgcactgcgtcactcccctgctcccggaccatctgcggctccctattaccacctctacattctggtttacagccttgagtagggcccagcaccgcggacacttgacactgaatgagtgtcattttgcaaactgtacaaatgatcattcaatacatatccctgctccaggctttcttgcctagatacatttccttcttgatttaattatattatttcatgtcaaaaatttcattaggattatatagtttttacagacaatggttgtggcagagttgctggttgtcccccaatatccactcttcctgtcttgcaaagtaataaaattttttatctggacatgtggtagacccgataagaactatatttcccagcctcctttggagctagctatggattatgggatgtaagaggagtgatacagtgtgtgtgactt

SEQ ID NO: 479064 - DNA, 931 bp, Homo sapiens
ccggagcaaggaaacgggcgctgggtctgtgacagccgcagttgccccaggatggctgggcagggtcggctcctgcctggatggctgacgtctccttccagttctttgttcagtttccagggggaccggggatggggaaaggcaggcagcacagcccgcggacctgcagggccacagcagagaggcgctgcttcacgtccccctgggcctccgtggccctggccctgcacacagcacggctgcctcctccctccgacttatttccggtcacctggctgcaaagcacaggatacccagatggcttgggccaggttgaaggcacagccatagccagcaaccagccacccgagccctgctgccttcggccccagctggcccagccagcgcgggtccctgctgcctggtgcccaccccacccacccggcagctccgattttcagcttggggctttctatgccctgtcactgaagggctgaagcgctctcactgtttaaagcctccatgttttcccttccaaccctcagaaggacaggagcgattattcttattctgttgtcaagggccacacagcaggttggaagcagatgtggaggctgcccagttccagaccagcttgtcctgctagtgcctggtcccaggactggctcaggtgcccatggcatgctcccctgtgccctgataatcgatgtccttttgcagggtggtgaggctctgagagtgagctagtggcttgttctttttccacatttttgaggcctctatcttggggctgaaatacccaggtggagaagtgagtgactccggaaaggaaggaaagaaaagaacccagagtctaattcccacccaagtggaggtggggcactcactacctacacagctgccctgactattggatagttcatcttgaggcaaaacctacctcccttggtag

SEQ ID NO: 479065 - DNA, 638 bp, Homo sapiens
ccaggcacccagcaggcacttaggatctccctggggcagagcaggctgtggctgggcccacctgaaacccacccctccggaggaatgacaaccttcaccattaatgagcagacaaaatgtgccatgggacaggctcaggcagagccagtctccctggcagcgtccttcctgcacatcccctcactctccacccccacctcccagagggagggggatttccaggctggggataaggtgcagggcgctcagcttgccctggtcaggctctctggagaggaggaaacacacaacacaggcccgtccccactcttctggccgcctcctcacagcagcctgggagcattccctccacagcagacagggaggcggctgagagccgtgggggtcattagctggtacaagggcacgcaactcgccaggagccagacactggctctccccctctgcccagcagacccccaaggttggttaaggttcactgaaacactgctgagcaccacatacgcaggcaagggcatcccccaggggcttgggcatctggacaaacatcaggccctgggtgccaagagtcagcatgtagagccactatcctgtggccggaggtcatgtgtttgtcccctctagcactgggcaaagac

SEQ ID NO: 479066 - DNA, 617 bp, Homo sapiens
agcaggaatgttttgaaaattgttagtgatgcttaaaaccatggacatagacaagatcaccaaggaagaatatacagagttagaatggaaaagtaaagagccttatttagatgccctggagatgcccatttacagatttagaggccaagttgtgaaagcaaagagaaagtccttgaaggaaattcaaagtgttactctagggaacacagaaatgataagaaagcaaaacagccttaatgctgatatggagaaattttcagtggtctggggagaagatcaaaccagccacaacattccctcaggctcaaacctaatcaagaacaaagtcttaactctcttcaattctgtgaaggctgagaaagtacaaggtgaagcaacaaattctgatgtagaagctgcagcaaattatccagaagatctagttaagatcattgctaaagaatgtagagaagtgaaaagtacttaacattcactcttaattgtttgaatggtcaatagggaatttaattttatagaaggtatttttaaaaatcattcaacctgacaaaatcatagtcaaaggatggaaggagggatggagatacagaaatatattatttaagttatatttataaaga

SEQ ID NO: 479067 - DNA, 722 bp, Homo sapiens
gctgatacaccaccacagagctgcctcgccatgccatatgtatgcctgctggcacgccagtctggacagctggcctagtggtgtccctgccactatatacctgccctggtcaccccaggacaaggtactggacaactaaggacaacccctatgttccagagttcactaagattattcaaattaaccaacccatgaagaacctgcaaaacctagccagtcctaccccacttgccatacataagtggctcattacagtttcagcttgctgtttccctgcactgaggtgcaacactgcacaactctgcctgacatatttctctggcttggagctgaaggtaacaaaaaattctacctttaatacgtctgagtgtgactgtattgtgtcccaccatcaaaatacctttaaatcttataaaataatagatgatatccttatccccagttgtcacacaactttggtcaatcaggtgcatctttatgcattctaacaagttttattacccatagcaaccgtatttctttatgaattctctattaaaaatacttggcacattttttagagagagctttctgtttcttgaattataactattcaaagggaattgtctgctgaatgtttgtgggtggcttagtttgtagcacgagtagccacataggtattgctcatttctccagtaaaacatatgtcattttatggctttggttattacctcttccttaga

SEQ ID NO: 479068 - DNA, 595 bp, Homo sapiens
agactggagtacagtgaaaagccaaaaacagggaaagatgagctacccagatataattcatctgcaggaagctgctgtttgtactcctaaaactggaggtagagaaggagaaggaaatgattataccagagtccagaagccaggctcaccagggggaacgaaaaccccagtgaaggagattcccaggagaccaccagatgagccacatagaagagaccaccaggagttgtgtgggacccagagtaaactccacctctggaacagtgtcatcacatggactccaagcagtttcctataccagtttcagaaaacacaagggctgaggggtcctcccatggctataattgcaggagtccatggctacaagccccatgtaagtccgaaacccaacagggcactcattacatctcaaagctttaaagtaatctcttttgactccatgtcccacatccaggccacactgatgcaaggggtgggcttccaaggccttgggcaggtctgtccctgagctttgcagggtaaaatcactataattgcttttgtgggctaatgttgagtgcctgcagcttttctaggcacatggtgcaagccgtca

SEQ ID NO: 479069 - DNA, 2382 bp, Homo sapiens
cacagctgatgagtcgtctgagagcttggagcccccacccacaaggccacccctgagcccagccatcccctccctcgggaacaaagggagtctcgggccatggccgacagggctgagaaacagctgcatgctgcccagctgtggatgaagaagcggcgttttcctgtatgtaatgtgctgtatgtaaataaaacactggaaagggctctttctttgcacgcgacacagacagcagcctgcaacgggcccagctgggctctgctgagaaagcagaggcggctccacgctcaccgtgacagccgggagaggacctcacgccgtttgtcccttcatccctcgctgggcctggagcccaggaagggctctcaggatgggggtcttctctcacaggcctggctgcccgtggacaacagtggggccctccccagcacttgcctggcctgggggagagtggccagcggggcgggcctcgaggggggactgggaggtgtccttgggctgaaaggcaggactcttgtcaggaggagccctgcttccattgacataacagctggggaagtgtcaccaaactcacaaacaagccaacaccaaaaaggttaagccatgtgggggagggcgaacagagggcgaggagtggcacctcagagccgctcagcccctcggcttctctctcgttctagccagatgccttcaaaggtcgttggctaagtaagcattgggactcccatttcctcctgcacggcagcaacagagattccaggactgctccggagaagggccggctccctcctttcctgcagactggctcccagcctctcccccagggcctcccacagccctctgcgggaattacctgcaggtaaagcagcctctatgtgtcctctcctccctgagaatctcgggcctttgccatggccctggtaacacacaactactacgtacgctggggccctattatcctattggccaattatcctatcggccacattagattggccacctgtaactgagttactttccctgacaacggaggaatggggagccccgggtaggctgtcccaaggaggcgcaggctttcagctcctatacccttcaggtcaggagaactggagggagaatgaaggaatgaaggcagccattcccaatgtctgtggatggctttgggccgtctcatcattcccatttcgctgatgagaaaacggaggctgagagcgcccagataacctccttgatgggactgaatgcatccggcccggggactcctaacctcagctgctctggagaatgcccccagcccaacccaggctgctcctggaccacatatatcagtatcctggggtgcagcctgggcaccagcattttgtaatgctcccaggtgaggggcatcctgggccactgacgacccctcatcctcaccctcctcaggccaggggcactccctgtaccatctgaaaagaaaatcatagctgagagataactcacctcacacacaattttgcaagagtcaatataacgccctgttatatggaggaggaattaaagggaaattgtatgataaaatcatatgtttttcaatatgtaaaggcctggctctgtctccaaggggagcccagaagcccccccgaggcatgcctgtgtcatcttatccccgtgccagcccccatggctgatgcggacgggccaggcctggcgttccagactccagcagctgagcatgtacctgtgatgtgactttcccaggtggtcaagttccaaacgcagcaacgtgtcctcccttcaatggacacaggagatgctttcctggaaaagccagcgaggattaactgtgcagcaaagatccccaggatatattttctaaggttctagctcaggtaattataagcagcctctttgcttacctgaacgtctggcaagaccagggacagagttacctgcagggctggcctgtgtatttactgaaggtcattgtgacaactcaaaacagcccttcctgaagttccaaaatgccccttgggaggggagccacctagtgttcagccattttgatgtgtcctggtgacaacagacactctggggacaggaggagcttgcaggagggttacttgctgcagggcctggtgggccacccatgtaaagcttgcagccatcagtgtctggagggctggagaggggtcagggtggcagggacatcccacagagaggccagggtgggaccagtgtgaggagagaggcagaaatgatgttttaatgcaatgttttaaataaagttaatgcaaaatgaatgcaagatatctatgaggaaggaaatattgaagttttggaggaaaagggtcggtggtcctgacgttcccttttgccccaggctctggggccaggcagggc

SEQ ID NO: 479070 - DNA, 563 bp, Homo sapiens
ctcatccagaatgatgtttgaccaaatgcctgggcacaccgtaacccattcaggttgtcaccctggaccccctgttgcggagccccttctggaccagtgcgcctgggaaatgctgagccagttccagcctagcacacagagcacagatgggcccctgtgctcctcagactctggaagggagttgcttgagcctggtacacctggaggcccaggaggaaggccatgggtgcaaggggcaatgcctgggccaccagtctccgggggagacagggaaatcaatgccgagggtgaggaggtctctcccagagaggatttctctcagttttacagggaagaaatggaggcgagggagcgaggacacttccccaggctgtacggccaggaaggggccaagaggggctcccactgggggcagggtgtggggggtcttccttaactctactcttatttcacaagccccaggggctctttcaggccacggggtacatttgtttgcacggcagcagccagcctcacccaggtgcggcaaggagaggcagggcaggggtgaaggaggggcccag

SEQ ID NO: 479071 - DNA, 2033 bp, Homo sapiens
tgccttgccccgcagagtcccaaggaaagactctgacagaggctccagagaggtggtgacagagggtgaccgcatggaccataaacgaagaacggctttaggggagatggcgggaagtgaaggcacagggttggtgccccacagtgagggtgattgccatgagggtgatgatgatggtgatgatgaccatggtggcgatgatggtggtgatgatggtgctggtaaggaagatggtggtaatgatgttgatggtggtgatcaccatgttggtggtgatgatgatgttgatggtgatgatagtggtgatgatgttgatggtagtgatgatggtgatgatggtggtaatgatgttgatggtggtggtgatgatggtggtaatgatgtttatggtggtgatgatggtggtaatgatgttgatggtggtgatggtgatggtggtggtaatgatgttgatggtggtggtgatgatggtggtggtaatgatgttgatggtggtgatggtggtgatggtgatggtgatgatgatagatgtgatgatggtggtaatgatgttgatgctggtggtggtgatggtgatgatgttgatggtagtgatgatggtgatgatggtgatgatgttaatggtggtggtgatgatgatggtgatgatggtgatgatgttaatggtggtggtgatgatgatgttaatggtagtggtgatgatgatgttgatggtgatgatgttaatggtggtggtgatgatgatggtgatgatggtgatgatgttaatggtggtggtgatgatgatgttaatggtagtggtgatgatgatgttgatggtgatgatgttaatggtggtgatgatgatgatgatgttgatggtgatgatgatggtgcacctgcaccacggatggctgcaccacggcacctgcaccacagggacacatgccacaggagcagacaccacaagagcagacaccacaggagcagacaccatgggaacccacaccatgggagcagataccgtgggaacccacatcatgggaacagacaccacgggagcccacaccatggaacagacaccactggagccaatgccatgggagcagacaccactggagcccacaccatggaacagacaccatgggagccaatgccacgggagcagacaccacaggagcccacaccatgggagcagacaccacgggagcccacaccatggaacagacaccactggaaccaatgccacgggagcagacaccacgggagcccacaccatgggagcagacaccacgggagcccacaccatggaacagacaccatgggagccaatgccacgggagaagacaccacgggagcccacaccatgggagcagacaccacaggagccaatgccacgggagcagacaccatcgtgggaacccacaccatgggagcagacaccatgggagcagagaccaagggagcagacaccaccggagcagacaccatgggaacccacaccatgggagcagacaccaccggagcagacaccatgggaacccacaccatgggagcagacaccatgggagcagacaccacgggagcagacaccaagggagcagacaccaccggagcagacacaatgggagcagagaccatgagcgcccacaccagtggtgtccaatgtggctccccactcccaatcttgggagctgctgctcactgagccattgatctccctctatgatacatcaaagccgaacagggtgataataccattgtatagtcttatgaccagtgtagaagagttccagttgctctatatcctccctaccatgtggaatagtcagcctttgattttagccatttcagtgggtgggtggtgatatcccatggtggttttaatttccatttccataatgagtaataacgttgagtgttttctgtgtgcttatcggccgttcatatatcttcctctgtgaaatgtatgttcaaatctcttgactgtttaaaaattggttggtcttcctacaattgtgctttaaaagttctttatatattctagataaaag

SEQ ID NO: 479072 - DNA, 1142 bp, Homo sapiens
gcctttctcaactttctcaaagtgtccatgtggccactctgtgacagcaggaatccataccccacccagccagctcacagcaggaatccatacccccccaccccagccagctcacagcaggaatccataccgccccctccagccagctcacagcaggaatccatactcccccaccccagccagctcacagcaggaatccataaccccccaccccagccagctcacagcaggaatccatacccccccaacccagccagctcacagcaggaatctataccccccacccagccagctcacagcaggaatccataccccccacccagccagctcacagcaggaatccataccccccccagccagctcacagcaggaatccatacccccccaccccagccagctcacagaaggaatccacacccccccgcagccagctcacagcaggaatccatacccccgccagccagctcagaacagccctgggtccctgttgggatggacttctctaaaacggccctggacccacccagaagatcagggacaagtctatcagtaccaggacagtctggaagtttttggccatgcttaaattagttaaggctggggcctggccacgggcaagcttgcctttcgcacaactgctggactccctgctgagcatgaccacgggccatggggctgagatggcaggtggaacctgggggatgctggcttcctttcctgagcgtgtacagccctcagctgttcctacagccctgagcttcagcatcgcagggcagagacatggggctggggccctggggttacttccagggttgggtggtctctgtcactcccgggcaggaggagacagtgatgacgggaaggagagttctggaagtaagaccccagctgatgacggaggcagcggctggccttcggaggacctcacctttctcttcccctgcactgctttgggtttggggtgtgcagggccagccagctgactgctaccagggcagacgctgtcagtggtgactgccctgcaggcctgcaaacattttgccagagggccagacccaggagcagaggggtcctcttctcttcctcctcctcccctcctgtcctctcctctcccctccctcctatcctttctcttcctctcc

SEQ ID NO: 479073 - DNA, 1058 bp, Homo sapiens
tccctcatggcttggtgctgtatttgtgataaggggagcccactaccctgaaaaatgagtcttaggcccaagaagcatccaccacaagttgacttaggagagccttcggccttaaaggaacctctgtggtcgtctggcagtattcctcataaccgagggtggcagcagctacagaacatagcaccacctgaggttggttcagcagaattgagactcatggcaaattctgatagggctgaccacagagatagcactacttccagcagctggtggaataagtcttggtatcctgacgtgggatctgagagaagtagcactgtattcatattcactacaaacactgtggccgttggcgaagatgggccaagacatcacaccttctcttggagacaaagactaaattacaaattcttccacctggactttcagttgtgggagcttcaagtttcagaagtaacttccaagacccacgagagggagctcatgcacttcttaggcactactggttagctttttaatatcttattcaaaacaggcagtagtttgggaggaatgaccaagaacagcttggaagtcagaagcaagatggaatcaagtatgtcaaatttcccttactgtcgtaattctgcaaagacaatttcagtagtagttcttgtgtgtgtatgtgacttttctaaattgattatataaagtctgtattctttgtcatgtgtaaacctgaagtctctgctttgttagcttagttttttttctattattaatatattgttttagtgtgatacatttgtcacagttgataaccaataatgacatattaactaaagttcataatttacaatagagttaactttttgtgttttgtatatctatgggttttgactaatgtatattattttttgaattgctgattcagtgttctctcataccccccaatacttatttgaatatatttaattcagtttgaagtgttgtattacacatctcttcttcagcattttggggggaagagtgaggagaaacttttatcaactaactttgtttaattctcattttctgtt

SEQ ID NO: 479074 - DNA, 1532 bp, Homo sapiens
gaagaaagggacaaattccccactggtcagcaagccgtccccagtatggatccccactgggaccttgactcagatcatggggactggagtcgtaaacatctgttgacctgtgttctagaagaactaaggagaattaggaaaaagtccatgaattattcaatgatgagaaagctccaaaagcaagccctgggccctgaacaaaatttggaggcattattaaacctggcaaccttggtgttctataatacggacgaagaggaacaggcccaaaaggaaaagcaagatcagagaaaggccgcagctttactcatggccctcagacaaacaaaccttggtagttcagagaggacagaaaatggagcaggccaatcacccggcagggcttgttatcagtgtggtttacaaggacactttaaaaaagattgtccaatgagaaacaagctgccccctcgttcatggcaagtgccaggtcatgtcatcaccctcactgagccccaggtacgtttaaccattgagggccaggaaattgacttcctcctggacactggtgtggccttctcagtgttaatctcctgtcctggacgactgtcctcaaggtctgttaccatccgagaaatcctgggacagcctgtaaccaggtgtttctcccacctcctcagttgtaattgtgagactttgctcttttcacgtgcctttcttgttatgcctgaaagtcccacacccttattagggagagatgtattagccaagactggagctattatctacatgaatatggggaacaagttacccatttgttgtcccctacttgaagagggaatcaaccctgaagtctgggcattggaaggacaatttggaagggcaaaaaatgcctgcccagtccaaatcaggctaaaagaccccactacttttccttatcaaaggcaatatctcttaaggcctgaagctcataaaggattacaggatattgttaaacatttaaaagttcaaggcttagtaaggaaatgcagcagtccctgcaacaccccaattctagaggtacaaaaactgaatggtcattggagtctagtgcaagatcttagactcatcaatgaggcaataattcctctatatccagttgtacccaacccctataccttgctctctcaactaccagaggaagcagaatggttcactcttctggacctcaaggatgcctccttctgtattcccctgcactctgactcccagtttctctttgcctttgaggatcccagagaccacacctcccaacttacgtggatggtcttgccccaagcatttagggatagccctcacctgtttggtcaggcactggcccgagatctaggccacttctcatgtccaggcactctggtccttcagtatgtggatgatttacttttggctaccagtttggaagcctcgtaccagccggctacactagatctcttgagctttctagctaatcaaaggtacaaggtgtctaggtggaaggcccagctttgcctatagcaggtcaaatatctaggcct

SEQ ID NO: 479075 - DNA, 1006 bp, Homo sapiens
ttttttttttatatttctgtgggggtctgcaagcaaaggagttatggtgttggctgttgggtggtgccttggttgtgtatctgaagctgtgctgcaagtggatgtggccagacaggaaccttgggagaaatcagcagacaggggggatgctcagatcggactggtaccacctcacaggcaagatagctttgttctacctgggtacaactgccaacaaaggccaaagctacctagaggagtgttaacttggaaatgtagaacaagaaacaaaaatcaacagaaaaaaggaaaaggcgagtgtaggaatccatgctttcttattgtggagaatagctttagcaatcaagatctgggaagcagcatctgcagagttggtcctggaggcttgggtgagggaaaccacagctgtgaagctttgctcctgctcctagcacagatgccaaagcagatggaagggcagggatcatctgcagaaagacttcagatctccaacatgagtaaagagtgaaaagcatagcgggcattgctgaaatggctagattgataggctctacactcccaggagcagcagaggcaacaaactctccccactctgtgcctcagacagaaacatgatgaatggtgtgtgtgtagtcatcttcaatccttttacagcttgtgcttctttattccaacaggccctcatttggtgctttgcctggaaattgttctgatgctgtttatgtttcaaatgcttagaaaaacagttctattaaggttgtatgccaaaacacaggctagtctgaataacaggaaggatggagtaaatttgggtctgctaatctgcaaaagaaaatattaaatatgctctctctggagaacagtaacaaacactttgcatgtggctgtgctaaatttactgcaggaactataagtgttaaaatgccagccgtgtaaatgggccatggggtggtaaaaggttgacaggatgattatgcttgaggggccactgttacgtatgtccttc

SEQ ID NO: 479076 - DNA, 779 bp, Homo sapiens
ttgctctgtctcatctgagattagtgcccttataaaaagagatatgagagggcttgcttcttttggctttcctccatgtgggaatataagggaaaagcagccatctgcaaaccaggaagccagccttcaccagacactagatctactgacaccttcatcttggacttcccagcctccagaactgtgtggtcacataagctacccaatgtatggtgtatctgttttagctgctcaatctaacacacatggaggaaagcggacaggacacaagccctctcatatctctttttataagggcatgaatctcattcctagggttccaccctcatgtcctaattacctcccaaaggctccacctataaataccatcattttaatgattaaacttcaacatactaacttgatttggggagttttgctgacttgtgaaaacaatgaaaaatttgagaaagccaggttggatggaatttatgggaaagaatatgaagtgatacagaagtaaagagagaaagaagagcaaactacggcagaggcgaacctgtgagtcactgctgaacactgaactgagccaacatattagaaaactacatgtaaagaagatttaagagaaattacttcaaagaggatttataaggaccccagtcttacattgtacttcatcttccatctctctgcaactgctagtgctaatgtgaacttgtgttagggaatttggctttttcaaatttgcaagctctaaatcaacagcctctcttggtcaaagtggatttcaggctgcc

SEQ ID NO: 479077 - DNA, 824 bp, Homo sapiens
acagcttcacacaaagaacaacgcctgcctagtcaaaagtaggcttttaaaaaatatttgctgaaaaatggtccacatttgtttaaatatgagagggcttgcttcttttggctttcctccatgtgggaatataagggaaaagcagccatctgcaaaccaggaagccagccttcaccagacactagatctactgacaccttcatcttggacttcccagcctccagaactgtgtggtcacataagctacccaatgtatggtgtatctgttttagctgctcaatctaacacacatggaggaaagcggacaggacacaagccctctcatatctctttttataagggcatgaatctcattcctagggttccaccctcatgtcctaattacctcccaaaggctccacctataaataccatcattttaatgattaaacttcaacatactaacttgatttggggagttttgctgacttgtgaaaacaatgaaaaatttgagaaagccaggttggatggaatttatgggaaagaatatgaagtgatacagaagtaaagagagaaagaagagcaaactacggcagaggcgaacctgtgagtcactgctgaacactgaactgagccaacatattagaaaactacatgtaaagaagatttaagagaaattacttcaaagaggatttataaggaccccagtcttacattgtacttcatcttccatctctctgcaactgctagtgctaatgtgaacttgtgttagggaatttggctttttcaaatttgcaagctctaaatcaacagcctctcttggtcaaagtggatttcaggctgcc

SEQ ID NO: 479078 - DNA, 1749 bp, Homo sapiens
gccatcagttaaggcaggaaccggccattttcacttcttttgtcattcttcagttgcttcaggccatctggatgcaggcttaggctcagaggcctgacacttcagagaggactcagaagaagacaagaagatgtggaaaagtttgggacttcctggagacttgttgaatggtctttgaccaaaatgatgatagtgatatgggcaatacaatcaatgctgagatggtctcagatggagatgagaacttggtgtcctgcgtcccagcctctccagccatagctaaaaagggaccaaggtacagctcctgccatggcttcaggggtgtaagccccaagcctttgcagcttccatgtgatatcgagacttctggtgcactgaagtcaagaattgaggtttgggaacctctgcctagatttcagaggctttatggaaatccctggatatctaagcagaagtttgctgcaggggtgggaccctcatggagaacttctgctagggcagtgaagaaggaaaatgtggggttggagcccacacacagagtccccaatgaggcactgcctagtggagctgtgagaagagggccattctcctccagaccccagaacggtagatccaccaacagcttatactgtgcacctaaaaaagctgcagacaatcagtgccagctcatgaaagcaaccagaagaggggggctgtaccctgcaaagacacaggggcagagctgcctgtggccatgggagctcacctctggcatcagtgaaatagaggatacaaactaagttaataatattttctcattttctccatgaaattaaaactttgtgatttgcaaatattgagatttttattttaaaaaatcaagattattgagatgttccaagatgcttatcacaccgtttacaattccaaaatctggataacctaacaagaataccatgtacaattgcggtaaacatgccaaaaagtaatataaaagcaaatatcaataatttcctcaaataagacatcacttttctttctaatttaccacacagcaatggattttagacattgcattcccagcataagaagttaatagcagctagaagttgtagatagctgaagacatgattgatagtctgtagaaaaattgaatgtgaatatttagagctcttacataaaaatatatcaaggtaatttttaaaatgtaatgatttaatgccaatagttatgcaataattttgtgtactaacaattacagacatgctatatgctatatcttacatttattcaaatacctctttagacctagaatctattagttagagctttggcctttgctttctaaaacatttacaactattcttcttactgattctctcaagtactttctccttaaatttcccaagctgtgtagcttgttaggaacactgaatatgaagcaaacaatgataaaaatatcagctaaagagctaaatacagacattcattcaagagattagtgtgaccacttagagagctgactttatttattcacttgtttatttactttttgtaaacattagtttatattctatgcatgatagaaacttaatgcacataaacaggatgttgttagttaataactaaatagatcaaccccacactaaaactttgattattaacctgtatttaactataataatgggttcttcacgcatcaggacctcttaatatatgaaaatcttcttgttgagccaagctaaattatgtactacttcttacgttttt

SEQ ID NO: 479079 - DNA, 530 bp, Homo sapiens
tatggatgcatggtgttggactggaagtcagttccacctgcggcccccgtttgtaaacacaccaatcagcaccctgtgtctagctcaaggtttgtaaatgcaccaatcagcactctgtatctagctaatccggtggggacttggagaacttttgtgtctagctcagggattgtaaacacaccaatcagcaccctgtcaaaacggaccaatcagctctctgtaaaacagaccaatcagctctctgtaaaatggaccaatcagcaggatgtgggagacattccagcagaaggcattattataatagaaggtgagagctccatgcatggttttgcacctgaagagcttctagtgggacaagatgtggacgtggaagacagtgatactgatgatcctgaccctttgactgtcacttttagcagaagtctccatggtgtgaggaagccccagcagcaggtatagaggtccacatggagaggatcacaaccaagctgagtggactttcagcatcactaagtcatgattgacttggc

SEQ ID NO: 479080 - DNA, 2019 bp, Homo sapiens
gtccctctcctgctgcagctcgtatccttgaagcagctgctccagatgggccatcgctgccgtatatctcctaatgctatccctccccctccccccaccccacgacgggccctggtgtgtgatgttccccttcctgtgtccaaatgttctcattcttcaattcccacctatgagaccctcagctgcaggtctgttggagtttgctggaggtccactccagaccctgtttgcctgggtatcagcagcagaggctgcagaacagcgaatattactgaacagcaaatgttgctgcctgatcgttcctctggaagcttcgtctcagagcagtacccggccatgtggagcttccaatctccaaatatacccgaagaaatctagtatttcctcacactggcccatgaatcagtctaccactagctcatttcttgccatttatcagaagtacaggaactctctggaatctgatacaagtaaatctaaatctacttactctccctctctgaactcaattgcctacggaaaatgaacatatttcatttatattcattttttcattaaaaacaattattccaaaattactaagaaattctgagtttgacagtgcatgcttacacatgggctaattgggttaaaacattaccaaaatagaatatgtaataaagggtaaatagacactgaggaaatccaaaagttaccattttagtaaacaatttacttccaatttcccatgtaggtatatagctatgaccattatgatatatttttacttaatgtttcaaggtattgatatttatagcagatcttgcatgatggcttctaggtttacttttctatatgaaattatgtgaagaaaaaaattaacatatagtgcaggcctttatgatccttttagttgtatctatgtctgtcctgctgaattcttgccttgactgagcccaaatggaagaatttattgcaaatagtggagatctttttggtttctgtcatcgattgtttttactgatagttttctctaagctttttcgtggaacctaccttcacaatttccttcaaagtttaatgaatttgctagatgttccagtaaaaagtatatagaacgagtagtattccctactcctttataggtatggccacccaactgaaaatgggtagggagcagtatagtaaggaaaataaatgcaggatgtcagagcattgagaagctctcggatattttagaatgttaaatatacaccatatattatatgaaatgagaatatatgaatcttttttgtttaaggaaagctagtttggaggaaacttgggaattcatttgaagctgagtcttccaccaagtactttagaactctaagggcactgcaggtttgcagtcagagctagtacttctttaagaatatatttgacagaaattgcaggaggatgagttgaaaacacagaactctgtcagttatttattttacatttagaaatcaaccttccaagcagaccagcttttgaaaatatttgtatcataaattatctcaagtgtcctatagttccttctagtagtgatgctttcaaagtcatttgttattcagaaatttcactgctgcattctattagcaataatttacatttgccagtgaaacctgaagggacaacttgacaccttgacatttaatgctgtggtgaggtgaagtaaattggtggtttcatactgcctgtgcactacaataatttatgcagcttttgcacatattgaacaataacattgaatccataaacaaaactaagaaacaatagtttggaggaactcagtcaataacatgtatcttattgagttattaccctgcaactaaaaatatattatattgccagatctatttctgtagtttcttccagactctggataatctgtgagtaatttcagcgtggatgtaaaagggctggtttgaccatcttaatgagtattttcaatgtatttaattgtagagtcctattttgcaaaggctttgcatctaaattgcatacaaaggttaa

SEQ ID NO: 479081 - DNA, 721 bp, Homo sapiens
taagattatatctgactgtggtttttattttcatttccctgaagattggggatgttcggcatgttttatataccttttggccacttatttcagatgtatggaaaggcatggatgcccaggcagaaacctgctgtaggggtgaagccctctcagaaaacctctattaaggcagtgcagagggaaaatctagggttggaggccccacgcagagtccccactggggtattgcctagtggagtcctgagaagagggccaccattctccagaccccagaatggtagagctaccagcagcttgcaccctgaatctgcaaaagctgcaagcactcaacacaagcccacaagagcagttacaggggttgaactttgcaaagccacaggggcggagctgccggagccaatcgcttgcacccacgtgccctggatgggagacatggattcgagtgagattattttggagcgttgagatttaatgactgccctgctgagtttcagacttatgaaggtaggaaataagaaaatgtgaatagataaaaataattttacaaaagggaaaattagcaaatatagtaaattatggtaatagaacagacttgtaaataatttagttagaaaaaatcataaatttgtttaactcttttctatataatttttgattatatcattagatatgtggaacacaagatgattggtcatatgaaaataaataaaatacaaaatga

SEQ ID NO: 479082 - DNA, 658 bp, Homo sapiens
ttctacacttcagctgttttggatgccttttatttatttttcttacctgtttgctctggctagaatttccaatgctttgccaaacagaagtaccaagaacaggcattctttcttaagctttaggtctttcaccattgaaaattatgttaattatggggttttcatatatggcttttattatgttgaagtggtttcttctattcctagtttgttgagtattttttatttgaaagaatgtcgaattttgttaaaagctgtttctgcatcaattgaacagatcatgtggctttttcctttcattttgttaatatatctgtttaaagttatgaatcacaaggaacaaaatatcaaatctgatacacttcgaagtctctgtcctgtttttacacaatcaatcaatagggtggtcatatctgcaaaagtaaaagccaattaggtgaagtggaaaaagaggagtctggttgttcattcaataacaggatttccaaaataatgtttggataatggaattgttttattctgtcatcatttctaacaagtagttttaacattaccaagcatacctgtgctttgccttatgttaacaaattaggctgatcagcagccagttgttggtcccacaatattcactggggtttggcaaagggacagccacctt

SEQ ID NO: 479083 - DNA, 454 bp, Homo sapiens
ggggcaccagttacaagacctgtgagctcctctacaaaaggttaatgtcattcttcactacaaagcattgtgaatggtccccagggctgtctttggtaaaggaagagaaggtcttgttaagtattaatgatcacagtggcaagttcacaatatcacctcctccctgggaaggaaaacatcacttcattgatatttatcaagggacttccactggggacaaagaggacggccatcattacgctcgctatgggcacagtagaaaagtagcaacggaaggcacttgtaaagctcaagctgccctgcagaggttccttcccagagtccaaatcctcactaacatcctccttaagcagcttagcataaagccggctctgagagtgttcctcccacccctagcctttctactcagcagtgcctgcctccccttcatctcagatctggaattacattagaa

SEQ ID NO: 479084 - DNA, 563 bp, Homo sapiens
taactggaaacaagattgtcatttctggtgtaacctgtaaatcaaatagtgtgcagtaattatggaagatggagcttgccagtgaaagaactctcatggtggctgttggcaagcaccttggctggtcagctgagcctgtgctgcaagtgggtgggaccaggcagggactggagatgggctggcagacaggagggtactcacatcagactggctgcatcccacaggccaagatggccctgttctgtccaggattccagagggtcacggtgagagtgagccactttacccgtttcatttataccttcgttagggctgcatggggccagaaatgtgccctggttctgggcaaccccatgcttccttccttggcaaccccatgcttccttccctttcagtcaagtttctgcaccctccctctgtccattctcaatgacttctttccaaaagatatgttcataatgtgccaatttacttaatggcctggcctctctcagtggaagaagctcttcttggctgcatctagttggctatcttggttcaagtcaccttttttgtctttctta

SEQ ID NO: 479085 - DNA, 629 bp, Homo sapiens
actgtttcatagaattcactgggatgggaaagccatctggaagttgttttattcgtgggaaggttttctttaatatctactcagactatgaaacaactttagtcccttcgtatcctggcttacaattggaatctcaggctcaactcctttcccttgttagtctaaggcttagctttctttctgcagtgtcctgcactcagggcactcataaatttgtggtggccccaatgctgggggcagcagggttgctaccagtggttggcacatcagccctggtgctggcagccagcagtggcaaaggcttttacaactgctccttgcagctttctccctatcaaaaagaagaaactccaattttcagcaaatatattcatgtggactggtatcttgtagtaattgttaatcacaacaggaggtgttatatcatgctcagagtgaccaaggcaagagacttagaaagagtctagtatttgtaattctagctttgtatccaagagagtgcccagctgtggataagatactctaatttgtatgcacaaaggtgtccataatagtctctgaagatcttttgtgtttctgtggaattggttgtagtttcatttttgtcatttctgattgtgcttatttgg

SEQ ID NO: 479086 - DNA, 578 bp, Homo sapiens
ttgtgcttctcaggcgaggtgatgccccaccctgctttgcctcacccccccgtgggcttcacccactctccaaccagtcccaatgagataaaccaggtggctgccatcggattctgggatgagagaaatcttgtaagcaaccagagctacaaagaaaggcagttaatggccagagatcagctgcagacaagaacaaagctttcaatggaaattttcaacaagtgggatcaagatcctgaagtatttcttcaaggaattgtaacaggagatgaaacatggctttaccagtacaatcctgaaggcaaagcacaatcaaatactccctctgccctaacgtgtgttttgttcttcaccccatttcctcaacctccatattcagtgccactgaaaccaaagaacccttctgaaaaaatgatgattctaactgaaggacagggatagggaagatacagagaagccatagcaggcatataccatttatagtacgctgtttctgtaagatcttcttctccatgactcgcgtgggtggataactttcctgcccagtaggtttactattttgaaagacaactgtgctt

SEQ ID NO: 479087 - DNA, 1073 bp, Homo sapiens
tttcatcagcggctgcagccatgccaatggtacgaggacaaggtgaccacacattaattgagtggctgatagcagccatacggactgtttggaatgatgccaaaaagataccagaaacagtgagtaaacggcaatcatatactgatttggtgcagatactccaggagatgggtatgtggcaggctatgtttgatctgaatacccggaggccaaatgatgaacgctttacctcccacatgagggatcttgtgctgggctcagtgccccagagagcttttggttctctagctgctgttctcaccccgtatgtgaggcgccatatacatgaagtgactaatgctatggcagccctcggggagacagaaaggcattggcaggacctgggaacccatgccataaagaaagggaaggtgccccctctgtgggtaaccaccccacaagatgagaaggaaccccagcagcggagggtaccagacaactggaggctctacgtggagctggcaatccactggtcccccactaatgtacagcaggtcctagcactggtagatactggtgcagactgcagtatagtttatggaaacccggataagtttctgggcaaagctgcatttattgacggttatgggggccagtcagtgaaggtgaaacctgtgtctctgcatcttggcgttggccacttggctccctgcctgtacactgtgtatgtttctcctatacctgaatatattctgggggtggacattttgcatagtctggacttacacactgcggttggagaattcagactaagaattcatgtattaaaactggtactgtgtggacattcgcatcaccagtcccaagttctgccacaaccctgatgggttacctccactcatcaataccatttgccagagataactgagactattaagaggttagaggaggtgcaaatagtgtgtggcacccatattccctacaattccccagtatggccagtcagaaagcctgatgggacttggcagatgacagtggattattgggaactgaaataagtaacaccccctccacgtgcagctggaccttccatc

SEQ ID NO: 479088 - DNA, 736 bp, Homo sapiens
aaactatcctttgacccatcctattggctcctaactggtggagtaattcttgttctctcagtggtgggcaggcttcctggaggaacccatacccaaaatgagtctcaagaatatgtatcctacatacatgactgcccacccctatagccctacccaaacacagatatgttgggcaaagtgtaggctgtggcctcagactcgtggttttgctgttgtctacatgactggtccctgtggaatcaaactggcaaagatcatagcattcttttgcaaggcctggtgccaccaggagacctctcctaaaagctttggctggtggaacagttctactgaggcccacgaagatatgctttggaagaggttatatggtgctttacaagaaagtgttttcccctctgtgaaaaaattttctattgtccatatccactgccctaccacctttctcattgtctgtgatttctcaaagatgacaaacagtggtcccacaatcacattagacaattcctttactccctacagaggataaccttgcttttccaaactttccaggtcattcctctgaaattaccttcccctattttttttttaaataagattcctccttttcaagagccagctggaaagcaaactctaaagttctatgtgtactgacatgcaaagatctccaacatatactgttaagtgcaaatagcatgtgcagaaaagtatgtataatgtactacatttttagtaaaaa

SEQ ID NO: 479089 - DNA, 638 bp, Homo sapiens
ttaatgtttgcgctttaaaatgagaggcgatggtttttcctcatcttcctggatttatctacctttggtctttgatgttggtgaccttcagatggggttcccgtgtggatgtcctttttgttgatgttgatgctattcctttctgtttgttagttttccttctaacagtcaggcccctctgctacagagctggcaggcaggaacatttaagtctactgaagctgcacccacagctgccccttcccccagatgctctgtcccagggagatggcagttttatctataagctcctgactggggctgctgcctttctttcagtgatgccctgcccagagaggaggaatttagagatgcagtctggctacagcagctttgccgagctgcgtgaagcaggaggttggtatggaaagaagtatgtagtaggaagatctgtggtggttcttgagccgaagaataacgtgaccaatatgggaagagataacagtagcacagtattcaatgtaaaggatggaaaggtgacccctgaagatttttcagtgactcatgtatgagatgatggaaacaggcctgggaggatggcagtgggagtgaagagggaaaccacaactgttgagactaaggatggaatactgtcatga

SEQ ID NO: 479090 - DNA, 514 bp, Homo sapiens
ggagaactgtgcttcttttggtgacataaacaaggagaaagggtataataagattgacttgctgccagtgccattatgatgtgtgaagtcaccaccctgacacataaaacctggaataattttgtgaaagcaggaacccttataagcaaatcctttctctccagtgctcagagcatgaaagtttcctgctgtctttggaaacttgtctgcaaacagctccaaggagacgcggtccaagggcccgccatccacggcgatgtcgaagaacacggcgggatgccttttatttatttaacttgccttatggctgtggctaggacttccagtactctgttgaacgtaaaaggtgtcaaaattattccaagcacatttttggaccacagtgcaatacaaatagaaatcaataccgagatctctcaaaattacacaactgcaaggaaattaaacaacttatccctgaataactcttgggttaacatcaaagttaaggaataaattttaaaattctgaaaat

SEQ ID NO: 479091 - DNA, 681 bp, Homo sapiens
ctattactaatgatgggtttttactttgcccgtggagagaaaatactggccaggagacaggtgaggcaactaaaattcagcgagagatccagacccattgggaaatcctctgagcagcctttgggttctcacactcctgccttgagctgtggctgttcctccattgaatgtggaggacttcttttccacagggactcacagatgcaggaaggtggaaggccaccaatagctctgccccaccctggtgaccagcagagcagggctgccactcaaagaagcccttgtgtttcagatgcagatgaaaggccggtgaccagagagagaaagcactggaaggggataaggtcttgtccacaactccttccctacctggtcctcctgttgtgctccagtgatggagcccactgctccatgaagtgcaaggatcaaaagaagtcatctgtatgaaagcactgtgaaaatgacagggttctgaacacctgcgaggcattagcattgttatggttgtaagcaaggatgataaactcggagaggaacactgtgttcttcagagggtcagcctccctacaaggctatcagtaaaattgcagatcatctttcagaagatccctagaatcagagcttgcagtgtttctgggatagacgtcaagactgggaaaaataggactctccatttcagga

SEQ ID NO: 479092 - DNA, 870 bp, Homo sapiens
tctccccagaagataacagcttccctgcctctttgtttacactgtgagcacagaactgcctactcaagcctcagcaatggtggacgcccctcctcctgccaagctccagcatccaaggtctttctcagactgctgctctagcagcgagcaaggctccgtgggtatgggacctgctgagccaggcaccagagggaatctcctggtctgcccattgcaaagaccatgggaaaagagcaacatttgggcagcagtgtactgctcctccaggaattcagagccagtgaatcaggctcagagaccccacagccaagaagtaaacccagatgctggatcactcacaggtattttgcttctgttgctcctgaaagcccagttacttcctgccattctctctggaaaggtggatgctgaatgtgaccttcttcgtcatggggcccatctcactggtggaaactggatcacatgtctggccttagtgttcaggctggcttggaacctgggtacaaaggtgcaaatctcaaagagaaaaaatcaccaaaatataagctgggagcccaaaagacgtagggtgtccatgattatgacaaatgaccactgcacatcagctgactgacctggagatcggctgactctgtcacactatcagaaagttgttcaacatgaagttagagaatgggaagctatgtatgacagtttttgttgttgttgttttttggttttttttgtagcattaagctctagtaacctgttgaattcactgccacaattcattcattgtacattatgtacaattcattgtacattgtacattacattgtacattgtacaattgtacattatgtacattcattgtacattatatacctaatc

SEQ ID NO: 479093 - DNA, 610 bp, Homo sapiens
ctagctcaggatgacttctgcaagaagcacacagtcagggtaccagacaaaacttttggtaacagttatttgtttttgcctctatttccttcctgcgcattttctcctaaactcacttcgattgtgtttttcttcctactattccatccaaactactcttgtgaagtcatcaatgccaaacttggatcaacatagcccattagatggaaccaattttgtccacattttattgtcctccagcccttcttcagagtgtgagacaagaggggctaaatttaaacagactgggcatccgcaaacattgcctgtgtataaagagctggatagtaaaccttttaggctttgtagacctacagtctctgtccaagctgttcagttgtgtcatttttgcacaaaagcagccatagacagtacattcacctattgctaaccttttatgctttttgctttatcatttgtgctcattcttttcttacatatgtatataaaatatttatattttatttcatatttattacatgtaatgtttttaatcctttaaagctaagttacatacctcaaagcctgtatttataaatacttcatgtatatgtacaggttttttaacaat

SEQ ID NO: 479094 - DNA, 1261 bp, Homo sapiens
aatactctcatgacaatggctgtgcagtggggagagggggaagcggggtgcactcactctggcagcactggcatggtaggaggcatgtgcatgtgtgtgctggtggagaagggaaggctaggacctctagtacacacatacactggcaaagtgatggggggagagggaatggttgtgggcaagtacctgcgggcaaggcagatggcggaggctgcagtgaggggagggcccaagtgggctgctgtgtgtttatgggcagctttgctggagcactctgctagtcaggactggtctgccagtgcagaagctacaatccagacctcaagaggtacctggggtctgccctgcaagcaggcacagccaggctggagccccaggagaggccagcagagcaagagctgcccaggtccaactgacctcatctcatgggtaagaccaccattcagagttcaggtctaacagttcacctagggctaaagtgtcctatgggagatcctagcaagaaacagaaagtatatttagagagcgttactgaagaaagtgtactgaagggattatttacagagatataggcagggttatgagaacacaataagggacagaatctggcaacaataatatacttttaccacctataggcctaaaggagctatgggagagaatgagcctggaaagagcgtgtagcctgaaagagggtcctcttataagaaagcattgcatccccaatgctccagctcagtgcctgacatatggtaggtactcaatgaatatttgctgaataaatcaatgaagtgaaaggcttagagagatagcagttttatatttaaaaacttgaaaatatcagcaattataacatcatatttacgtaactattttaagttaaaacacaagctgcttaaggttgtagtcccagatgtcaggaatatctttgtcctcagctattttttgcagaagatctgggtggggtgaagaagttgagatattattctaaatcaataagttcacaatgaaaagaattaaggaatttgtttttagttttatctagcttaatatttaatctttcaagatgcagccataaaaagcacaaaccctaaaaatttttaattgataacctgaacttcctgaaaattaaaatttattgattttcaaaagacacagttatggaaaaaaggacaacaatatttgaaaacatatatctgataaaaacttgtgttcagaatatataaagaacccttaaaatgcaatactaagaggacaaaaa

SEQ ID NO: 479095 - DNA, 607 bp, Homo sapiens
gaagagctagtcctgagcatagaggactcccagaagctgtacaagaagcatggtgtcagcatccatctgcttggcttctgttgagggcctcatgttgcctccattcctgatggaaggtggagggcaagatgggcttgaaaactgtcccaatgctatccaccttccagctgagaaagaaaagggctttagttcttcccctgtctgtgaagtctgcacgctggattcatgccctcccctgagttctggccaggaggcttctcaccccattcaaattgttataaaagcaaccagacaaaacccatcctctttgcctggagtttgttctctggcatgggaaacaaagtctctcatttggttccctctctgtgtttatatcactctggctgcttatctgttggacatctcaccaaaaaatacttcaagggatgggtggatatgggaagtaaaaaccaaattatttggttacatactttttaaaaaataagcttttctttttagaatagttttagatttacataaaagttgcaaaaacccaacctgaagccaaagggtgagggaacctgtttgatgtaatctctaaagattagccttctagggcatggaatac

SEQ ID NO: 479096 - DNA, 675 bp, Homo sapiens
agagacctgcagctgagggtcctgactgttaggaggaaaactaacaaacagaaaggacatccacaccaaaaccctatctgtacgtcaccatcatcaaagaccaaaggtagataaaaccacaaagatggggagaaaccagagcagaaaagctgaaaattctaaaaatcagagtgcctcttctcttccaaaggaacgcagctccttgccaggaatggaacaaagctggatagagaatgactttgacgagttgagagaagaaggcttcagaagatcggtaataacaaacttctctgagctaaaggaggatgttcgaacccatcgcaaagaagctaaaaaccttgaaaaaagattagatgaatggctaactagaataaacagcatagagaacaccttaaatgacctggtggagctgaaaaccatggcacgagaactatgtgacacatgcacaagcttcagtagccgatttgatcaactggaagaaagggtatcagtgattgaagaccaaatgaatgaaatgaagcaagaagagaagtttagagaaaaaagaaatttcatatcctgccaaactaagcttcataagtgaaggagaaataaaatcctttacagacaagcaaatgctgagagattttgtcaccacaagccttgccttacaagagttcctgaggaagcactaaa

SEQ ID NO: 479097 - DNA, 632 bp, Homo sapiens
ctgccaacacgactgtcattgcaagatggctgctgcagttctagctccagtcatcacttcaaagcaagaagaaggaaaaatagtttctgatgagaaatctgatgatattctaattgaggatctcttggagtacgtgtcttccggccagctctcttcctgcttctgctatcccgctcacgcacactgctggtgcaagtggccttgcgccttggcactgagcctgaggaggaaggagttattcatttccttaagctttcaggtcccagggagaatttttcactgggaacttagactcctaaattgtgatgagtcttttttgccaatgaaagaggcctcctcacccccagaagacgtggcctctccaactccagtagtatctgcctttccaccaatttttccacctccatctaagggcattaacccagcatttcctgagaaaatagtaatggcctgtcctgaggcagttgccatgcaagacaacactgtttctcctcagaatccaccccatcatccctctttgcttctagaactgtaattagactcaagtctcagcaggcccctaagggtgaagtagaaagtgtgacccatgaggagttgtactacactccaaaaaaaaaaaaaaggtattaata

SEQ ID NO: 479098 - DNA, 451 bp, Homo sapiens
tttgtgccagagtactgatgtaggtagactcagcatgccccttacccaaattatgtttcagaaaaatttgaaaccaccatattacacaacagttggagaatttggtcacatcagtcatgttgggcccagactggaaatatcagcagtacagcccacagagaaatgctgggaggactcagagttgacatggatgattcaagcacagggtgtagaaatttataaaaaaacagagagttcaaaagttcctgggcacaacagtaacatcttgggtgttcccctacacaagctctctcttccctgccttcatgtaagatgtgacttgctcctccttgttttcccccatgattgtgaggccttcgcaacatgtagaactgtgagtcaattaaatctcttttctaaaattaattacctcatcttggatatgtctttattagcaccatgagtacagact

SEQ ID NO: 479099 - DNA, 558 bp, Homo sapiens
ggtagttgataaaggagacaagagatgatggggaacatggtaggattagtgacttccatgagcatgagaccactgctgcacttctttagccaaaaagtgagtgccttggtcagaggcaatgctatgtggaataccatgatggtggataaggcattccatgagtccacggatggtagtctcagcagaagcattgcatgcaagataggaaatcctatatccagatttttgaccactcaaagaggtccatccacatacctcttccccagatgtcttcgtcaccaattttccaatcatgctgcttccaagtccctgaccatccagccaaaccattggctatggtccatgaatcagtatataatcacatacctggccatttcttcttccatgcaaagtgcaaaaccaggtgcactgctggaaattctgcccactgggaagatttcccttcactgctgtccttcagagatgtcctagaaaggggctgtaatgctgcagctgtccacttttgggtggtgcctgcatattgtgcagaaccatgtgtgaaccaggccctagtcttct

SEQ ID NO: 479100 - DNA, 809 bp, Homo sapiens
gcttcagtacgtagatgatcttcttatatctggtaaagatataaaggaagggatccaaacttaaaaagagagcacgcatgtttagatctgattgattaccatacaaaagttcgaccagacttaggagaaactcccttcaagagaggggggcacttattcatagatggctcctcctgcaacccgattgccatggactaaatgtcttcctattgctttgttaagaatccagactgccccttggagagatattggcctttccccttatgaaatgctctacggattgccctacttacactctgctgctgacatccctacatttgaaactaaagatcatttcctcaaaatctatacactttgtctatcctctatcttctcctgccttaagactaaaggtctcctagcacaggcgccacccctggagtttccagcacatcaacatcagcctggagactatgtcctcatcaaagggtggaaggaagggaaactcgaaccagcttgggaaggaccctacctagtgctcctaattactgagactacagtccggacagcggaaagaggatggacttatcacacccaagtcaaaaagacgctgccaccttcagaatcatgcactgtcactcctgggctcacccccaccaaactaactctaaaaagagattactaatcacttacttattttcttttcaacagaaggtcatcttgtcatcaatggtaactcaggctagccaacctttaacccttctgtttgacgtctgttcagtcatcccgtgcggagatgagcaagctcaaaggaaggtatcccatggtga

SEQ ID NO: 479101 - DNA, 1472 bp, Homo sapiens
tgaaggaggggcaggaaaagattttccgtctctcttcttacagcacccatctgctcttgcacgttgtttacttacttttatgcgagctcttagcatattcttcatagttgttttaaattcctggcctcacaatgttctaaattcctggcctgataatgttcctggtcctttaccagagggtcatgtgaccagcagtaactgtgaggcccggttttctgccacgatattccctccagactggctggtggcttttggtaccaaacaagtaactttcctttcccgtgaacttgtctgcagtcccaaacgacttaggtcagccacagtgacacgctggcaaaactgcaaagtgagtgatgcccacctcccctatcctctagctgctcaaggtcggcctttggggtcactgctgtataattctacttcttcccaaccatgcaaggatggcagaggcctccccctgcctcctagacctactaagacaaggcaatggctgtgggcttccccaccctcttggccccatcttctgaagaagaaataagaaagtactgttttcctggcctgcctacatcctggtaaggaaggtgccagaattcttgcggatctggaaaagctggcttcttccacctgccccaaacatctctaccaccccctgaggaaagcctgtcattttgacagctttgttcccttcacttgaggcttttagaagggtcaaatacccgctcgcccccctccccacgggggtgaggttaaatagcctgggaaggatagctcaacaaaagtgctattaattacttctactctagtataaatgagctttcagttcttccttgacagtgggttttgcagggtgagtgggggtactggaatctcatctgggaggatgggttcttggtgaggagtcttgcctgcttaatgatgtttctccaggttggccctttcccttactgagtaaacagtggcttgcactgatagggagactagaggaacagaacactcctcacccagagatcctatttccttttgaaaatggcctcaagcaacaagtctatgaggaaaatgttcaacttcattgatcaatgaaatgtaaattaaaaccacattcagctaccaatttccaacagtcaaattgacatgctacttcatgactagtgaaaatgtgcaattctggagggcagtttggccatatctatcataagcttttttaaaatgggcatagacaacagaaatgtattttacaaggatgtccagtatggtgatgtttatagaagtaaaaaattggaaatgatctaaatacctaataaaagatttcaaataaagtacagtagatctatactactgaactattattcagtcactaaaaatgatataggtaaatatttattgacaccagaaaatgcccatactgtattattatgtgaaagaagccagttataaaatagaatgttcccatttttgttaattataataataaa

SEQ ID NO: 479102 - DNA, 638 bp, Homo sapiens
cacccgagcccacacatcatcacccggcatcccaggctctgggcggctctgcccccatggctctgcagaatacagcccctgaggctgctttcatgggctggtgttgggtgcctgcagcttttccaggcctatggtgcaaactgttgatggatctaccattctggcatctggagaaaggtggtcctcttctcacagctgcactagacagtgtcctagtggggattctgtgtggaggcttcaaccctacgtcccagtaccagcttctcctggatattgaagatcctccattaagttttcctgcggaagacctcaaggccactcacaattgtggagctgcacctccttcctatgtctttggcacagcagtgattgctccattccttgctgggcgcttctctggaggcctgaggactgccccacaaacccctttgggaccagtgcttatgcctgcctctagggggcctgagtgtggacttacctggcccacctcaacaagctttgccctccctacctcagaagcagagtgcagaccactgagagttccacagcccattccatcccccaggacacccacatgcttctcctagttaacaaaggtcaagtgtaaaccctactgctgccacagcagctggctttca

SEQ ID NO: 479103 - DNA, 481 bp, Homo sapiens
catcactttaggcttgtataacaatgtttgaagtttacaaggaactttcttcaaagccaaatgttgtgcaatggtctctcacaagatataagacaaagaaaggaggtgaaaagggcaccaagagcctctcagattatatttggcaggaaaaacccttcacctgtccgtccatccagagattctgggcaggccacctgatgaagtccatgggcatgcttctagcaggagtctgcatgtgggctgacttgatacttggagattattttattacaattattccgtttgagctttatcttgaatcctggggtcttagcaccaaagcatcaaagctctcagggcccatagtgctcaacggttcctactgcaacacactgagggctggtctgcacggtcctctcatttgcggcttgtctctcctcctggttgcaggggaattttgccaaaagttgccatctattctctagggtactatacatctcct

SEQ ID NO: 479104 - DNA, 2444 bp, Homo sapiens
agccttatgtagacaacagttgcagggtggtatgccctccaagcatttccacaaaacacagtgccccatcttggagcacctcactaactccatgaagatgcatggccacaataatggcaagaaacccatgaccatgcacattgtcaagcatgcctttgagatcatccacctgctcatgaatgagaacactcttcgagtcctagtgaatgccatcatcaacagtggtccctgggaggactccacatgcattggaggcacttgtgaggcttccttccagaacatcaagaccattgctgagtgcctggaagatgagctcatcaatgccaccaggggctcctccaactcctatgtcatcaagaaggatgagctagagcatgtggccaagacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccacagcccctcagctttccagtttacctcctaccagccagaaaccccagcagcaaagagcctcttttgccagcaaaagtcttggggtcggcaccgattagctctgatcatgtccatccttgaagatggggagtggggacagtctctcctgaacctcgtcgactgagtttggtggagaggttatttcccaaagtgtgtatgtgtggaggcgaatgtgtggaggtgtatatgtggaggtgtgtgtatgtggaggcgtatgtgtggaggtgtgtgtatgtggaggtgtgtatatgtgtaggtgtgtatatgtggaggtgtgtatatgtgtaggtgtgtatatgtgtaggtgtgtatatgtgtaggtgtatatgtgtagatgtatatgtgtagctgtatatgtgtaggtgtatatgtgtaggcgtatatgtgtaggtgtgtaaatgtggaggtgtgtatatgtgtaggcgtgtatatgtggaggtgtgtatatgtggaggtgtatatgtgtaggcgtatatgtgtaggcatatatgtgtaggcgtatatgtgtaggcgtatgtgtggaggtgtgtgtatgtggaggtgtgtatatgtgtaggtgtatatgtgtaggcgtatatgtggaggtgtgtatatgtggaggtgtgtatatgtgtaggcgtatatgtggaggtgtgtgtatgtggaggtgtgtatatgtggaggtgtgtatatgtgtaggcgtatatgtgtaggtgtgtatatgtgtaggtgtgtatatgtggaggtgtgtatgtggaggtgtgtatgtgtaggtgtgtatatgtgtaggtgtattatgtggaggtgtgtatatgtggaggtgtgtatatgtgtaggcatatatgtggaggtgtgtatatgtggaggtgtgtatatgtggaggtgtgtatatgtgtaggcatatatgtgtaggcatatatgtgtaggcatatatgtgtaggtgtgtatatgtggaggtgtgtatatgtggaggtgtgtgtatgtgtaggcgtatatgtggaggtgtgtatatgtgtaggcgtatatgtgtaggtgtgtatatgtgtaggtgtgtatatgtgtaggtgtgtatatgtgtaggtgtgtatatgtggaggtgtgtatatgtgtaggcgtatatgtgtaggcgtatatgtggaggtgtgtatatgtggaggtgtgtatatgtggaggtgtgtatatgtgtaggcgtatatgtgtaggcgtatatgtgtaggcatatatgtggaggtgtgtatatgtgtaggtgtgtatatgtgtaggtgtgtatatgtggaggtgtatatgtgtaggcgtatatgtgtaggcgtatatgtgtaggcatatatgtgtaggcgtatgtgtaggtgtgtatatgtggaggtgtgtgtatgtgaaggtgtatatgtgtaggtgtgcatatgtgtaggtgtatatgtgtaggtgtgtatgtgtaggtgtatatgtggaggtgtgtatatgtgtaggtgtatatgtgtaggtgtgtatatgtgtaggtgtgtatatgtgtaggtgtatatgtgtaggtgtatatgtggaggtgtgtatctccccccgtgtgtatatgtggaggtgtgtataatgtggaggtgtatacgtgtaggtgtatacgtgtaggcgtatatgtgtaggcgtgtatgtgtaggcgtgtatatgtgtaggcgtgtatatgtgtaggtgtatatgtgtaggcgtgtatatgtgcccccgccccatcatgtggagcgcgtgtatatgtggaggtgtgtatgtgcaggtgt

SEQ ID NO: 479105 - DNA, 1401 bp, Homo sapiens
cttctgatgtgggttgagagtgcagtcttaaagaatgagtaatattctgacaaatagtgatgggcaaagaggtgtcctaggagtaggaaattgcctgagcagagacagagggcagaagaaggcaccactgcatgtttgggaaactgaaaataaacagttcaacgtggctgaatgtgagataaaggaggaaagaagagttgggaaataccaccgctgtgcatcagtggaggcctgcttggtgttcacctttgccctgggattgcaggctaccctgctgggcagtcccgagcaggtggtactagaagccagaaaggctgaggcaaagtatgaccttgtgcacaactctgaacatttactggctggcaaaccaaatgtcaaatgcgtggtaatgagcatttggaaaaataatgttgaggttcctgatgtatttaccctgccaggactgagatagtgagagaatgaagggtcccaagtggatgaggctgagaacttaaccactaatccaggatgggcaaccaggactttgtctgagggagtcaatggggtggatcctttctttatccttgacctttgagtgtttgattaataaatgctttgaagtagtcttctttgggttaaatctgcttggtgttctattaaccttctcatacttgaatgttgatatctttctctaggtttgggaagttctctgttattatccctttgaataaattttctacccctatttctagctccatctcttctttaaggccaataactctcatatttgtgagactattttctagatcttctaggcatgcttccttgtttttttatctttctttccccttctgtgtgttttcaaatagcctgtcttcaagctcaataagtctttcttctgcttaatcaattctactattaagagactctaatgcatttttcagcatgtcaattgcattttccaactctagaattgctgcttgcttctttttaattgtttcaatctttttgttaaatttatctgatagaattctgaattccttctctgtgttatgttaaatttcttcaagtttcctcaaaataggtgttttgaattctctgctaggtcacatatctccatttctccaggattgttccctattgccttatttagttcatttggtgaggtcatgttttcctggatggtgttgatgcttgtagatgttcatcacagtctggacattgaagagtttggtacttattgtaatcttcatagtctggacctgtttatgcctgttcttcttgggaaggctttccaggtattcgaaggacttgggcctcaagcccagtaatgctgtggtttttgcatatttgtagaggtaccaccttggtggtcttggatgagatttggaagaattttctggagacttgttcttttccctt

SEQ ID NO: 479106 - DNA, 558 bp, Homo sapiens
tggcgttcaggaacggctctggaaggagagagaaagtggggagatgaatacagagtcttctgagagtcaccagctggccacagaaatcaacttttgcccctctgttaaaagatgtcaagctaaggataagggaacacctggaggcaaggcaaggagcgtgaaaaagagagtttacagcaaagggcctaacattagagatccaggcaggaaaacatgcattctcccaaattattttggcagcttttgtggaaagtccattgaaagcagaggagagaggaaggtggtttgcgtgtttccttcccataatagctatgaatttcagagtgaaacagcagcaggcagacaccctgttaagtttagcacatgggtctttgcctactttagtgggctgtgcttccaagggcagtggttttcaaagcctttactatttttggttggctcagtttattggatgctgctggggcttccactggtccctgctggtactgcccgagggggcaaaagggcttcacagtcaggccgccagatgactttcagtggaggaggcctgtggtgaga

SEQ ID NO: 479107 - DNA, 536 bp, Homo sapiens
tcactacacccattccaccacctctggcatctgtgcagtcccttcaggaacctgaagatgggcccacccaacctgacaccaacaccactgccagcacccacccacatgcactacctaggagcctggggactgtcctgcccagcccatcgagccatcaccaatacaaatatacacttctcaggacccagagggtcatctgccactactaactgccatcacacacaccatactttcttcccagggactgaagaacctgcccacatgcccaacccactgccgccaatactagcatctgaacaagccaccctggaggcccaagaatcagcctgcctggacctgctgacactggtgacagtggacaccatcctgggagagactacactacagtatgcacccaaaataaaagccaaagggccatacctgaccaacaccattaatgcatcgtcagaaaaatttctctcctgtgaaagcaaatacaaaaaattggaagaagtgacaataatagcaaatatgaaggtatcaatgtaagaacacag

SEQ ID NO: 479108 - DNA, 1649 bp, Homo sapiens
ccgctcctatttccttcagcagtggttttgttatcaggatgatgctggcctcacaaaatgattttccttctaacagtcaggctcctgttccgcaggtctgcaagagtttgctagaggtccactccagaccctgtttgcctggctattaccagcagaggttgcagaacagcaaaagttgctgcctgctccttcctctggaagtttcatcacagagggacacctgccagatgccagctggaactctcctgtatgaggtcagagctcgagagctgtgttgggacatccgctgctctcttcagagccaacaggcaggaacatttaagtttgctgaagctgcgcctacagctgccccttcgcctaggtgctctgtccagggagatggttttatctataagcccctgactgcggctgctgcctctctttcagagatgccctgcttacttcccttggctgggggagagaggtccctggacgcttgcagtcccccgctgaggggacaccccaccctgcttctgctcgccctccatgggctgcatgcactatctaaccactcctaatgagataaaccagagctgtttgagctgcttttatatcctggttattaattatttgtcagatgggtagtttgcaatgttttctcgattctgtgggttgtctgttcacttggttgactttgtgtattcttaacctttgaactcttttttatattcctattaggtataaatattacaatattttatttgcataatgattcagtgctagctaagaaatgaaattttgctagaagtatgaggaatataagaataaattcttagtatgttgtttcatttcaatattaaaaatatcaaatatatataaactgcattaccagatatcataattatactagccaggatggaattatacttgtgtatttaaacaacgctgcttcaaactataggtttttaaagtgagcatcagcaactacctcttacattttttcttttaacagtatgtcaaatggcatagcctaatttggaaacacatcttttaaaatacttgagaaattaggatttttaaaaataaataataatcttaagcacttaagcctttttttttctatccgtataattatgtatagaaaacaaaatactatagttaatactgtgctttgagaactatcttcaagtgccaaataagacttggaagattcagtcattggacccaatgctacttctgcttaactttttcgcaagatagcgaagcattaagcccaagtaagagaatctactacaaaatatgtattattttcaagtaaatctgctattaattgcatgttggctctaacgtcagttctcctcattacaatagaaaataaactctttattaattcatcatatgtgtaagatattcaaaattcaaattgaaatgatgctacagaaaacttaaaaaacttttatatatattatttcaataaattctagctacataattattaaataaattagggttgcattttatttatgttcaaaataaaacaatgtatcccagttggggaatttaataaatatactgataaatctgttttgatgtaaaattttggcttattctgaattagagtggagatgttaaatacatattataacttctctaatttaccacacctttcc

SEQ ID NO: 479109 - DNA, 947 bp, Homo sapiens
cgccgtcgttggaggttcctgggagagggtggccgttaggacgccgtcgtctggcacaggggcggaaagccggggaccctgagaagcgcgaggggattgggcctcctacgttgttaccctttaccagcacctgggtcgcaggggagctgtggttttgtggaggaatggtttaccatcttcagacgtccttggcactgccaatatttagcattttcgataaaatggtggaaatcctgggccggtcgaagtcccagggtgcgaagcaaattgatgagatgcaccaaaaactgcaatgcctgcagctggcattggtcaacagaaagggcctaattcttctccataccagtgctcaaccacaccttgcacaaccaacacttcaaaaggtgaatgaattgggctacaaagttttgcttcattcgacatattcacctgacctctctccaactgactaccacttttttaagcatctcgacaactttttgcagggaaaatgcttccacaacgagcagaatgcagaaaatgctttccaagagtgcaatgttctaagctcaactatgaatgtggcctccaacagccatggttgcactttataagatcaaactctcaagtcaaagttgaataaacctgtgcacaaaacgattttctgtactggttaaaggaagcctgtgtgcgtgtgtaggcattcacgatgtatatgaaaaaccatggagagctggtctaaacaaagaaagtaaggctgatacaaaagcagaagcagagataagatgttattaattttttgaatatctaattagtttctttacagattacctcattataaattattctgcacttctatgtgaaaatctaaggttatgtttttatttttcatatgctgccaataactgtatgccttatgttatgattacttgtatacatatatgagcccattgcctaagataatgaag

SEQ ID NO: 479110 - DNA, 463 bp, Homo sapiens
tattgtttaggtagttcatgacggacagaatggagacttctaagtgtcctcacatggcagaaggggtgaacaccctccctgaaaactcttttataaaggtggctggacatcgagaggagcacatcagtggaggaacacacgggttgctggacatggagaggaatgcaccaacaggcaccggcagcggggaggccactgaccggcagaacaacgcagagtttggctggggcaattggaggagagcctggaacactgagtggcccaactccaggggaaaaccagtctcccttctggcttcctcatctactgagagctacttctactcaataaaaccttgcactcattctccaagcccacgtgtgatccgattcttccagtacaccaaggcgagaaccccaggatacagaaagccccctgtccttgtgataagtcaggggtctaattgagctgactaacacaagcc

SEQ ID NO: 479111 - DNA, 635 bp, Homo sapiens
gaagatctgcagcttcactcctgagcccagcgagaccatgagcccaccggcaggaacgaacaactccagacacgctgccttaagagctgtaacactcaccgcgaaggtctgcagcttcactcctgagccagcgagaccacgaacccaccagaaggaagaaactccgaacacatctgaacatcagaagggacagactccagacctgttacaactggaaggtgcttctggcatctactgcatagaggccagggacgctgctaaacatcctacgatgtacaggatagcccatgacaataatgatctggccgagaacatctgcagtcagcaagctagagatccaggagaattggtggcatgtcctagtctgacagccagcaggctcaagacccaggaagtactgatggttcagttcgagtctaaaggcatgggaaaaatgatgtcctagctctaaggtagtcaggcaggagaagttcccacttattcagcctgttattctattcaggccttcaactgattggatgatgcctacccacactaaggagggcaatctgcttcactcagtctaccaattaaaatgttaatatcatccagaaacaccctcacaaacatagtgaaaataatatttttctaaatat

SEQ ID NO: 479112 - DNA, 582 bp, Homo sapiens
acactcccaataaatccattgtcatgctgatgcaagaggtgggttcccatggtcttgtgcagctccacccttgtgacttttcagggtacagcccccctcctggctgctttcatgggctagtattgtctgtggcttttccaggtgcacagtgcaagctgtcgatggatctaccactctgggttctggaggatggtggccctcttctcacagctccactaggtagtgccccagtggggagtctgtgtgggggctccaaccccacatttcgcttctgcactcccctagcagaggttctccatgagggctctacccccgcagcaaactttagcctagacatccagaacattgacagaggacatgcaaaacctttaagacagcctgatcaagaagatgcagatagtgcaacatctgcatgcagtcaagtagcagcagtcaggttctctccatttctcaaaatacccttcctggtccagttgaatcaaatcatgtaggctaatgtttaaaatgcatattcctgtgcttcttcccagctctatttaatggtactgtctcatgggcagatctcagggacttgaatttgtt

SEQ ID NO: 479113 - DNA, 1293 bp, Homo sapiens
tcaggaggacagcttcaaccccctaagatttcatcattgccttaatcaatcggcagcaagcacctgttacctgctaccccgaccccttcccttaaactgtctttgaaaagcccctaacctacaagctttggatgagatgattttgttacaagaaaggggtcccaatccagaccccaagagaggggttttggacttcacacaagaaagaattccagaagctacacatatcttgctcatttatgggctatgcatgatacctgttatcatctccccctcactgggtggtgtggaggtcaagatggtgaaaatgacatcactacttctttcaatcttcatttccagatagattgtgataagataagggccaaacctggtctacacaaattgagtgtggcttcagtggaatgtgtaactacaattccactgatggattcttcctacaggagaaggaaaaggagaagaagaggaagaagaaggaggaggaggagaggaggaggaggaggaggagaggggaaggggaaggagaaggagaaggagaagaagaagaagagaaagaaagagagaaaaaagaaaagagaaagaaagaagaaagagaaagaaagaaagagagaaagaaaaaagaaagaaagaaaagagagaaagagaaaagaagaaataagaaatgaagaaaacaggacttatgggtaattccaatcctttaaacaactctacagggaaataaatcattttgacccaaactaggtcagcattgaagcagaattctatttgtcagtgcccacaaattcaagattctctttgaagaatgtgtcagaaaccatgctttattggatcacagagaaatatagtttagaactcatagaaactgctgcttgagtcataagaaaataccttttcaaaataaaaatggtgccaaattatatcacatgattaaatgatcattttgttcaattgatgaacaatttccaatatatccattagcagaacaattactgtttgcaaaactacttataatgcgcatttatatagtggtttttctattataatgagtgttcgccgactttaaaatcatttaatttttattcaatcccactgccttccaaattctttcaaatgtagtcgcataaatatgaaaataggaagctatctttatcagcatttgggggaaaatgtaataacattacgagcagtatcacattaggaatgtctacacaatgtggtgcagagaggaatccattgaaataagtactgatcaggccaagattcatggcaatggaaatttaaagaaagatattc

SEQ ID NO: 479114 - DNA, 746 bp, Homo sapiens
ttctgctcgagtggccaattgagtggctgtgtcctgcagcagccaaagaagctccactcttactcatgaacatcacagttcatgtgagcaataacatccacaggctgaagttttctcctaaccctgcagggatcttcatttatttgtcattcactaagaactgtgagtgcttattctgtctcaggcattgttctagaagctctggatactataagacagttgtccccaacctttttggcaccagggaccagtttcatggaagacggtttttccatggaccagggaatattgtaaatgagtgtggctgtgtgttccttcacacacatgcatatacagaaatggatgaaaagaagactggccattctaatattgaaaattcctgtggaaagactttttgtttcaggtataaaatccatatgagtgattttggggcttgtaaaaatggtctgatcattgacatgttttaatcgtttgcattagcaaatagcatcaacatattgaacctgagcttctaccaccaccatttaagagctcttggaaatgttaattcttcataatcaaaaatatttaagcacatagataatatatgtacttataacattagaggttttctaggtatattttatgctgtaatttgaaatattgtgcaatttggtatgggaattgaaatttctgtattgattgacactcatatattttaatttagcttctgcatgttatgtaaagatgacactggttttactcac

SEQ ID NO: 479115 - DNA, 589 bp, Homo sapiens
gacagcttgacggtggaactttggagaggagttcagctggtgatgggcgaactccaggggaagattatcttcctgcttaattacccttccagctccttttcccgtgtgggtgcaagaggctgtcacgctgactctccactgagctatttaacacttaagccatcaacggacagcaaagctaagggagcgcactgcaacacatgctctctggggctccaggggtcacggagaacccctagatgctgccacggggccgcgaatgcttcctgcaatcaattattcaatcaatcaatcgatcaatcaatcatcagtcagtcttatgatgctaatatcggaaatcctatctataggagctttgtggatgcagatggatttgacgttttcagcgatcaagaattactatatttagtaaatggaaataccattactacaaacgaatgctaaaaatagaatgatgtcttttgtttccaaagttgatacactagagcaatgcaaaaaaaaaaaaaataataaaagcaagatacttcatagcaaagttatctcagggtaaatgctgcaagcaccgccaggtacatgtgcacaacgtgca

SEQ ID NO: 479116 - DNA, 882 bp, Homo sapiens
cttgctcacacctcacagccagtccagtggacaattctgccatctgcatcatcaaaatgtatccacaatgctcccagagactgaccggcttaaggctcgaggcgtgccagggcccccggagtcaccctgcatcagctcttgccgcctgctgcctgggcacgggagaccacactggtggaggggatgagacagggcaggcccagccttgggacacccctgtccccacagctccagtgactgggtgcttcccccagccctgcagagcagcctgccccactgcagacagtgctggtccagggaggtcctcacaggacaaccagagttgtgatgcgggtgatgatcagaagctgtctgaaatctgcaaggcaggcaggctggagattcagaaggagtggggctctgctaatactgatcagcccagtgatactgattttggactcctagcctccagaacagtgtgagaataaatgtgttgttttaagctcaccagtttaccgtacttggctgtagcagcccttgcaaactgacacagaggggctgatcaactgaggctaagattatttcttagaattgaaagagaatcagtatctcttgagcaaaaaccattgtgttttcctgattgaaagtctcttaataactattgttactgggctctaacgtgatgactgtactgtgaccagtctggtttgaatgtgttggattaagcaaaggtctgtgcccttggtttgagcatgtccttggtttagacccccaaagctcaaaatctgggtatagtaaagtgacagaaaacactctctgagaccccagaggtctaggatgtgtaccctagaaggccccagacaccttttatgtgaccaccttggcttgaatgtgttgcattaa

SEQ ID NO: 479117 - DNA, 2093 bp, Homo sapiens
cagcttctgagaaccgcgtctgccctgttccgcatccctagagcccgaaagagtggcgggaggggtagggatggttagtgagggggccccaatacctatggtcagggactctacctctttggtggaggtccatcctgccaattggcttctcgggcctgtggcagtgagggaggtccttgctactgcccctccaaagacgcctgcagtgacaccacagtcagatatggtggcatcagagtgggggtggggggggacagcaagaacgtggcctgtggcagaagaatctcttatcgttaggaagtcctcctgggaaaatgttctccgctggtcctacttctgcatgttagagccacacaaagtctgtactttctgccccatgaaagcccctcagagagttaaaggagaggccgtttgctttcataatcatctctactttaagcatttcccctttccggtcaaccccattgtcacccagaggatccctttgttgattttttccacatagattatttttgactgttttggcactttatataaatggaatcatatagtaaatatatacatgtatatatgtatatatacactatatatgtatatatatagtgtatatatatacatgtatatatgtatatttacatatatactgtatatatgtatatttacatatatactgtatatatgtatatatacacgtatatactgtatatatacagtatatactgtatatatatactgtatatatgtgtatatatatatacagtatatatacagtatacatatatatacatgtatatatacacagtatatatacatgtatatatacacagtatatatacatgtatatatacacagtatatatacatgtatatatacacagtatatatacactgtatatatgtatatatatactgtgtatatatatacagtatatatacagtatatatatacatgtatatgtatatatatactgtatatatgtgtatatatacgtatatatactgtatatatatatagacacttttgtgtctggcttcttgctctcatcataaagcacttgaaatccatccatgttgtagctggtatcagtagctagtttcttttcattgctgagaagtatcactttttattgatgagtagttttacattgtatgaacatgcccgagtttgtttatgcattctactaatagacacctgggctgtttgcagtttttggctattacaaagaaaatttctatatttttttccaacttttattttaggttcagcgggtacatgggcaggtttgttacatcggtaaattgcatgtcactggggtttggtgtacagattatttcaccacccaggtgttgaacatccctcactgatgtgagatgctgcctttttcacagtctcaatccccatgtgcatttctatttattttccttccactttattcacatctttttcagtatccacaaccatattgttttaaatagcttcatgatatgttttaatatttgaaatttcctggctattcttgttttgtagtcttccagataaataattttgaatcactttgtcatgttccagaaaataatactgccagaatttttattgtgatcacagaagttttacagattcatctgggggaaaaaaacccatcttcccagaatacagaaagggtgagggaaagacaaacatcaaggacaagtctcaggttctggacttggagaccaagaggatttggggcatccgggagcagggcagggaggtgtgatggctgcctttcactgagtaggaggatgcccagacttgggggaactatggaaagtttggttcagactttctgagttggagatgtctatgcgcagtccacagggcgaagccctggagaccttaacttgttactgttttatttgttgatgtgtttacatcatttgtccccctgtgatggttagttttatgtgtcaacttggctaggctgtaggggctgttcctctggcccctggactgcggaggtctgcttccacccccattggtcgatcgttgtcccttgtcacagccattgagaattttggcagggagcatgttcttagagcatttttaggctctgc

SEQ ID NO: 479118 - DNA, 731 bp, Homo sapiens
tcaagtgttgctgggacatctgcttctagaggctgcgcggtccttggctcctggccccttgctccatcttcaaagccagcatggccagtcgtctttctctcatggcatggctatgactctgaagtctcttccacctccagcttccacttttaaagagccttgtaatgacattgggttcacctcaataatccagatgatctcctcatataaggttgctgaggaagaggagtcctttctgttgtgcaaagcaaatccccctctgtgtccttgggctcttccccactctgaggccttgttcaatcagagacttgaagatgttctgctgctggctttggagatggaggaagaggccatggcatcaaggaatgcaggtggccacgagaagctggaaaaagcaaggagaagaattcttcccttgagctaccagaaggaacacagccttgccaacatcttgattttaaccgaaatagggccacaagtcagtgctggtgccgatgagaaccctggtttccacacatcccatccaggattctaatatagctttgtgatacagagttcataaaatgtaagcaacttttataatttgcatggaagccactgtgaaacaatttcagaaccactgtaaatgaataagcagcgctctcaaaagccggagaaacaaactgctaaggcttaatggtcgtgtctaagcattgaaccactttatgtgtttaaaatatgttatcaccttc

SEQ ID NO: 479119 - DNA, 742 bp, Homo sapiens
gagccaggaaccgtggacaaaaaccaatatatatcataacaccacgagagcatttaaaaatgaggtagatctgcaaaacggggcgatgatgcagacctcaccaagatgttgagaggattccctgctagtttatgaagcatccacacaccagatgctcaatgcctgtcggctgtatgggactcaaccattgccaggaccaggccttcgaatgccaagacctttgccctcctttccatccacaatgaaaataccagttgacaccaccaggggtccatcctccagggttccagctctcctcagcaggaaatgggcactgaaacagacaaagaggcaggtggtgcaggtgacctgcagcacccaaatagctttggttgaagtggtgaacgctgaggagttgctcgacttagctctccctcccccagaaggccccctagctgcctcttcctggcccttgccagtatccagcccgcaggcagataagtctttgctgtgggacccgtttaccaccagacatggatctcagccaagtgatggaaaaaagaataagggacttgtgcctagaatacacaaggggctcttacaactcaataataaaataacaaataacccagttcaaaaacaggcaaagaatctgaatggacagttctccaaatgagatgcaagaatggtgaataagcacatgaaaacatgctcagacatcatgagtcatcaaggatgctgcaaatcaaaatcacaaagacgt

SEQ ID NO: 479120 - DNA, 652 bp, Homo sapiens
ggaggcccagacttgcaactgggactcgtcttcgccaggagcctcgggtttgatggggcaggtgtcgaccagcgcccccaggcagaccagcagagccagaagtgctatggccacagcaggccacggcctgcacaccgacaccatagggatagctagtgaagcagatgagcaggaggtggaaggcgagggaacccccaagggctggactgccacaggatacccagttggtgtgcagaaagttgaagaattggttggtgtggggaaaattcccacatattcagcatcagaagtgttattaatatccagctctgatctgggcactcattcccaaaggatttatgatctaaattcttgtagcattgtgtcaggaagagagcgaaaggaaacagtgaccgaactagaaacaaaactgaggcaagcagtgatcaactttgaagttacagacttgctgccttctcagtatattctcacatggcagaaagaagattacagtcaagatgtcaatggcatttgccatcctctgaaggcatgtctggagctgaaggatatattaccaaggtagctccctcatatagctggcaaattggtgctgcacattggcaggaggcctcagttcctcataacatggacctctccacaggcttgcttaagc

SEQ ID NO: 479121 - DNA, 575 bp, Homo sapiens
agcacatagattctgtagaacagagatgccagtcagcacttttggtcacttaaacccaagacttataaatccaatcgctgtggagaagctatatttagtcaaggtcatggaaaagcagagaaatcaggatcatgaagagactggagtggatatggatagacaaaagaacacacagactgagagggacagaactgccttgattcctgatgaagaaactgaggacccccagaagtcagccatacaacagaatatggtttccaatgaggtatgcctcatggaggctgtgcaacattgggcaacttccagaacatcatcggacctatgtctgaaaatgcctgaaccagacatctgcattcctgcttcccttgccaacaggttacaagcatatgacttagagcctactgaacccaatagagatttggaagagaattcaatttggaagagcatgccatgaaagaggcactgctcagagtccactgtggaggatgtggaggagagacagccagctttcacaggcagtggtgctaaattgtgttgcagtgatgcatcaggcctgcattggtgttgaagctaca

SEQ ID NO: 479122 - DNA, 516 bp, Homo sapiens
ctgcagaaaagatggcctgtcacagcttctgcctgcactcctcaggcaggctccttggaggggacatttcacagcctcagaaacatttctggaattggcacccacttggcccccagctctgtagtggctgggggaagcctgcatggaagaggggaagaataagggaggaagatcagagctgtaaaaggggatacaaagcctgtactctacgaccattgtgtcaggcacaagaatacaccagagctgagggccagccctacctgagaaccatcaacaaacttaccccacatcccattatacctcctcactccctgcagcctgtcagcttccccaatctcccacactcactgtcacctggggctctggtgcaccagatgacactacttgctccctggtacacagggatgataaacagggaggggtgaggactgtatctttactaattatcatcatttgaatatttttgccatgaacatgtgttacttttataatgtaaaagcacttaaaatcaaaaga

SEQ ID NO: 479123 - DNA, 582 bp, Homo sapiens
tttgcggttggctttttgcaaatgtgcagagtgtgggcttccatgtatgcctggtccattcctggcctgacccctcgagaggcaaactgtcccaacacatcctcctcagggtacctgtaccctcttcagtttcctctgtcactgaggctgatgaggagacaaggccaccacatcagcatcccaggaacatggatgaagctggaagccgtcatcctcagcagactaacacgggaacagaaaatcaaacaccgcatgttctcacttaatgttaggtctctgaactctggggaatctcagttaatgtttgagtccaaagtatctggggatatgtgttcagagtgtgaagcttctgaactctttgaaggtgtgtcccaagggagtgagatctctgaagtctttgagggtctgtttcccacagctcgagtctattgtttttaggaccagtatagagagatgtaaggatgctgaactgtttagggctttgtgttcagggtgtgaggtctgtgatttgtgcagaggtctctgaggtgtctgtgaatttgtgtttagtgtgagaggttgctgagttcttttggtgtcttc

SEQ ID NO: 479124 - DNA, 615 bp, Homo sapiens
gctctggctaacacttccagtactatgttgaagaagaatgatgagagtgggcatccttatcttgttccagttctcagggaacaactttcaacttttctctcttcttcaccccttcagtaccagccccctcatggagcctcactttaccacctccttcaggaagtctgccctgattggagcctgagagagcaaacactctgcacaaaggaaaggcctgagaaacacttgaataaatacatgaatttattcattattgagcacccacaatgtgcaggcataataccaggagctgaagacactaagatgaataaggcaagacctcacctgttgaggaatcgagtatggtaccaggggagcctgaaacacatcttcatgacagtagtattgctgtgggactgcaaaggaggagctgatcagcagtttcctggaaaagttcttaagggccacagtaggagagagaaatctgaaatcctggggtcacctgaacaagagtctcttctcttctgcactagatcacatgggttgacctagagtgagaaaaggacaatgctttctgttttcgaatgtgaatatgccttagagtatgtgggaatgtttcattttcataatcccctt

SEQ ID NO: 479125 - DNA, 590 bp, Homo sapiens
cagctatgtggaactgtgaaggagggacatagtgatggcagcagcagcccatctggagtggctgctgcaaagttacgggctgcagtggggaggcacccctcagcatgaacagcctgggcaccatgaacagcagcagaaggcagacaggttccaggggggaaaggcgcgggtccccagtgaagccccaacttcaagccgtactgggggctgggatgccagtcctgtggaccagagtgggatattatggtgctttttctgtgcccacccatggccacctatggaccaatcagcatgcacttcctcccctctgaagcccaaaaagccgtgtgctcagcaagactcaaggagacaacagggtgaccagctttggggagtagcggcccactccagggtttcctctctgctgagagctgaacactcaactagaccacctgcccacggagaggagctacccagcccatggtcttccctctgctgagagctgaaaagaagacaagatgaccagctacagagaggagctacccaccccagggtgctttctgtgttgagagctgaacatttgatggatgaccagctgtggagaggaatta

SEQ ID NO: 479126 - DNA, 689 bp, Homo sapiens
ttcagagctgagtacagaccctgaatatctttgttaatgttctgtcttgatgatctgtctaacattgacagtgtggtgttaaaggacccacttacagaagcagtctggctgcttttggcagagaaggtgtgctgcactgggggggacccttccttgtccagggctcccatactctccagagccagcaggctggaagagctgagtccactaaccacagtgacggcagctgctcctccccctgggtgttctatccctggaagaggtcagagttctgtccatataggcatggctggagtcactaaaggccttctgtccaaagaggaggaatggaaagaggtcctgcttaaagaacaggctcagtctgttgctgttggctggctggaatttcaagccagtaggtcttgtgaggtgctgtggaagtgggacgcacagaatgatgctttttggccctccctgaattcagcccccttcttcggggaatctatggatggatctgccaccttgctgggaatcctggggccagaaaataaaacattttccaaacaagcaatcactaagggaatttgttattagtagactagccttacaaggtatccttaagggagttctaagcatggaaacaaaaaaacaatacctgctaccacaaaaacaccctgaagtacatagcccactgaccatataaagcaaat

SEQ ID NO: 479127 - DNA, 1345 bp, Homo sapiens
gccgcaataaacatacatttcccataacccccacgtgtcatgggagagaccaggtgggtgttaattgaatcaggggggcagttacctttatgcgtttctcctgttaatgaaagagaggaaaatgtgggaaggtttggaacttctagagacttggaaggctcagatgacagaaagatgtgggaatctttggaacttcctagaaacttgttgaatggctttgaccagaatgctaatagtgacatgcacaatggagtccaggttgaagtggtctcagatggagatgaggaacttcttggaaactggaggacagaatcctcatggagaaattctgttagagcagtgtggaagggaaatgtgaggttggaacccccacatagagtcccccccactggaacactacctagtggagctgtgagaagagggccaccgtcctccagaccccagaatggtagatctaccaactgcttgcactatgtgcctggaaaaaccacagacactcaatgccagcctgtgaaagcagccaggagtggagctgtaccctgcaaagccacaggagcagagctgcccaaggccatgggagcccaccatttttatcagcatgccctggatggctgcgaaactaatggcaaataggtatcatacatttctcaaactgcatggaatgtacaacagaaagagtcaatcctaatgtaaactatggacttacttaataaaaatgtataaatacatgctcatcaaccataacaaatgtaccatactaatcaaggtgttaataatatgagaaactgcttgtggggtcggggtaatgacatgggcaaaatctatttgaaatcaagtagtcataaggaatttattattgacaattgaaaaaagttcttaaaaagcttcaattcattctcccacacaaacatataaacccaccaaaataaactttcttgcagctcaatgttttgttgtgaattcatgtctaaaagtgaattctattaagcttttgtgttttattgcatcatggggtttgctatgaccatcatctggagctctatctccttggttccttttattggagagtattgagtggcattacaagccaagatatgggctatggataaggtcattgctctcaggattactctttggataaaattatatatatatatatatatatatatattattatattatatttaaaactatgagtatcaccaatacttctcattctaaaacctaactacagtgtttattcctagtctcactcttgtcatattttcatatattataactcccttctctgacactgagaaatctgagtactgttatcttctatataggtacatattgttctagt

SEQ ID NO: 479128 - DNA, 3043 bp, Homo sapiens
cgccttgccgccgccgctcgcccgccgcccaccatggcccagcagcaaacaggtagcaggaaacggaaagcgcccgcggtcgaggcggacgccgagagctcgccgtcgcagggcttggcggcagcggacggtgaggggccgctgctactcaagaggcagaggcggccggcgacgtatcgctcgatggcgcactatctgaaggttcgggaggtaggcgggtggggccccgccaggctccagggcttcgatggcgagctgcggggctacgcggtacagaggctgcccgagctgctgacggagcgccaactggagctgggcacggtcaacaaggtgttcgcgtcacagtggctgaactccaggcaggtggtgtgcggcaccaagtgtaacacgcttttcgtggtggacgtggagtcaggccacatcgcgcgcattcccctcttgcgggacagtgaggccaggctggcccaggaccaacagggctgcggcatccatgccatcgagctgaatccctccaagacgcttctggccaccggcggcgaaaaccccaacagcctggccatctaccagctgccctccctggatcccctgtgcctgggcgaccgccatggccacaaggactggatcttcgccgtcgcctggctgagtgacaccgtagccgtgagcggctcccgcgacggcactgtggcgctgtggcggatggacccggacaagttcgatgacactgttgcctggcatagcgaggtgggtctccccgtatatgcccacatccgtccgagggatgtggaggccatccccagggccatcatcaaccccagtaaccgcaaggtgcgggccctggcctgcggcggcaagaaccaggaactgggagcggtgtccttggacggctacttccacctgtggaaagccgggagcgcactatccaggctgctgtccatcaggctgccctacttccgggataatgtgtgcctgacctactgtgatgatatgtctgtgtacgccgtgggctcccattcccacgtctctttcctggatctgcgccaggaccagcagaacatccggcccctgtgttctcgagagggtggcacaggcgtgcggtcgctgagcttctaccgccacatcatcactgtgggcaccggtcagggctccctgctcttctatgacgtccgggcccagaaattcctggaggaaagagcctccgccaccctggagtcctcttcgggacctgcaaggaggaagctcaggcttgcctgtggcagaggctggctcaaccacaatgatttctgggtgaattactttggtggcatggaagtgtttcccaatgcgctctacacccactgctacaactggcctgagatgaagctctttgtggctggggggcctctccctgcaggcctccatgggaactatgcaggcctctggagctaaggatgaccgccttgtactccaggtacacagatttacctttcagttccgcccgactgcccttcatgctgcatttttttgcttttaactctgtgcgtcttttgttttccaggtggaaccagcccagcttaatttgtactcctccaagcagagagaggtgttattgaaggaccttagcctaatatctccaacagttcttttaattactcaggaaggatgatttatataaacagatatgaaggtactgaacctgattttctttgtcagcttaagcaatcattacattatgtatacatagtgtatttttttaatttgagggcatgctttgaacatgtatgttgttattttgggttatgtctttgtaatttatataaatggcataaatagtaattgtaggtattactgacatagtactttctataagccagacactgttctaaacacctttttatgtactgacttatttaatctttgcaataacctaatgatatgggttttagcaactttttgccttaactctcaccaatgtttccaagtctattgtgagtacacgagcatctgtgagtctggacagagaaggagatcaggatgagtgtagcaaaaagggtggtaaaaaataatctacaggttgccactttcaacttcactctcctactattccaccttcccaatcttctttgctgacctctttttctccaaccgttacatgctaatgtttcccaaaattcttatgtttggccatctctttttgttctctgtgtttttccaagtaaattaaaccatgcaaatgattttatatacaatctatgcagagataacttcgcaatctgtgtctttcagcttgatctgtattttatacatatacttacacaaatttactagaagtattcatgaggtacttcaagcatagcataccttaaattaagcacattatatttactcttaaatcaaaatccatttttactcctgcattctgcatcttgttgaattacatctatttcttcccctctcgagctcctagagttaacattgactcttcactacccttcaatatccacatctagtacctcatctagataaattatgcctccaaaatatcttttaaatatttttatcctgtccattcctacttttagtatcttaccatttctccactgaactatttatgaaaataccctcattattggttctcttacaaatatatggtattttctttaactttttcccaattattgccacagttatatttttaaatacaattggggttatgggacttgcctacttagggtacacgtatgtaaagcactgagacaacacttcaaatctggggtccaatccttcaacatgtctaattacacttgccatataataaataaatatatatgtatgttatgtatatatcatacatattatgatatataataaatatacgtagataataaataggttatattatatagagatatatatatacatatttagtcattttcactagttcttaccacagaattcctcaaaatattggaatatcctgagtgatacaaatgtcttttgttatttaccacaaacacctttttaccatacctgagtttatgcaaaagaagtgactcctagtggtcct

SEQ ID NO: 479129 - DNA, 671 bp, Homo sapiens
ccaagccttgacagcttacacatggttttgcacttgtgggtgcagagaagtcaagaattgaggtttggaaacattcgcctagatttcagaggatgtatggaaatgcctggatgtccaggcagaagtttgctgcaggggcagagccctcaggcagaacctctgctagggcagtgtggaaggaaaatgtggagttggagcccccacacagattttccactgcctagtggagctgtgagaagagggccaccatcctccagaccacagaatggtagatccactgacagcttgcaccatgcatctggaacagccacagacactcaatgtcagcccgtgaaagcagccagaaggagggatgtaccctgcaaagccacagaggtagagttaaccaaggctgtgggaacccatctcttgcatcagcatgccctggacatgaggaaaataatatgactaattattttgcactgattataattcaatcaaacagatatgccttgattccttgtcatcttttgctctcaccaaaatgtaagccccttcaaccacctacactttttgctgtttcttctcccctcaccctaatgcccactgattctctccattccgaaatatttcacactgtcttgtggtgcctcatttcttggttaaaaatgcaaataatcattaactaatca

SEQ ID NO: 479130 - DNA, 4288 bp, Homo sapiens
aagttaatcttaaatacattggtgccgtctgtcacccctttccatggctaggaaagggaattccctgaccccttgtgcttctcagaatggtagatccacaaacagcttgcaccatttgcctggaaaagctgcaggcagtcaacatcagtccgtgaaagcatctcggagggagtctgtaccctgcaaagccacaggggcagggccgcccaagaccatgggaacccgtctcttgcatcagcatgacctggatgtgagacctggaatcaaaggagatcattttgcagctttaaaatttgactgccccgccatattttggacttgcatgggccctgtaacctttttgttttggccaatgtctctcatttggaatggctgtatttacccgatacctggacccccaatgtatctaggaatgtttttcagttctccatgtagacctgtctcaactctgtagttaaatgtattcctaggtatttatgtatgcatgtgcgtggctactgtaaacgggactgagattttgacttggttctcagtttgaacgttattggtatacagaaatgccactaatttttgtttactaagtgacagacattaaggagatgttcctaataatacaagattttgacaataaacattattgatttatttttaaaaaacatatatgatatacttatatataattatatgtttatataattatatataagtatatatataattttatacataagtatatatttatataattttatatataagtatatatttatataattttatatatcagtatatatttatataattttatatatcagtatatatttatataattttatatacaagtatatatttatataattttatatacaagtatatatttatataattttatatataagtatatatttatataattttataagtatatatttatataattttatatataagtatatatttatataattttatatgcaagtatatatttatataattttatatacaagtatatatttatataattttatatataagtatatatttatataattttataagtatatattaatataattttatatataagtatatatttatataattttataagtatatatttatataattttataagtatatatttatataattttatatataagtatatatttatataattttatatataagtatatatttatatagttttatatataagtatatatttatataattttatatataagtgtatagtatatatttatttatgtattattcctaattttaaatagttataaagatcagacttagcaatcaaggttgtggctacattaattataataccacatgacaaaacaatttgtcaaatgttttatatatatatatatataaataacataaaataataaaccataggctgaaatactttcaatttttttaaagtatcaacacaataccaacagcattttacaaaatacctgcataataatacttagaaaatataataaatttaactgtttcttcaaaatcaatttcccctctggacatatttatttcaatgtactgatctttctatttgtcctcaggcttaaatattcaaataattcttgattcttttctttctggagaaacttaaaatagactttatgaaattcattaccccactcatcacaaatggttattctcccctctctctttcccaacccatcaatcaccacgtgtagtgcattttttctgttgtaatagccatccctttcattgttcctgttacaagctttgttcaaaccctcatcactgtttcctcaggtggttgccaaggtctcttaacgagtttccttgccttaatttactctttccccatttgctgatcaacacatcttcataaaatttcattttgtagacattatcatctgctgaaatccatcagtagaccctaatcacctaccaaacaaacctgtaattcctccatttcaaatttaatgttctctacaatctggttaaaatcgcaattatatttttctgctttgcaggaattctcttctctgttctctttgcttatttaacctgtatcctacaacccccactgaaatcacaatgacactgtgaagacttatctgctttcacccctacatagtgttcttgtccaagtaacctttttagcagctgtaggttagtctttcaaatcatactataaaattacattttcctacctggcacatttgtgaaactttgtatgatacttaatacatcatttcacttcaagtacttactaatgaaacataaaatagtttagagactgtatctatcaattatgactatcatactgttgattattttgacctctaaagccctgatcagtgaatgccctttgattcaaggaaacatactgaagtttagaagtgtttctcatggcactgtgtcaaatgcaaatgcctttcatggcagtgtatcaaatgtatcttttttttctgtttcgttatccatcttttctactgccaggttggaaagctaaaatattattttatagatttctacctagcaagaagtgtcataaccttctttctttatggcttgtgctgcatcgttcttgcaggcaaaattagcatggatttcgatgctcatcaatagtatcagtatggtctaaccaaagttattcttcctctaatgtacagtggtctttatagcaacccagctctgcaacagtcttataaatagtagtgattgtgttttattacaatttctccagtctagattgattatataatatccaaaatccacaatgaaagcgaatcatttaaaagtaagctgactgttcaatgcacgttcaccattttctttaaatatagtttggtgtaaaatttttcatgaactgtcaaatatacaatactgcagtgaaaaaaaatcatttctttctgctgttaagatattgtttcctcaaactagaacactagaaggccgattttttttcttattttgcttcataaaacagtgagaagaaaaacacgataaagcccatagcaacaagatatttattttaacatctgtgtgatttatgtcaaatttaaactgcttgtattttagaaaggaatctgttttctgtcttcaaaaggatgctatccaacatctctcagctgctaatttttagcacttagaggttccctcgggctgctgtcaactacgacttattgcataggtacttttcactaaactcattataaagtgattagcctccagcaagatagtgcaatgctgcagactgcttgcattatatgtagctttgcaactgaattttgtactgtcaaatcttatcagacagtgagtatagaatgactcctgggattcaatacatatagaatgttgagagggattttgtcacttctcttttaaaccatacctttcaaaaaaccatatgtatgcacatacacaaaaacatacacatgcatgtgtgcatacagaacaaacataaaatatatactagtttaaaatagatggcatagtttgctatcatcaaatacattttcaaaatctatgaattattcttcagcttatgctttgaattcaaaagctaattaaatatctctaaatgtatgactggttatcattaatatatgtaatggtgccacttttattagcatatttaatttacaatgctttttaccttaaagaaccagtaataatcaatatcttggcatctaataagccaataaaactaaaattagaccatatgtgttaaaatacagattattaggagtagaatgttaatttggctatttatttgcaagctttcctaaaaagttatgcattatcccagttcacatattaaccagagcatgacagtagcactatactgcaatagtgaacagtctatactggaagctacattagttacattgtacttcttcattagtctttacttattgtaagactcttgcattatccagtgcatattactcaactgttatgcagtggttaagttcatgacacatcttgtagaagttttaaaatatagaagagtaacttgcatgctccctggaaaaaaaaagacagaactgcacattctgaacttgttcatgttatgacaacttcaactcaagtatgaaggttaactcaaaacaaatgatctactaggaggataaaagtctaaaagaagttattttattatttgcaattattactatcatttaagctgaactggtatttattctttagatagaactgatagtttttgaatgcttgcattatttacatatttgtttccttttacagattattcctgggcaacttttca

SEQ ID NO: 479131 - DNA, 1063 bp, Homo sapiens
ccgcataagttatgtttgaatttctcctcagataatgggtttttcttttttatcgtattgcccaccagaagctattttccttcagctggcaaagccgcagtatacctttactgtcctacttcagggttatatccactatccggctttatgtcataatcgtattcaaagagaccttgatcgcttttcgcttctgcaagatataacactggcccattacattgattatattacactgcttagatctagcgagcaaaaagtagcaaacacactggacttattgttaatatgtttctgtgccagaggttgggaaataaatctgactaaaattcagggaccttctacctcagtaaaatttgtaggagtccagtggtgtcagacctgtcaagatattccttctatggtgaaggaaaagttgctgcatttagcccttcctacaatcaagaaagaggcaccatgcttagtgggcctatttggattttggaggcaacacattactcatttgggtgtgttactctggcccattgattgagtgacccaaaaagctgccactttcatgtgtggtccatatttctaaagtgagttgactcagacgttatgtgcaaaacaacctacattacaatatgtgtcattgtgttgttcttttctttgcaatagggacatattaacagctgtttaacatttaacctaaaacttctaaaatattgaacaacatatcccctttcacaaaaaaatgtgatttcaagcatccaactgtggttgcttctttgatttatttatttttcacaaaacctatactaagcctatctccaaatatattatatgctatttgttacatccatactttgctttaataccaatttttctgtacttattagtgttgtatttagtggccaaaagtgcttcaggcattcaactatttgatgctttctgatattactcagtatcagctggaaagaatcacactgaacacataggaagttttactaataacagtgtgctttgtgggtgaacacttttcacacatgcaactaatttgtgtgtatttaataagtatgtgtccctt

SEQ ID NO: 479132 - DNA, 1525 bp, Homo sapiens
actcctgtgtatattatgtcactgggcaaagggactttacagatggaattaaggaaacaaggacctcactcctacattcacaagaaactgagttctaccaattatttgagtgaacagggaaatggattcttccttagagtctccagaaaggtatatggccctgagaacccacttgaatttagtctgaaggaatggtaccagttcctccttgtacctctggtagaattcggctgtgaatccatctggtcctggactctttttggttgctcgtcaaagtcgttctccgtccagctttgttccgttgctgcgagactccgtgggcgtaggaccctccgagccaggaaagggaactccctgaccccttgcgcttcccgagtgaggcaatgcctcaccctgcttccacacggtgcgcgcacccactgacctgcgcccactgtctggcactccctagtgagatgaacccagtacctcagatggaaatgcagaaatcacctgtcttctgcgtggctcacgctgggagctgtagacctgagctgttcctattcggccatcttggctcctccccaccctagtctgaaacagaggtcaacccacaccttgatttcaacttggcaaaaccttaagcagaggactcagcgaacatgtgcttggacttctgaactacagaactgtgagataataaattggtgtaattataagttgctaaatttgtagtcatatattatctgaaatagaaaacaagtgcaatcatttagcacattaataagtatttacttttattcaggaattatgtaactttatttagtatttgcttagtaataattattgtgagtttttgagcatgggaactatgtcttattatcttttttatgctcaatccctatcagaagttgtgtattaaataaatatttgtcaaacaaataaacaaatggtgcctagtttcctcttgttgcttagggtcccataatagaactaactacataagtccaatttccccaggtaatgtcccaagtcctgaatctctccatcctgctttttaacctatccaaatttacctgctggctgattttggttattagataccaattttgtgcgtttcatattaatatctgctgttctttcttaattagaaactggaaagagaattaaacactaatgccctaagacatctctttcatgtaataaaacaacttatattctgtgcatctataatggttctagttccttaccaactttgaaaagattgagaaaaaatccactcaaattctttttagtcttctgtgttttagatgaggataggatcatcctaaacgcgaatggcttcatgtgccatatttttcagtaccaggtgatatggttaggctttatgtccccacccaaacctcatcttgaattgtaattcccataatccgtacttgtctagggagatacctggtgggaggtgattggatcatgggggctgttttccccatgctgttctcatgataggttccaaggtttcatactgatttcttgattgtaggta

SEQ ID NO: 479133 - DNA, 557 bp, Homo sapiens
aaaatcttatcattttcaacaacatggatggaattggaggtcattatgcagtgcagaagggaaatgtggggtcagagcccctgcacagagtccctactagggcaccaactagtggagctgtgagaagaaggccaccgccctccagaccccagaatggtagctccaccaacagcttgcacagtgagcctggaaaagccacagacactcaatgccagcccatgaaagcacccaggagaggggctatatcctgcaaagccacaggggcagagctgcccaagaccatgggaacctacctcttgcatcagcgtgacctggatcaaaagaagtatctcctcatggtcaccacagccgagaatgcactgagtcacaccaaagccagcacagtactaggtcttgcccaaggctggcagcaagtttctttcaggcataggtcctttctagaaatactgtccaagatctggagcctggaatcgtagactttaggaattagctttattttttaaaaacttttactgtgacttggttcccaatttcaaagaaagccttttctattcccc

SEQ ID NO: 479134 - DNA, 721 bp, Homo sapiens
tctgcagagcacacatgaattttcatgactaattaagaggcaaatgttaatagccaagaaaattgagaaactgtttccagggcatgtcagagaccttcatggcagcttccatcacaggcccagagggctaggaggaaaaaatggttttgtggtttgtgggccagggccccactcccttgtgcagcctcaggactttgtgcccactccagccatggctaaaatgggacaaggtacagctcaagccattgtttcagagcgtgtaagccccaagccttggcagcttccgtgtggtgttgggcctgcaggtacacagaagtcaaaaattgagaaatcttgttgtgaagcagagcagagagaagaggaattggctagatgcgtggtcaaaggaaagctcattttgggatgtgagattccaggacatgcagacatgaagagattagtgatgcatgacagaaatgataactaaagtagcaaactccttgagaagatcacaaactaagttcattagaaattatttttctggtttcttctcatttggatagactatttcttctaattatttcataatttatttttgatttgactgtttttttcccccttgagaatgtgacataaatgttttattgtaacctagtttcagctctgggtactttcagcagtgaagactctgtatgagttccttggttatagagtatttttgtgtgttggctttctcagatgc

SEQ ID NO: 479135 - DNA, 720 bp, Homo sapiens
attactactactagtgctagtagtatggagcatgagggcagtagttgtttcaatgcctcacaattgttatgctctcctccccagagcacaggaatgcccactgtggcatgccactgctgccagaggatggggaggagtggcgtcctattcaagagtgtctcttctattctttacagagcctttttcagtgataagaagttaaatccagccatggctaaaatgggacaaggtacagctcaagccattgtttcagagcgtgtaagccccaagccttggcagcttccgtgtggtgttgggcctgcaggtacacagaagtcaaaaattgagaaatcttgttgtgaagcagagcagagagaagaggaattggctagatgcgtggtcaaaggaaagctcattttgggatgtgagattccaggacatgcagacatgaagagattagtgatgcatgacagaaatgataactaaagtagcaaactccttgagaagatcacaaactaagttcattagaaattatttttctggtttcttctcatttggatagactatttcttctaattatttcataatttatttttgatttgactgtttttttcccccttgagaatgtgacataaatgttttattgtaacctagtttcagctctgggtactttcagcagtgaagactctgtatgagttccttggttatagagtatttttgtgtgttggctttctcagatgc

SEQ ID NO: 479136 - DNA, 551 bp, Homo sapiens
aggcattgcctttttctgcttcaccagacttcaagcagtttgaaagcatagatttgataatcagaaatgtcttccctgaaaacaaaacactggagcagagacctgaatgaggagcaagcaatgcaaagacctgagagaaatgtgtttgaagcagaaatgtggaccccttcccagctggctgtctcactagctgctgcagggaaacccagaaccccaaggaagtgtgagctctcaggggtaatctccatagagattaaatacagagctgcagcaggcactgagctggggacctttcagcacgagtcagctccagcggatcctggtcatcagtgcctaccctctagggctgcccatctccctctgagaggctctgcacccagctacctgctgaggagaaagcagggcctgcttctgccacaggactggagcacatatgtcctgcaagtctgtctgcctgccagcccttcccaggacccctgcttggtcacctcatattacctcataggattaagtatacagtgaagccctggatgccaggcctggctgcgttg

SEQ ID NO: 479137 - DNA, 704 bp, Homo sapiens
agcaaacaaccagcgtcattatgttccttggttctccacatacggtcaaaggtattatgtatagagtcactaaactccttgcctctcataagtggttaaccaggatatatctatatatctatatctatatctttatctatctgtctatctatctatctatctatctatctatctatctatctatctatatctggcactggagaaatgaccacaggatgagtccagggacccactgggccccgtgtaagtcagacctgagggcagtgcactcctctctgtctcagggaaggtctagaaatgacatccaagagccaagccctggcttaggggaccccaggaccctgcttaattctctacctcagtgtggcccagctggtacccaagctgcaagacaaagtcccgttactttcccctctgttttcctcaagcagaaggagtctctgtactccttctgtaccaagtcttctgtatcaagttcagaatatgttgggttgcacctgaagccagcatagctcttagtctcacccaaggctcatgtaaatctattttaaaccactacccaaccacaagctgaagggaaaaagacttcaaatatcaaacacaataagaatgcagtatttaaaatatagttttaaaagttattaaagaaagaactacaagtgacaccgagcgacaacaaacactaaggagggggaagtttcaaa

SEQ ID NO: 479138 - DNA, 571 bp, Homo sapiens
gtaactttgcagcagccactccagatgggctgctgctgccatcactatgtccctcctcttgggatttaatttgatcctctgccttgatggtgcttgcattctataccgtattttacttattgcatgttttcttatgtattttttgcatactaatctgcaacttcttgaaggactgaaagaggaggaagctgggaaccctgcacgtggttgccaagcaccaagacttgttcctggtcccaaccaactcttggggaagggacccaaaatagcagatggagagctattgcaggcaggctcctgccagtgtgcacctgcccagaccccctcccccaccagagttcacttgcctacagcctccccttactgcttcactggcaaatgcacatgtgtgggaccgtccactgccctgctgctgccctgccaaagtgttaatgctggcaccccctatcaagagtattgttgcaagcagaccaaaaacaccttggcccctccagggcagcaggtgcttaacctcaaacagtcacaggaaaaagccatgggcctggtcccatgcccttaaagttagtgaata

SEQ ID NO: 479139 - DNA, 671 bp, Homo sapiens
gtgagggtccgcggcttcattcttgaagtcaagacaaagagaagaaaaaatggtaagagctgctaatgaggaaaaacctagtatccagttgcacaccagcagacccaaggtccaggcccactctacagaccctggcactgaatcatcccccatgaacccaggatctaggcctaccccaacggactgcagcaccaagctggcacctatggacccaggatccagatccaggcttcaggataaggttgatctaggaagtggaaaattgtggaatcttggtaatttcaataagcaagtgttaggaacctgctgcactggatggcctgaggtgttcctggtccactggccacaacacttcaatggaggattctggccaaatttattctttggtgagcagctcactgccagctccggtgtccatgaggttcgtggagtctactgctgctcagattctgaagatacgtgaaaattctaaatcattgccttaattttctgattaaattaggctaagatttctctgtgcaaggctatccacgtataccactcacacatttttctatcattcataaaaattacattggaagaaataacatacacagcagctatcttttattaaactcttgttagtgttcctacatgaaactaggcatttttcatcaattgtgtaattttat

SEQ ID NO: 479140 - DNA, 827 bp, Homo sapiens
ctttaggctcctcctacctctaagacgacagtctaagcagggagttatggtgttggctggggcaattgacccagactgctttagacctgtaaggaaggtgtccataagtaaaaacgagatgtggctaaagcagaagggctacctccaggtgcacctgtgctcagctctcatgggagaagccccagctgggtctgtagtggtggatgaggggcagaggaaatctctctccaagagccttcacaagctccaagactgcctgactgctgaggtgatgcttcatacttaccttactgagcacagctttgcacctgtgcctctgctgaaaaaaatttctcagaagaagaaatttgggggactcaaggcctgccatctaaattttttggcccatgggaaacgttatttttccagtacttttgtagtgattgacaccgtcagtgaattatttttaaatctatgctctataaaagaagattcctacatataatacacagaaagttaccaaaatccatgttaaaatgctaattcaaaactaaaacttgaacagtattgaaaaataactgaagtggaaagctgcatttgaaataaatttgctttctgatatttaattagcttagtttatatttactgattttgaatgtttattttctaatggccaaatcggtaaaacagaagtacgtattctatccttttagtggttaaacatttaatgttcattgtaataataaaacttatgctacttttaaattacttgtctttcatggtgccatttgattgttctagaataaggagggttcttttttctattgatagtttttgggttagactct

SEQ ID NO: 479141 - DNA, 564 bp, Homo sapiens
aaaaggagtttatgctggagatttaagatttcataactgttctgctggataccggacttgcatcgggcctatagtccctttgttttgagcaatttctcctttttcaaatggaaacatttacacaatgcctgtttcccccgtttcagggccctcttctgcaggtctgctgaagtttgctggaggtccactccagccactgttcacctggatattaccagtggaggctgaagaacagcaaagattgctgcctgcctgttcctctggaagcttcatcccagaggggcaccgagatgccctgcccagtgatgaggaatctagagaagcagtctggccacagatgctttgccacgctgtggtgaattctgcgcagtccaaaccttccagcctccttagcacggtcaggggaaaactgcctactaatgtctcagtaatgggggatgcccctccccccaccaagctcaatcatttcagatcaacttcagactgctgtgctggcagtgaaaatttaaagcctgtggttcttagcttgctgggctctgtgggagtgggacctgctgaatgaga

SEQ ID NO: 479142 - DNA, 575 bp, Homo sapiens
actgttagagccctttctaactccccaagctgcaacattcaatacagaatttctacttgcattgtcatgcttggaaactgcctctatggagactattatcattccattagacagaagtggaaaggccaataccactatgagtggggacagtgctactactgggagattgaaaggctacttccaccggcaaaacaacaaaacaaaacaaaacaacaacaaaaaaacacttcattaaaatttaaaagctcaatgtctcttgcctcggagcagtttgatcttctgaagccttcttctctcaactcgtcaaagtcattcaccatccagccttgttccgttgctgtcaggacccttagctgcaagtcttttgaattttgctggaggtccaacccagaccctgtttgcctgggtatcagcagtggtggctgcagaacagtggatattggtgaactgcaaatctttcctctgaaagttttgtctccgaggagtacctggtcgtgtgaggtgtcagtccacccctactggggggtgcctcccagtttggctactcggggtcagggacccacttgaagaggcag

SEQ ID NO: 479143 - DNA, 950 bp, Homo sapiens
agctagcaaacccatatcagcatggttccaacagttgcccagttcatagatgctatgcccacagaaatggaatttaaaggggcagttggccttgctgagctgtgttgggctccacccagttcaaatttcctggcagctgcccgcctgttggagtttgctggaggtctgctccagacactatttgcctggctatcaccagcggagcctgcagaacagcaaatattgcagaacagcaaatactgctgtctgatccttcctgtggaagctttgtcccagaatggcactcgcatgtatggggtagctgaaataccatgctgggagaaccactgctctcttcagagctgtcagacaggaatgtttaagtctgcagaagtttctgctgccctttgttcagctatgccctaccccccagaggtggagtctacagaagcagcagacctagctgagctgtgtagagctgtgagaatatcaccatcctctggaacacagaataagagatttaacaacagcttgcaccatgcagcaggaaaagccatggatgcttatcgccagttcatcaatgcaactgcaaaagctataccctgcagagccagaaaggcagagctgtccaaggctttgggagcccacttcttgcatcagtgtggcgtggatgagcagaagtctgcacagctggcagaattgtgagtcaattaaatttattttctttatagattacccagtctcagagagccagtattcacgttctcagagttttttttcagcttggtctgttctgctgttaatagttgtggttgcattgtgaaattcttgtagtgtgtttttcagctctatcaggtcagttagattcttttttataatggctattttgtctgtcatgtccattatcatttttattgtgattcttagttttcttggattgggtttttaaattctcctgaatctcaataatc

SEQ ID NO: 479144 - DNA, 740 bp, Homo sapiens
ttgtggccactattatgtacagcagctgcactgttctggagaaccccaaaatggcggtgtgcccttcttctggtaactccatcccagggaaatacaagagctgctgctggtccaaaaacactggcagatatggtggctggagaccaactttgggaggtcccacccagcgaggagaaacaggatcaggaactcatgcacaaaaactggccgtttttcctagagaagctgcagcaacagccaacggcaaagacagtggcccacccctccctctgggagctccatctcggggaaggctgctattggaggctggctggagtcacaggccagagaatcttatcctgcgaggtgctgtgtatgtggggcctgtagactgtcattgctcagctctttggattcagcccctttcctgggtgcatgtatgggagcataaccatcccctttgccagagatgcagctgctattgctgggatgcctgggaatccaaggctcccaggacttgtgtgtgcctgagcagcaactctgccaagaccatgtagctttctgtgtcagattcaaggccctgatggagtaggtttttttgtgaggtataaagttaggttatttgacatcttttttaatgtaggtgtttacactgtaaatgtttattgcatttgctgaatcctgtaagttttgggaagttatgcttttactcttttccatctcaagatattttaaaattattttttaaatttcctctttca

SEQ ID NO: 479145 - DNA, 630 bp, Homo sapiens
acagcacagtgttcgagctctgctaagggtcagactgcctcctcaagttggtccctgacccccatgtatcctgactcggagacacctcccagtagaggccaacagatatgtcatacagaagagatctggctggcatctagcaggtgaccctctgggatgaagcttcaagaagaaagaacgggcagcaatctttgctgttctgcacttctgttggtgatacccaggaaaacagggtcgggagtggacctccagcaaactccagcagacctgcagcagaggggcaagactgttagaaggaaaactaacacacagaaaggaatagcacgtccactcaaagaccccatccaaaggtcaccaacatcaaagactaaagcaaaggaacaaaactggatggagaatgagtttgacgaattgacagaagtaagattcagaaggtgggtaataacaaactcctctgagctgaaggagaatgttctaacccaatggaaggaagctaaaaaccttgaaaaaaggttagatgaattgctaactagaataaccagtttagagaaaaacttaaatgacctgatggagctgaaaaacacagcacaagaacttcatgaagtatacacaagtatcaatagctgaatt

SEQ ID NO: 479146 - DNA, 871 bp, Homo sapiens
gagaactcaggcagggctggggtgatgataaacaagctcctgtggaattgtgggtagacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggtccaaagtttgcctcaaagacccctcggccggtgactgaaccattgcttctgctttcggggatgcagctggccaagctgatccgacagagaaaggtgaaatgtatagatgttgttcaggcttatatcaacagaatcaaggacgtgaacccaatgatcaatggaattgtcaagtacagggggtcagttgttgcagagcttgtttttgtgtatgaggacatagataaagacctgagagaaaatcaaaattttgaccttgttgaaaataatgagtttgggctactactaggagactggagagggtgcttgtgggtaaatggggggagcatggcagggcagtgactgtcaggggattggagatttgaagagagagaaaacaggactgtttctaagacagagaccttaggtaaaataaaaagatgctcagaaataattttatgaagttcatgcatgctatgtgtgacatctgtgcttttttcctccctcctgtaaagggcccccaaatgggcttactgtcctgataacagtgtttttattttactagaaatttaaaacactggcattaagatgaaaaatatgtgtaaagcacctagtatagaa

SEQ ID NO: 479147 - DNA, 623 bp, Homo sapiens
aaaggacatgcattcatccgggatgctgaaagtagacccccaatatcttctcattgttaaggtttctgctgagagatctactgcttgcctgatggagtactctctgaatgggaagacttggggattggtgcctatggctactctcagctggagctgcccagagcaccaaaagcttccaggctccaagccctctgaaggcccatctctgcctgctctccatcagatcttcctgccagctcatacacccacgggcgacaagggttcccctatagctaggatcccaaagattcctggtgaaggaccttcagctgcaggtctgttggagtttgctggaggtcccctgcagaccctgtttgcctgggtatcagcagcagaggctgcaaaacagcgaatattggtgaacagcaaatgttgctgcctgatcgttcctccggaagttttgtctcagaggagtacctggccgtgttgattgtgttttttttctatactgactattttgtctttcagctcctgtatgtttttattgtgaattctagcttccttagattgggttttaatattttccaggatctcaatgatctttctttctatctatattctgaattctatttatctcatttcag

SEQ ID NO: 479148 - DNA, 624 bp, Homo sapiens
agctcgaacgccatgctgagaggacccctgctctcttcagagctgtcagacaaggacgtgtggggaaaggtgacagaagccccactttggtcaccattgctggaaatgcactgggtaagccctgaaaccagcaaaacactgagtttcaaccaatgtccacagcgactactgcctggttaccacctatggttcactccagccccccaaaactctacaacgagcatgtggcaaatccagctagactgtgtcattcctcctagccctggatggggccatagatgctgtcagggtccaggtcctagatttggaaaccttagaaatctacctggtgctttcagaagtgcctttctccatgggcaccagtgccccagacctgtggtggttattgcctgtgaccaccatcaacatttactcaagtcccaggagctccttagtcagcttgtagcaaatgctgccagtcatgagtcttcttcagggcagtggactcccctctggcccatgaatgtagtttatgataactaatatgccgtgtaaacttgaaaatatgttttctgctgtttttgcataaagcattttatgaatgttgtagtataatttaaaaatatattttaggtctttgtcttt

SEQ ID NO: 479149 - DNA, 726 bp, Homo sapiens
taggcttaaatcaatcactgacggaatgaatgtttgtgagtctttctcgcctttcctcttggcaaggatcagccaactatcaactcaatatgcatcacaaaaccagaagactttaagaatgtcagcaaagggctttagccctttagccacagggcagacaatattgcaaatcagaggagggtttaattacaaaggcggcagaacaataaagaagagtaaatgtccaaccttgacaagtttccagagtcagggccctgagaaggaaaatggaagcatttggctgaatctcaagccaaagaattttgtactggcagatttccctgaaccctccaggctaggcgaaatagcccacctcttgctaggaaagacccgctgtctctcttttccaggagagcaagcaaagatctcacctgagttacatgtcttgcaagactatgcctgtcaccttcaaattcttctcacttcctttattgcctccagactagtaactaaatttggctctaattatagctggagctaggaaagcggtttcttcttggagggattagctagacacagcaaaacgatgtcaagaccctgaatataattggcaagaattggtaaaagacataggatagaaatatggacacggacctggagatatccagactccttttcactctaacagtctgtaattctaccgagagggagggaaaggatggatgacctctgaaagtctttctgaac

SEQ ID NO: 479150 - DNA, 856 bp, Homo sapiens
ctctctactcctatacccccaactactcaagccagaagtttgagattaattcattcattctatgcatcactattttcctcaaccctcacttccaccattttcaggatggagcccctgagagctgaactgcagtgactcctatttctcttctggatctagccacccagcagagctagcaggtgctggactgatactggggagtgtctgcaaagagtcctgcaatgtgatccatcttcaggtctctcagccatgaataccagcacctactctggtgaagaagagatgactccagataggaagttcatggagaaagtatgcaattataagtgtggtctaaggagactcagccataaaaaggaacaaaataatgaccttcacaacaacctggatgaaattgcagaccattattttgagttaagtaactcaggaatggaaaatcaaacgttatatgttctcactcataactccctttttggtgctaccccttcctacaaattccatctacctcagcagtcttacaccctgttcattccatctcacatcattaggtctttaaaacccaaacatgcacttctgaaatttcatcaaagacaaaaaagtacatcttatgaactgaatgtttgtatccacctcaaagttcacatgttgaaagttctacccctcaaggtgatggttttaggaggtacaacctttgagaggtgattaggtcactaaagtagagccttcaggaatgggatttgttttctcatagaagagaccctaaaagcgtattgactgttctaccatgtgaggacatggcaagaaggcactagaaagtggaccttcaccagacactgaatctgctgaaaacttgatc

SEQ ID NO: 479151 - DNA, 898 bp, Homo sapiens
cttctgattgtgctctcctatctgaaactggaatccaagatttattataattagtacagatagtgtttaggagcctaggatgggctttgctgggtattctcctccaggtattcaggcttctcctgatctgttggagatcagaagaagcctagcattgaaaagacaatttgttacttacagttcccaagaggtaggagcatgccacaccatgcaaaaaggtcacatggagaagtatcagagttggggaaggaagcaggaggaatatgaaaagaatgagggcccagtggggccagccaagaagactgggcttttaggcttttaccccagcttcaatcaaagcaccaatacctgtttccacttcacatgctggaaccaaggatttctgagtgaagtcattctgggactctggatagaagaagaaaagataaccagagctggagcagatggccagagtaaaggagacttggccgtgactctaagttcctttgtctacaacagctgttctccatggagtcagagatcattaatagttgattttgaccatatacatactagcagcagtcaagatacaattcttcagtcttccctggaactgcagatggccacagaacctaatgatgatgataattatctgagtgatgatagtgtcaacgatgacaatgatgacaccgttgctgatggtgattatgatgatgattctaaaacctgccaactttaggtcctgagtagtaatggaccagtagaagtctgagaagtccagattatatccacagaaaacatagatgacggattgttcagttagtgtagaaagaaggaatgtgtaggtactaagaatccagacagtgcaaaccaggtcagagcttgtgtaatctaatggactctggagtaaaggatgctt

SEQ ID NO: 479152 - DNA, 689 bp, Homo sapiens
ttttctgcctcatgcccctcagtccaattccttcttctgaggaggcaggaattgagattgctgtaggattgttgcagatctgtacggattggacgccggtaactccgggaaaagaggggcgaggggaagaaggaatgtctgccaacgggtatgaagtttcttttaaaagtgatgaaaaccatctgaaattacatattactgatgtttgcacaaccattgaccatggacccacagatgttgctaaacatcttataatgcacaagacagtccctatagccaagagttatcaggcgctgaacatcaatactgccatggctgagaggcactgcctcagtttaggatacagagagaacatttctggcagaggaaaaaccttatatagagagctgacactattggagaaccccaagcaaatcattgaaactgaagtgtggaccataggagtaaaacaaagctttgagaacacttcctctctcctcactcctcctctctgacttaactcagacgaaacctttgcaattattttaatttctccctctcttcttgacggccatttcctaggtagcactaagaacgtttaaaattattataggctaataagagtatttatttttaatatgggctttctagttaaaagtatatttatttagcatttatattactttcaagtaatccatgcatcacacaga

SEQ ID NO: 479153 - DNA, 576 bp, Homo sapiens
gacttcaaagaagatactgaagaaaggaaagttttcatggatgaaatggaataccctacacaaccactatctgcttatggcagaacgcttaagtcaaatccagctccaagtccaggatccctttccatcctatgttggtgtagcttttgagagtctaagaacctatgggctacaaggtggggaaaaagtgacgatattagtaaaagacattaataaaaccttcagtgataaaatgagtaattactggaaacctactgtacagcatgaagataaaagggaggttcacaaaagtcagtgtgatacaactcaagcaaagtgtgaaatgttgaccaaaatgatcaaagaatccgaactaggattggaactgttaggacataacagtgagacgaaatcaataaacaccatcttactatctgagaatgagattccttttgtgaaggagactatttttgttgaggaaataactggaaatactacttcaagtaggtcagattcatttttggaatatgtcatggcattaaaagagagggaaaaacgtacctattgaagactaaggcagtattttctttggaattt

SEQ ID NO: 479154 - DNA, 1112 bp, Homo sapiens
ttaggaaattcgctaaataagattgagaaatcgtcactcagagacagctctgtggcctgtaagatgaagaaagagactcaggagctgaagaagaatctcaaggagagattgaaaaagaaagaacaagttaaaagccaatggtgccaagttccagacacaaggagaattaatggaatagcatcagtaaagggctttagactcctcacaggaagttccccagcctcattaaaggatttttccagtgaagccagtgataatggtccttttacttctctggtcatgtggcttttagaactattaacctatagccactggcagctttgtggcctaccctgtggggaaattaaagcagaaggagaacaaaagaaaatagtggtcagaagcaagcatagagagaatcttgctgacatgcatggtcctaaatccagtcgccttcaaggcagtgtaggagttttgaacatggatcctggagataggaagattttggccctacagaaacgggatgtggaagacttatatggacagaaatgtgtgtgcatttcacatattaaacaggaagtggatagatctttaggaagacatttagaggtggaagaagagtatatataggccaagaacagagatctgaattctcactcttcccatgctcttttttaaagataatttagcctataatcagggttgacatcttacattcttggatgtgagacactgaccagttgcagtcttggatctgggacaatggttgtaattaatttgtaaggcagtcagatgatattatgagtgtgaccaggtcttgcattgtagtgaacattaacctgtcaagcaaatattacagttgcctaaaccctatgagtcaattgaaggaaaaactaaaatgaatctattatattactgagttcacttattgaaaaataaggacataagactaaaagagattgtaggagaatctcatgctggagatgagagtgtaaaaatattaggcaaaattgtattccagttaccatgtgtttaagcaacatatgaagagtaacacttctaattatttagggaagttgcctgtaataaagccaatgtttagagcctgagtcttccactgaattctgagcttt

SEQ ID NO: 479155 - DNA, 1025 bp, Homo sapiens
gacggtggaagccctagtgtgtagctctagcatggaaaaaccacagacatctgactccaacccacaagaactgatgtgttggctgagcccaggaaagccatgggagtggcacttttctaggctttggggacccaacccccacaccagtgtgcccaaaataactactctgctgtttgacagttcttcagcttatctgagctccttccccattttctctgacacgcactacccctgtaaacatgctcaagtgaccaaaaggagacctgtgtggctggagtataatgggaatggggaaaagattagatcagatgaaagtagttctaagaagctaagaagctccagcatctttattcctgtgcaggtaggggcaaagacaattcaagaggctgagcaggaaagaaagaacacacaaggtgagcgtattgcctcagctagtctgtgtttacatgtgagtcacctttttgaagacttattttgagaatgaggttttaatactaataccacttcggtgatatttataaattccatgacttcaaggctacactacaaactaatgtatatgagaagtgagaaataaatagagggagaaaaagagagagagagaaggaagaagaagggagggaaggagggagacagagagggagggagggggagagagagagacagagagacagagagaacaacacaaaaactataaggatttcaacagtaagaaattaaagagcgataatagcaaacacccagcatttattaagatttagtaaatgtcaggcactattttaagttttcctaattcttcactgcaaactggttatgattaataatagctctcaataatgaaatattatcacaattttgtgaaagaggcattattatcattcctcttttatgatgacactgaggctggagaaaggttcagccatttcatcaaatgtactcatttaggaaaagatagaaccgagcctcagaactggccttcacagtccaagtgctctgtgcctcaccttctccatgtttcctcctct

SEQ ID NO: 479156 - DNA, 1164 bp, Homo sapiens
ctactgtataatcaaggattttcacttctgattagatatccaaagtaccaatatgggtagggctcaaggaacaattcattctgagatttttttctcaagctgtaagcctgggaaatcaaattatgtacttccaaaattcgatggtggtacagggataacattggcattcctgttccaaaagggagaaataggaaagaaagaaggaacttctctaattactcttcttcagagagagtctgtgtcctgcatccctccacagccagccactggctgcgcttcatttcctgcagaagctcagttacttgggtacttctcaggagcagctgttaggcaatctggagggcaaggcagtgatgctttgccttgggggagggctgcttatggagggagaaagcagcggcagtggaggcattcagaggtcttggatggagggtcttctgaggagtatcagggaggaaagaggcatgatcagaagtctccctcactggtgcctccaccccttgaggtttctaaggtaaaagcacttgtgatctgcccaggtctagaggccccagagtcagtgagggtcactgatgagaaagtagaaacaccaggtcattgggatcacccttgtgaaagctgcctgcctcaggaagagatgagccacgacctgacagcctggcccacattcgtactcctcaaatatatccctcttctcacaccaagaatgattcttcgttccagaggtgagataaaagtaaaagaatttaaagctgtcaaacaatctgtgtggaagtgaagtatgagaaacagtacagttgtttttaaaaaactgtgtcctgggagttggaagacctgccttctgggcctgaaaccttggtcaaaccttggcataaccttagagaagtaaagcaatctctcctggtctttgtttctacatcctgttgaattggtgaaatgttgttggcaatgaaagttaaagaaaaagagagaagccctgggttctctctcaattagttgaccgtaaactcagtatcgatctgtgacatgatgtaactctgatgaaattaaggcgatattagactgcttaaggagggagatgtctgttctattttgttctgtactgatcagattgtctgaaatacaaagactagttcttaattatgcttttagaggacatattaa

SEQ ID NO: 479157 - DNA, 3451 bp, Homo sapiens
cggccagagtgggcgctaaggccgaggaggccccgagagcgagcgagggctggttcgtcttctcatgccaggaaaatttaggacacagacacacacgaggagtttaggagcggaggtttaatagggaagagaaagaaaggaaaacaactctctctctagtgagagagaggcgacttctgagaggaaaggctggcaggtggcagacctgctggattttatagtcagggaaaaaactctttcaaacaatgtttctcctctactctaacaccataacaatcaacacagatttctctgtgaccaaatatgcagagaaattttccccacgctccaagcagcagacaccagactacctcttcccgaccagttgcaagtcagaacctatgaatggaattagtgcccttgcaaatcaggctccagagagctgccttgcccttttttcatgcaaaaccagtgagaaggtgtcatctatgagccagaaaatggaccctcatcagataccaaatctgccaatgacttggtgtttaacttcccagcctcagaataataaaaaagtatctaaaatatattctgtactggaatgcaatgacttgaagaaagccctcaattttgcagcaaccagatttagcaaagtattaaaaaaagatatataaagcaataactgacaagttttgtcttctgaaatacttgtcagtaaaattctctgaatagaaggaaaaagacaatagctatgaaaatatttggactgaaatatttatacattttaacatcaaaaatataagaatatactccatttttaagaatttgcccttggcttagagttatttcacatccacagagagaatatgttctcaactgaaattataaaacagagcatgtggtccatagatgatgtcagaaactttaaatatgttaactataacatgaaactttgaaaaagattacaaactttatttatgagaaaaacaataagaccatattgaagagtgtattcttcagagaaaaacaatagcagtgacacagtgagagaaatacgtatgtttaagaaactgattaaagtacacgaatatgtgccaagaataattattatggttattccaatttaatgctcagctaatcaaatagaaaaaatgtttaaaacatttttaaatttaaatacatgaatgcatgccatttttatttttaaaagtgttttatgctttcaaaaagttttaaatatatttatacacaaatacaacagaacttgtctgtcaataaatatatattttaaaatgctattttttttaattaataaaatttatttttagagaaggtttggttcacagaaaattaagcagaaagtacagatagttcccgtttacctcctgtttccatacatgtacagcctaccccactatcaatatcctgtaccagagtggtacatttgttacaattgatgaacttacatctcactttattatcaaccaaagtccatagtttacattaaagtttattcactattggtgttgtgcattccatgggttttgacaagtgtgtaagtatataacatgtattcactattaagcatattaaagaatagtttacacagccccaaaccctctatgctctgcctattcatccctcccttccctcatcccttggcaaccactaatctttttactgtctccatagttttgtttttccagaatatcatatagttaaatagtattaagcctttttaagattggtttctttcacgtgataataaacacttaagtttcctctgtgccttttcatagcttgatagctcatctatttttagtgctgcataatatattatctggatatactatagtttatttatgtgctcacctattaaaggatgtcttgttgcttccaagttttggcaattatgaataaagtagatatctgtgtggacaaaagttttcgactcctgtgggtaaatactaaggaatataattgctgattcatatgttaagagaaggtttagttttgtaaaaaactgtcaaactatcttccaaagtggctgtactattttgcatttccaccagaaatgaatgagagttcctgttgctccatttcctcaccaacatctgatgtcaatattttggatttcaactattctaatagatgtgtagtgctttctcattgttttttaatgggcagttccctaatgacacacagtgttgaacatgtcttcagatgctgaattactttccatatattttctttggtgaggtgtctgtttaggtcttttgcccattttttaattggggtgtttattttctcattgttgcattttaaaatttatttgtatattttaaataccagccctttatcagatgtgtcttttgcaagtatgttctcctagtctgtggctcatctatcttcttattctcttggaattgtcttcagaatcattgtgaagcagaaatgtttaattttaatgaagtcttgctattaataatttctttcctggattatgccttgggtgttgtatttttaaaaagtcagtgccatagccaaggtcatctagatttttttctgttatcttctaggtgttttatagttttgtaatttaggtctatggtccaatttaagttattttttctgaaggatatgaggaagttctatatctaaatttgatttattttgcttgtggatatccaggtgttccaagaccatttgctgaagattatttttgctccattgcattgctttgctcctttgtcaagtcaggggactgcatttatgtggttctatttggagctttcaaattctattccattaatctactggaatagttttgccaataccacaccctcttgattactgtagctatatagtatgtcttaaagtaggatagtgtcaattcaccaactttgttcttctccagtagtgagttggatattctgttttctgggttttttgttttgctttgtttttatttttctacttttccatgtataaatgttagaatcaatttgtcaatatctaacttgctggaatgggattgtattgaatcttagatcatattggaaagactatcatattgacaatgttgtcttcctattcatgaacgtgggatatctttagtatagtcctttttcatattttgcagttttccttatatatacctttatatattttgctagatttatgcctaaatatttatttcatttttaggagtactaatgtaaatttttttgtgttttttaaatgtcaagttccacctgtttattgttggtatatagaaaagttattttcttttgtatattcaccttgtatcctaaaactggtataattgctcgttagttccatttttttaaatatactttcagattttccacacagatgattattttatctgtgaacaaagacagcttatttatttcttcccaatctgtagcccttctattttatgttcttgtcctactgcattagctaagatttc

SEQ ID NO: 479158 - DNA, 1395 bp, Homo sapiens
cttaagtagacttcagtgtctgttttcccttctttagaagaatcaaggttttgcagccatctttaatgtgccctaccagtgctttccgattgggttccaaattaagagatgttgcatggaaaaggatttggtggtcagttgaaaatcaatgcatctggttcacctggaatcttgagctgcatatttttagcatcagaaaagcctgtattgccagcattactggagaaaaagcagataaccccacaacgtcctccagccaaggaggagggcagagggctcagaggagcagaaggttgaaatttatattttgcatacaaattatccttgcgtttgatcacctcaacagccctgaagatggagccaataatattcttccaatcaccaacccttctgctactattactgccatcactgcaacttccaggatcttcttttatatgtggactctaaacaaatcaaacttatggaaacagtgagtagaacattggttgccagggcttgggagtggagaaaatgtgattttggttaaagtctgaaaactttaagttacaagatgagtctttgaggaatcaccacaatgtctttaattaattgtgtgtatatattgtgtgtataatttaattaattgtgtgtatatattaattgtgtgtatatacatatatatggataggcatctatctatctatccatatatacttggtacctgtataagcttggctttgcctagttcctatttatctatctatccatataaatctggtaaatagagagcatataggcaatattaacattatctatacctcatacttcaaaatagcatattggagattccttgatgtttttctcacttccactttcttcattctaataatcaccaatttccattcattctacaccctaaatttctctcaaactcacatttcccttagctcccataataactgccttattacaagtcttcactgatgcatggaccattgcaatgacatcttaagctgtgaacaccctgaagtcaggcattatgctttgcctacttctatcactaaaacaccagtacagtgcctttcacattgtgatgagaggaaacatgtgaaaaggttttataagagtagtgacattagagatagtccttgagaaatgaatacgattttcacatttacgtattaattcattcacttctctagttctttgtttatttagtacataattgttgaaactatatgttgtacccacactatgctagccattgaggataggatggtgagcataatggaacttgcagtctaggtgaggacatagacactaatccaatgatcacatacatgtgtcattaccaatgattgtaactattacataataagaaatgtttaatatttgtggaaagcagtgtggcaa

SEQ ID NO: 479159 - DNA, 644 bp, Homo sapiens
cactgttcgtggggcagcaggatgtggaaagtcagtatgcagtgtatcgagaagccaggatcaggtctacttgataccaaaattttccctcttagctgttatcgatactgcctgcatttcgctgaaacccagggaagatccaaaatttggaaacccactaatgaatgttgctggtcgagaaggggttgggtgagagtgaaagctgaaggacatgatgctggagatggggtcatattggatctctatgcaaagcaatattgtgcatacagcagttactggtgtatgctttacttgacacaccagataaaaacatattactgtgcttcatctttcagattcagtgaaaaggtgccgtctatgaagaacagactctcaccagacactgaatctatggataccctgatcttggacttctcagtctctgaactcaagcaggaaaatgggcatacgcttgcatgcaagttgtattcctttattgcatctgacaaggagcaaactctggaagaagttaaacctgtaattgatcgagctttacccttgactgtgcccatgtctcccaaggaatgttccacttctctgaaggcttactagggtaattaaaaaggggagtcaaggtgcttatttgtgggaccaggagacaagtc

SEQ ID NO: 479160 - DNA, 559 bp, Homo sapiens
gttcagctcccacatatacaccatggaataccatgcagccattaaaaggaacaagaccatgtccttttcagggacatggatggagccggaagtgattatcctcagcaaactaacacaggaacagaaaaccaaacaccacatgttctcacttataaatgggagccagcctttagaagggaagatacagtggagagagagccatgagtcagatatacagggtccaaagtgccatgctgagggttcagagtttatccagtggacaaagaggaatggagaggttttgagcaagacaggaacagattgtgccttgagtgttagagagcattacgctggctactggcagtgctatagagaactggttggaaggactgtgactgaggcaagaagaccatggagggagactagtgtagtgagcagggagatagaaaccacagccactgattctgaagatcatcttgttttggaaaccagcgggctagaataaccaggtggatcagccagtggttgaattatcagggttacttacctgggtaagatgcagaagcttgctgtctgtatt

SEQ ID NO: 479161 - DNA, 520 bp, Homo sapiens
tctgaatacatcatgctccttcatgggtttgtgctctggctcagacagtttcctgtgcccagaacgccctttctctctctcttttacaacgtgtctctactgccctgatctctatccaattccttattcatggttgatggtttggttttctagaacagtggttctcagccactcttacttttgcccccaccccaggggactttggcaatgtctggagacatttttggttgtcacaactaaagtaatggtgctattggcatttaataggtggaggctacagatgctgctaaacatattacaatgcgtaggacaatctcgacaacaaagagtgatctgggttaaaatgtcaatagtgcagaagtcgagaaatcctgctctgcccttgctcctccttgtgtgttctgcagaccagcaacatctgcatcatctgtttgtcaaagatcagatagttgtagatatatgtaactaacctgcacaatgtgcacatgtaccctaaaacttaaagtataataaaaaaaaa

SEQ ID NO: 479162 - DNA, 939 bp, Homo sapiens
ctgccagcacgctgtcacctctcaccaacatggagatgagcactggaaacagcccagggtatagcagtgcaggtgggaagaactggatggatccaggatatatttgggacctagggttcacaggagactttgtggattcgataaaatccaacacatccaaatgggctgccacatcctttgaggagcttctcctaggctttctagctctctcccacatccagcaagttttagcagatccaaccaacattcatgagcaccaaccctgtgctgggctcaaggtgggcactagaggtatgggggctgtccttcatggagactgccatccagggagcaggggtgggaatgcaggaaggaaaggagacatattgcatgcatgtccccagaacacaagctggagtaagtgctgtgataacagcaccaccaaggctaatagaaaacttaagggagctattgaattcctgcgaagaatagagacagatctgggaagacttccaggaggaggtggcatttgagtaggaccttgccaagtggaaataggagagagggaaactctggggaaaaggaccagcctgggcaaaggcatgatgccaagtggatatacaatatatatcatgggagaatgacttgaagcctctgatgtcacagatgtattgagaagcagaggtttctagtcctctcctaaaagagagagaactggggatttctaaggtatctctatctaccctcttactcacctctccccacaagaggaataatggatttgattggaagaggtggtgttgaagctgaagcttgaactctagggtgtatatggaaatgcagacataaaaggcgggtcttcttcatggagaagtgtctcaagcaagaacaagggagtaacaaatatgaggaggaacaggaagtcatgaggaccactagctcatataaagaagcattctg

SEQ ID NO: 479163 - DNA, 602 bp, Homo sapiens
gtgcaaagggcttggcagcacatcccagagccgagcacagggcccgtacaaaatgaggtttgtgggaacatgctgtgagcagaggagccgcagagggctcagggccctggagctcttccatctgcaaaacggtgcagaagcagcaggagattgtcctggagggagggatcctgcccttgggaccctgccccatgatgctgggaacatctgtgagagagtgcagcgtagttggccagcagcggccagcatatctgagacttattctaaagcccaagctcctccgctggacttcacaaagaagagtgggcgttggcgatctgtgggttcccagatgcagagtcgtcagtactcaaaatacaccgtcagatgttctgcttttgtgtctggactatgtgaaattgtgaggagaagcagcatttctgccaagtgccaacacgttttaaacactgaagcaagataggctctaatttgccttaagactcagtattttttattcagcaggtaagtttttagattcttagactaatgacaaagaacacatcccaattcttagccttctttttaccactggctacactaatacgattttaagcacattttaa

SEQ ID NO: 479164 - DNA, 787 bp, Homo sapiens
accatttcccagccgcagagcatctgtctcctcccaggtggccgctgtatcacagccatcatggccgtacattctctggcatcacagggacaagaaacaaacttgcagaattggtgtcaacatgtgggaaaagattctggagacaatggcagggtactcttcttaccctgaggaaccaaatggctatgaggagggggtaggggaagaaggggtggcaaatcagaaatgttttagcaagattccagagcaggaacaaaaattatgggtatcttgtacagagctccttgtgaatagaatttctgaatcacaaataatacacatctttgacttaatagacattctcaaatcattctacaatgtgtcaaatttgcaatctgattattcctgtatgagaggtcctgatttcaagggcctcttcgttgaacttccatcctcctctctcctcttcattgaacttccatcctcctctctagttccctctaactcactcctttatatagcccaagtgaccactaaaatacacagcagatcaaatcacatcttagctttaaatctttccatggatttccactgtgatttccaacaagaccgcaatgactcactgggccctgaatttgctccagagcctcaactcttgctgtcactacatctgaccagacccaccctcaacattacaaccaatgcttcagaatcctcttagctccttttccataagagtcctttctctcaccctctgtatacaccattttctctccttggaatgctctttctattaaaacctctcctg

SEQ ID NO: 479165 - DNA, 1596 bp, Homo sapiens
gaagagctgcttttctccctggaagggtcaagtcacagaacactgttcatcaaaatggtctaaataccagcatgacctggcagctagctgtcaggggagagtggttgcagcagaggagaaaaatggggtggttttcatctgaggagaagctcaacctgaagaatgttcagaggaatctgatcctcctacatccacagctgcttctccttgtagaccaaatacacctgggagaggagagtcccctggagacagcagcgagcttcttccacaatgtggatgttccttttgaggagactgtggtagatggtgtccatggggctttcatcagggtcactatagatgttcagagcttcaccatccacagagactctcagcaactggatgtgttcatagccaccagagaacatgcctacgcaatgtacctgtggacaggtgaggccgcaggacagtctgcctttgcacaggtcattgctgatcatcacaaaattctgtttgaccagaattcagccatcaagagcagcattgtccctgaggtgaaggactatgctgctattgtggaacagaacctgcagcattttaagccagtgaagactgctgaccggctgctgagattttcagataagagacaggctgaagaggccatcgacaggatttttgccgtaacacagcaacagcagcagcaaagcaagtcaaagaaaaaccgaagggcaggcgaatgctataaatctgtggatgctgtccctgatatttttgcacagattgaggtcaatgagaaaaagattagacagaaagctcagattcaggcacagaaagaactacccataaatgaagatgaagaaatgaaaaacctcttagattttgcagatataacatatgagaaacataaaaatggggcttgaggaaaggccgggttggacaggcatggatggtgacaactactcgtagcagggcctcatcactatctgcttcctataccagattgttcctcatcctgaacattgctattttctttgtcatgttggcaatacaactgactttttccagagggcccacaacctttttccagagggccaaagatgtctttatgcagttcttctaacagatagctgtattttattgtggttgtactcttcttgttcccaatcacagtgttagcactgaagctataagttgcctggtcattttgtgatcataaaagtccatgaaaaaaaaatttattaccccagtttatcagattttttccctcagattcattttaacaaattaagggaagatattttgacacaagaaagcaggaacatggagaaattggagcaggaaaggaatttatcaaggcaataggaatagcttggtggtcctatggtgtttccagaagtatttggcattgcaattgagcagtccaagtagtactacttttagaagaaacaaaaagtctgttttttaaagtaatgttttttcttatgagaaaaaggtttagatagaattgggttttattcatattaatttaatgctattagcaatttccatatactatattatggaaaagactgaagaacacaattctgagaaatattttaaaaattttaatggtatagt

SEQ ID NO: 479166 - DNA, 764 bp, Homo sapiens
ccgcgagggttggcggcttcattcttgaagtcacggtctcagcttatcaaagtcactcagggacgctagttctggaggttctaacaacatgtgcatccatgctcaatgctgcagggaaaaggaaacacggcaagtcacttaatcatcgtcaaagtttctgcctgaaagtaacacaggccactcctttccatgtccaattgcctaaaccctgtgacatgggcacacataactttaaaggcagtggtagtatttccatgagggaattccttcctggcagttttctggatctgaatgtcatattatttgaatacaacccagtaatgttgactggtgtttttcagtttttgaatattccctctaggctacagttctttgtaaatattttaactgaagaaatgcaaggagcagatgatatgaatgttgtggaagactccgacaggaaatcagagactgtacaaaaacctgaattagcaaaagcaatatcaatttcaatggcaaaatcaaaaccagaactagcagacaagaaaagcaaatatttttattttcattattaaaaaaacaaataacttacatgaagtaataggtgttctaaaactcagcttgaagatgcttttgtatgcaatcctcacaattgaacaaatgtccatgcaaggcaggaaattggctaggcaaataattctttgtgggttctacattttcattttaataatgataacttatagaagtatttgtggtaatatatttcattttagtaataattttta

SEQ ID NO: 479167 - DNA, 717 bp, Homo sapiens
aatttgtggttttggtttaggcctgggccaagcatggcatgcttttcagacctcatcttcctggcttttctgccagttgttaaccacttcctgctgttgagccctcagtgctccgctgctgtccactaccatatctccttctccttcttggctttccgagtacaggaacctttgtatcctcacccccacccagcacaatacaaggtgaatatggtggatgaggcaaaacttcttagtccaattcactcaacttttgaagcgttggttgtgggacatgcagtcacgtgttgtcgtgaagaattgggccctttctgtagaccaatgcgggctgcaggcattgcagtttttggtcacgaagatgtgtcttcttttcaatgtagtgagacagatcagcaaattaaaaaaagaaaacctgactgtgggaatatggaagactatgggactgtgggagaatgtcatgatccatgcgagcccactgctggtcctgaggtggaaccccagtcattgcattagggtatatcctaatccagcatggcttcattttaacttgataatatttgcaaataccttttttctaaataaggtacccagggttaggactttaacatatcttttttggggatagaattcaatccacaacattgacagagcagaaagaaaaatgtggccagttctattccccatgctgccaagtgaccataggtgaaccccctggaa

SEQ ID NO: 479168 - DNA, 1284 bp, Homo sapiens
tggaacaggctccaggagctcactactgacagtgaagaactttgtccaggatgtgggcttttcacaggggtgaggagcaatttccagatcagtacaaagcaaggaagttcactcacgctacctttattcaatgtagtactagaagtcctaccagagaaatcagatcaaaaaaaaaggaagaagaagaagaagaagaagaagaagaagaagaagaagaagaagaagaagaagaagaagaagaagaagaagaagaagaagaagaagaagaagagaaagaggaagaggaagaggaagaagaagacgaagacgaagacgaagaagaagaagaagaagaagaagaagaagaagaagaagaagaagaagaggaagaagaagaagaagaagaagaaataaaaggcatccaaaggggaaaggaagaagttatctctaattgtagatgacatgattctgtatgtagaaaacgccaaggactccaccaaaacggttagaactaagaaataaatttggttaagttgtaggagacaaaatcaatgtaatgaaaatcacttgcatttatatacacaaataacttagctgaaaaaattcaagaaaataatctaatttataatagcattaaaaatacttaggaataaattttaccaaagaggagatagacctatacactaaaaactataaaacattaatgcaagaaattgaagaatacacaaatcaatggaaagtaatcctgtgttcacacattgaaagaactgaggtttttaaagtggccatactacacatatgttgtatatttacagattcaacataatccctatcaaaatctcagtgatgttcttcacaaaaataggaaaaataatcctaaaatttgtatggaacaacagaagacctcgaatagccaaagcaattctcttaaaatatcctgtaaaagttgtattcataaatatattgcagtccatgcatataataagatcataagcaacaataaaaatcaagaactacaactgtttacacagagatgagcctcacaaacataatgttaatggttacatgagtatttgcataattattccttaaaatttactcttatgttttatgcacttttgtgtatgattgttatatttcacaataaaagaaagttaataaacaaaaacataaactggcaggtatattgtacttaacttcttagtggataatcctgaaaaatataaaccacaagagtataatgttttcccatatttctcggttttctaaattataatttaaaaagacaattggaaaataggcaaa

SEQ ID NO: 479169 - DNA, 649 bp, Homo sapiens
ctcccccttcacagaactggcacagcaacatgcagtaaaatccttaactttctaatagaaggaaaatgacttgtctgattcaaaggttataaagatgggcatgggctcgaggaaaagtcatcattcctggtctaggggttggctttcagatttgattattctaggcttcagagttaagaaggacataaccaagtcacaagagtttatatacagaaaggagtatgaaggccctcctgttacccacgctgtgggcctgaggcagatcacagcccagaggcagatggacttgcagctgagcaccatcatagccatcagtaaactaaagggcaagtccattggggatgtttcagatgctactgggctggctgagagaccatcaggaagtattcacttagctcagagatttcttctactgttttctcctgatttcaataggtcttcaagtctttctgctggtgctgatatgcagggaggaatttccaccaagtgtctcattcaaagcagcaacggcatcctctgcactgaagagattaaagatttgctacagcacctcaaggagtaaagcagtggcctcagccttctgtaactggctccatccagttcctttgtactgcccccaggaagtacaaagtcatatctgttcattaga

SEQ ID NO: 479170 - DNA, 1017 bp, Homo sapiens
agaagagcccaaggttcagggtcactcaatctcaacagcccagaagcatctgcaacctccccaatggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatgaaaactggttcaacatcgaaatgattctcattgactagtacaccatttcacacttcttgagttctgccgtttcaaatattaatttctgctatatccatgacttgagttgaatcaaaattttcaaacgtttcacacgtgttaagcaacacttctttagctccacagggacaaaatctttacagatgatcatgccaatctatctattctatctatttatctatctgtctgtcttctatctaatctatttaaatatttatttatttataagatttaaattattttaaattatgtttgttcaggtgcctttagcattttttctttcatttagaccttggagaatctgatgactacgtgtgctagggaaagtctttttctgtagcatttc

SEQ ID NO: 479171 - DNA, 1458 bp, Homo sapiens
taggttcctgccacccttgaccctgaaatggaataagtgcattggaaaatgaataaatgaatgaatgaacctacacataaagcaaggtcttcagagaacctagagctgaaggttcagagtcacccatctcaacaagtccaacagcatctgcaacatctacaatggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaatctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataagacctgatccaacacagaaacgactcccattgacgactacaccagcttgcactttcatgatctgccattttaaagactcttgtttctgctataaccataccatgagttgaatcaaacgcgtcaagtattttcaagtgtgttaagcaacatcgtgttcagttgcacaggaactagtcccttacagatgactaagctgatggatctatttatctatttattaaatgtatatttatttgacaataatatttaattttttgcccatataagtgcataaaatgtatacctttatattgttgataacataacaaaatatattttctatgtttagtcgatgtattattttgtttagtttattaaatatttactatagaaaacttcttggatttgtttattctctaaggagaaacaccaagccgattctccaacatgatttaaaaatgtatggttcaattcattgattcattgttattatactcaagttataagtacagtacaaatttacattctataagccagcttggcaggctgctagtaaggatgagaaagtaaagactagtactagggagactccttttatgggaatcttccatgattatccataaggaggtgggaagaggcgttactagtaagcatgttcttggttgtcctctgggtgcacatgtgcagtaactgcatatgcttgttgtaacaccgtatgtctcattagcatcttaaatcttctacccac

SEQ ID NO: 479172 - DNA, 1053 bp, Homo sapiens
agccttctgccatgattgcttctgcaggaagcaaagccttcagagaacctagagcccaaggttcagagtcacccatctcagcaagcccagaagcatctgcaatatctatgatggcctcgccctttgctttactgatggccctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacacctggtccaacatgaaacaattcttattgactcatataccaggtcacgctttcatgaattctgccatttcaaagactctcacttctgctataactatgaccatgctgataaactgatttatctatttaaatatttatttagctattcataagatttaaattatttttgttcatataacatcatgtgcatctttacactgtggggttttaaagtaattttaagagctctgtattcaattattagcttaatttaaagtgggtatcaaggctaccattttttaagggtctttctgattttctccttgggatcttgtttatcccatggaaacattttttctgtaaacttaagcctttttaaattatatatttgaa

SEQ ID NO: 479173 - DNA, 1203 bp, Homo sapiens
tgccaagaccagacttttttttttttttttgctaggcacaaagcaaggtcttcagagaacctggagcctaaggtttaggctcacccatttcaaccagtctagcagcatctgcaacatctacaatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgaaaactggttcaacatggaaatgattttcattgattcgtatgccagctcacctttttatgatctgccatttcaaagactcatgtttctgctatgaccatgacacgatttaaatcttttcaaatgtttttaggagtattaatcaacattgtattcagctcttaaggcactagtcccttacagaggaccatgctgactgatccattatctatttaaatatttttaaaatattatttatttaactatttataaaacaacttatttttgttcatattatgtcatgtgcacctttgcacagtggttaatgtaataaaatatgttctttgtatttggtaaatttattttgtgttgttcattgaacttttgctatggaaacttttgtacttgtttattctttaaaatgaaattccaagcctaattgtgcaacctgattacagaataactggtacacttcatttatccatcaatattatattcaagatataagtaaaaataaactttctgtaaaccaggttgt

SEQ ID NO: 479174 - DNA, 1032 bp, Homo sapiens
gagggctgccagcacgctgtcacctctcaccccaaaagttacctctctcctactgggtccggaatttattcctgctgagtttcttcctgctggtgggttcgtgacatcgcctacttcagcagcgaagccacagaccctcacagtgagtgttacagctcttaaagttggcgcgtctggagttgtttgttcctcccagcagcatttcctatgttaatgctttgtccactgagggacatatggactaatcagccatatcgtctcatgccctctgactcttatgtcactgaagactttggggaagtcacaatcacttcgttacacagcatttatctgcacccctgccggcaaacaggcctgaccatttttttggcactctgtctacttgacacatattatcaacagaatgtgtgcaagctacaccctgaattatcccatgatgaccttgcaaatgtaacacatgcccttgtgaccacaaggcccgacaactgtaatttcctctgcttttcatcagagctcttctgctgcctgcagcaggcacagcatgctagggtacagctgctccctgacgcccaagacacctgccctccatcctttactacgaatgacatcattggcccttaccctgactctccaaatgactctctggaagtctctccttgtgccttcatcctttcagagctaatgggtatccccttcaaggaacgttgtgtggcctcatcagcaaaaaggcgacatacctgtggtttggtacagggtgaactgagccaggaatctggggagcaatcctttattcccatcattgccactcgtgaccttggttccacaatggcccatgctctactttcctgttttcctccatgcttctctgctgcctacagcagcaagaaaaccaaacccctccctgaatcagggtacctgctccatatcttctggaccagttctccaaactggctgggcattgggaacagtggggaagttgttgaaacactcagatacgtgcagattctgattcactaggttaccaccaaatat

SEQ ID NO: 479175 - DNA, 1099 bp, Homo sapiens
tttgtttagcatgttttcaaggctccttcctattgtagcatgtttcagtgcctcgtcccttttcatgagaattttcctggacaatgaagggaaaggtgttcttgccaagtacgcacaaattctaatgataattccaaatcctgctgaatatgacgccttggcgcctcctcagcctcggcgtgtggccacacttgaggagccctacagcccgctgctgcactgtgggagcccctctctgggctggctgaggccagagatggctccgtttgtggggaggtgtggagggagaggcacaggcgggaaccggggctgcgcgctgtactcgcgggccagcgtgagctctgggtgggtgcgggctccacaggccctgtgcccggcgctgctggctctgggcagtgaggggcttagcacctgggccagcagctgcagagggtatgctggatcccccagcactggggacccgcccacaccacgcttgaattctcaccgggcctcagccgcctccccaacagggcagggctcgggacatgcagcctgccatgcccaaacacccactacccccccgcacccccactgtgggatctcatgcggctggagtctccctgccgcccactactcagcacgcctgggtcccatcgaccacccaagggctggggagtgcagacgcgcagcacaggactggcgggcagctctgcccacagcccggtgcgggatccactaggcgaagcctgctaggcttctgagtcgggtgcagacttggagaacttttaagtctagctaaaggtttgtaaatgcaccaatcagcactttgtgcctagctcaaggtttgtaaacgcatcaatcagtaccctgtgtcttcctcaaggtttgtaaatgcaccaatcagtgctctgtgtctagctaatctagtggggacttggagaacttttgtgtcaagctaaaggagtgtaaatgcaccaatcagcactctgtgtctagctcaaggttcataaatgcaccagtcagcacactgtcaaaatggaccaatcagctctctgtaaaatgggccaatcagctctctgtaaaatgggccaagcaactctctgtaagatggaccaat

SEQ ID NO: 479176 - DNA, 449 bp, Homo sapiens
gtacacacagcagccacacacaatgatgttccttgctgctcaaagtgtggtccacagaccagtagcattggcagcatctggatgcttgttggaaaagcttgtcttagatcccactccaggcctattgtatcagaagctgcatttcagcaaggtccccagacacggcaaccatccgatttctcaatcttttccccacctttcccgcctttctattccacaaaaccgccactgtcatcatagccggttctcaatgagctgttgggcacacctcccagacggggtggtggccgggcagaggggctcctcacatcccagtaggggcggccgggcagaggcgcccctcacctcccggacggggcggctggccgggcggggggctgacccccccacctccctctcggacggggcggctggccgggcagaggggctcctcacttcccagtaggggc

SEQ ID NO: 479177 - DNA, 579 bp, Homo sapiens
gctgcaacacaatacgaggggctggaagtgaacatgggcgaggggattggaatggtatataaatccaggacaagacttggtatttgtgtcggggcctttttcacacacactgatgaaaactacactcaccttaatgccaaaaaacccttgagaatttcctgtgccattgggcacattctccttcttctgaagtgtttcattcagctcatccactttgaccataatactaccctaaaagatttccaattgccagatttggaagatggaatgggaggaatgtggccaaataaagaagaattaccagttattgtctttgaaggaatggttaacaggaggattgatgatgtattctggtctctgccttatgcctctctggccctaactctgttcaggatccctcgagctgactctttctggatgtcaaaactgtgtgtgcttagcagcataaactcaaatttaggactggaggaactggagctgatctgatgtccctgtatttctggattccctttgctttccccacttcttttctcttctctaggcttgatcataaacctctattgcagcgtgtgaggggtt

SEQ ID NO: 479178 - DNA, 660 bp, Homo sapiens
aggagccagacaaaggctaatgcatcatccaaaatgagaagaattaatttcccaaactttaaactggttggcttaggattgggctcaggggaagggaacccagaagcccaacataccagcaaaagggcaacttctcgtgtaatcataagaggatcaacttcgataattgctctcaactggttgttgtcaacttccaatggcagccactacactcctcatcttcaaggctctcgtcttccttgggcttcccacttcgctcagcactcattcgctttcctgccatcctgtgaagaggagacttttgccataattgtaagttccctgaggcctcttcagccacgaagaacttttcactcaattgtaataccttgcaaaactgtggtacaatatcacaacctagatattgaccttgatacagtcaagacacagaacatttcaatcaacatgtaattcttctctgctgcttttttgtctcaggagtttttacactgactgatacatgaaatgattagttattttcgggtgtttatcaaatcaaatgctggtacattctaacatatagtaatactttcacttagaattatcaacaaggagagatggtgtatttttaactaataggtttgcattctcttgttcaagtctataattatagaagatata

SEQ ID NO: 479179 - DNA, 1034 bp, Homo sapiens
tgcctgagttgacagctgcagcagtgaggctgcagctgagctagcaggctcccactgactccatggaggatgcagcgctggccactcttcccccagtgcagccggcatcttcacagtggatatgccagatgggccgccactgccataaagaggacatataatattaccaaagcaccagccttatattcacaaaatttaggaagcacaatcatagacttgttaaatggttttggccaaaatgctgatagtgatatggacagtgaaatccaggttgaggtgttctcagttggagataaggaacttgtttggaactggagcaaaggtgacccttccactccagctgcagctaaaagggaccaaggtgcagctcaggctgtggcttccatgggtgccatcctcaagcattgtcagcttccacacggtgttggcctttttgccttttctggaatgtcacataattggcatcatggagagagagatttttcagacttgcttctttcacttcgcaatatgcgttgagattctttcatgcctttttacgtcttgataactcgtttctttttatcactgatattgcattggatattcttggtcttttcctttccattaacattttagagtcagtttcttaattcataaaaattaatttctgggatttttattgaaatgtcactaaatctgtacatcaaaactgatatattaaaatattgagttttctaatccatgaacatggactatttcttcatttatttggatattatttcatattactatcattttctatttgttttcacattcccacatagagatcatgtacaatattttaaaaatatttatatctaagtgtgtattaggagaggtactattataaatgctgttgtctaaaatttcaaatttttttcacacattgctattaaataggaaagcaattgacttgaatttaactttatatcatgtgactttgctacatccatttattagttccaggagattattattattattacttttaaaatttggggaatttttaatgt

SEQ ID NO: 479180 - DNA, 607 bp, Homo sapiens
gctattctccccagcctctggtggacttactcccgtggctttgctggtcacggcccacatgtcagctctcatggtgactccacccaaccttgaggcccagcctgcaaccctgtctaactgtagaactcaaaaagcagtaccacatggcctggaaatatactctgtggcctggcctgaacagaggcaatcacagtgcccagccagcagcttggccagattgcagaacacatccagtattctcatcagacagtggaagccagcaaacaatgccatccaaactcagagccaaggcagtggcccagtaatccagagaatcagaaagcaaactctgcttgcctgggattggtaccagctggtccatctagaaccacaagctagactatgtaagcgaaggtctaatcctgcccaagaacaggaaaaggtggaaaaggtggctgtctgctcaaatgtgtggagagcaacaaaaagacataaggattatgaagaatcagggaataatgacacctctaaaagaaactaataaagcttcaataatgaatcctaaagaaatggagatatatgaaaagactgacaaataatttgtaataattctcctaaagaagttcaa

SEQ ID NO: 479181 - DNA, 752 bp, Homo sapiens
cccacaacccccaacaggccccagtgtataatgttcccctccctgtgtccgcgtgttctcattgttcgactcatactttgtccacacaaggtggcgaatcctcctgggactcggtccatcccatcagggctctggactcccttcttgcccaggatgggtctagaaacaccatccagaggcaaaaacttggaatcaggttcttccggaatctgcctgctgctttattttactgtagctgaacatgtacccaaattgcaagacaaaatcctctgcacttcgctttttctcacaagcaaaaggagtcttcccctgagatgcactgcttggagggcagaggattcctgtctggcccaggctgttctaaaggctccctccatgggcatcagcagaattgtgagttgtgttgtgtttggctgtgacagcacagcactgagttctaacacaaggtttcatgcttgcttctctcttcctcctccaagcacataaattctgtactgcaaggagttgggaaggggtagtgtaagcaatacagtctgtccttcctatcctcttcagtgcctctttccttgtaatgtaattgctcacctgtttttggttcttatgaaggtgctttcttgtgtggatatttgtttaattatgtgctcctgttgggggatgattgctggaatgttctatgtatccatcttcctctgctgcctctcctgttgaattccatttgctagtaatttgttgaggatttctgcatcaatatt

SEQ ID NO: 479182 - DNA, 530 bp, Homo sapiens
tgtggagaaataggaacactgttgtgatgaagctgatttgatcatggtgaataagctttttgatgtgctgctggatttggtttgccagtgttttattgaagatttccacatcgatgccccttttctgcaggtctgctgcagttcactggaggtccaccccagaccctgtttagcctgggtatcaccagcagaggctgcagaacagcaaagacagctgcctgctccttcccctggaagcttcgtcccagaggtgcactggcctgatgctagccatagatctcctatgaggtgtctagatgctctgcccaatgaagagaaatgtagagaggcagtctggccacagccactttcccgcactttgttgatttccacccagtcccaacttccaggcctttttagcatgaataaatgcattgacactcctgattcaccactcatgagaggcaaggagtttagtgactctacacatagtacctttaaccatatgtgaagaaccaaggaacataatgaagctggttggttgctcctac

SEQ ID NO: 479183 - DNA, 5100 bp, Homo sapiens
ccgcgaggatccgtggtttcattcttgaagtcaatccttgaggaatcgccacactgtcttccacaatggttgaactagtttacagtcctacgaacagtgtgcctgcccagagattctgggcagactgtctggaagaatctgtaggcagacttgctgctgaagtccttgggcagtgtggactagtgcctgagtacacaaggatggatgtgcaccctggatctgctaaagctgggggacgtgggaactaccttggaggccggggctggtgtggcaatgggatgggcttggaacctgggtctgtgagagctagcagaaagccagagtccaagtgtcagcatagttggtgctttagtgcttctgcagacctggaagtttgccacccagcggagctaccaggctttgggctggtactggagagtgtctgcaaagagtcctgtgatgtgatccatcttcagatcttgcagccgtggctaccagcacctgctccagttgagggagcctgctgggatgatccaggtccttcaaaggggctgtggatgattttggcttcctggtatgttcctgtggtagttcttgaagcaaaaattcatgatgacttccagtaccatgctgaacaatgacgggaaaagtaggtatccttgttgtgtcccagaagttagaggtaaggctttcatttttttctcattcagtatgatactagctatgagtctgtttcatatggcttatgttatgttgagactctcacagccaccttcaaagaaatagcgcagttttaatacatactgagcttttcaaagaaatgaattaaaagttgtactattttagataatgttattccaggcttttttgggaattgtacactattgtagaaaatatcatcgatgacagtgttacttgtttattagtatacttgtgaactatttacttgtgcattagagctgccaatttaataccaacaccaatatcagtttgcattcataatttttaagttccaagtgagtctgcttatacatgagcatctgactgctccattgtcttctgaagaatagtaatgttgagcatttatgtattaaaacacaaattgttttattctatctttatttcattttatttctctttttcatcaaagttaaaacattgcattaattttttatgagaccaagaagctgtattgtctatggattttatctcaagatgtaaaatttttaaaaaaggtgtgtgtctctgatcaggctaaaaatcactggtataggagattcaaaaaaggtcatattagcctgttttattttctatactattgtataatcccccaaagatctaatttaccaaatacattgaatttgctgcaagaagttaaacattattcagattataataggtataataaatattgaatgaataacaaatggatgcaatgctcaaggttgcagaaggataaattttgacctgaaattatggaaataaggattggtgaatatgagaccattagaaagtgcatcaaagtttgaaaactccaagaaatcacaatgatgacaaacaaaggaaatgtgagttaagggggcaaataatgagagaagtactgaaagtggaaagaggggtgaattggaatgctaaagatacatatgcttgtgtatgtgttggtgggagtttgcccaagtttaggaaaattaaggtgagttatgtttttatatcaataatactgggataaacaaatgatctaagcaaaagaaaaagaattagaaatatggacttccattacattatataattcatataatgactatgaattcacaactagtgtaatatcatgattttttgtgttgttaagaattccagaaaacagagcttgctctcagcttttaatagtagcagccatttttttttcatctggtttttgtttgatggaagagaacaagaggtaatgatttccttaaatatgtcaatgatatatcagtaaactgtttttaaaaagaaacaatgattttctaggatacaacttttttgcttggagaataaagcggtaagattttttaaaatatatgttagtgatacagaagaaggtgctgaagcaaaactgttatggatattatgctgagttccagataaaataaaagagttcagattccagctaaggcttgattttagaacagaatacttcatgactaatggcctttcatttatcaaagaactgggacgttagatgttagcagaacatatagcagaagcttcagataggctacatgattaaaattattctagtgtatccagacacatgattgatgaaaatggatattttaaagaataaaattgtttgtaagtttcatttccttataaatcaactgctattataggacataatgtgtgatcatttagtttacttatgttaataaactctcattttgttatgaatgaacgttaagagtgggagaaactcaaatgtatacatgcttacatgcaattgtttaatctgctgatctgcaatatggaagcaaataatgtgagaaaatgtacagcttctaagatagccaaacagcagtaaaacctatcattcattcgctaatatctacagtgtagaatgggtttcacgcactacatctcacatatttctaataagttggaactcactcatctatttggatctatatgctatgttgtttattttttgttacaaaccaagttgttatgaaatgtttatacctgaacaaaaactccagagtctttgaatattatatctaagcaattgaaatgatttatggaaagactcaaactgcaaaatgaacacatcaacataagtacttacgtacatatcaatatgtacttataacattccatcatagtcacagaaaagctagtttctgtatacagttgtctcttggtatctgcaggggattggttccaggacccctgtgggtgcaaaagtctgtgatgttcaagtcctttacacaaaatgaaatagtatttgtatataatctattcacatctttctgtatatttcaagttatgtctagggtacttctatgtctaatacaagacaatttgagagaacaaaaatcagcacattttcaacttccagatgtaactattttattatatttatatttattctgtgttttaaaaaaacaaaacaaaaagtcatgagaatattataaagtgcatgtcattttacagcctgcttttgcacttaacaaagaattatgagtatgtttcctatatgtatgtgttttctacaatgtgcttcttggtggctgatttccattttgtggagaaactataacatttcacactgcaggatatttacagagttgccaagttaatgaaatcagctaattagctaaagatattcttgtaaagaaacccttttgggtgcatacttataaggaccaaaacaaagaaattcaatagctttatctatgggcacgcatagtttaaggttttgattcatattccatattaacttctaagaggtttttacctaatttaaaatgagggtatccatttatccccagtgcctgcaaaaccggttttttaactttccatttcatctttgttgataggttatggtaaaatttattcaatgtaatttcaaatgtttgatcatttgtgaggatgaaaaattttatgtttatgtgcaacttgtatttgttttcagaattacctaagtatccctttgctattttccttattggttggtaagaattttttttcgtatgttgagaatattaatacttttttctcatatgctatacattattttcaatttattacttacacattatttctatttatggtgtttttatttacactattttaatatacataattcatcaaagtggtaacaagtcaagtaattggataaaatctaatgattaaacaagattttgattctgatttttaccaccctagcactacataaacttaatttatttatcaggtttagatgataactaatgttgtcccactatgctttgtggcagtttagatcatatattttctcttttcttctgcccttctcttcttaatgattattatattactatttttgtttcctccattgttgacctttgttccttcaaataatcacctttctacttctgtttatgtttccgtccacttttattcactatctaaactcccctccaggtcaaatgagaatattaggaatcttatgctttattccatttattactgcccttttatctcctaccttctgacaactacattcttactttcacaaatttatcaagaacgttggcctacacatgtgttgtttaatcttgtattttacaatcacaattgtgtcttccatgcttccatggaaaccaataagcagcatctgtattattttacctatggataggcataattgaaaacctacaatgcccagccaaacattgtgctaagaacatttccatcatcctggatacttctgggtatagaaggtttgcagtatcaaggtcatgattttactggctgaaaactatgctacttaaaaaaaaaattgtttgtttaaatttgtattgtaactttttatatagactttgtgtttcctggcatttctattgtttttcaagttaaataaagaattagatgtttttgcaatatctgatgtgttatttctgtcttatcagtcataacatatgctatgttgaataagttcttccttaatgacttctctggaatagctttccattattggctgcaattcaaactaattgttctttagacttaccatagtgctgctgttaggagtattcccttcattgctttttcaaactgtgtcaactttttcctaaatcatgtatctttctcatttaaaaatatatatattaagatatatatatatacatcttattctgtcatttattttaaattgacttccattattgccacattagttgaaaatatatactctgaaagaaggctataccacacttactagctatatgaccatagacaattttctctctcttttttctttttggtatataaaagggggtttctagtttttagcaataccatttcatatggttgtaatgagaattaagtatgctaatacatatacttaaaggaatagatttgtctttaattgttctatatgta

SEQ ID NO: 479184 - DNA, 703 bp, Homo sapiens
tctgagacttgctggcttcaggtaccagcatggccacagtggggtagagcaaaatgcgggcttttgggggaccctcagctgcaggtctgttggattttgctggaggtccactccagatcgtgtttgcctgggtatcagcagcggaggctgcagaacagcgaatattgctgaacagcaaatgttgctgcctgatcgtcatgccaatgcaagaagtggactcccacagccttgggcagctgcacccctgtgactttgcagggtatagccccctcacagctgttttcatgggctggtgtttagtgtttgcagcttttccaggtgcacaatgcaagctatcagtggaccttgaattctgggttctggaggatggtggccttcttctcacagctccactgggcagttccccagtggggactctgtgtgggggctccaaccccacatttcccttccacactgccctagcagaagaagttccaaactttcccacatcttcctgtcttcctcgccctccaagtctctatgggaaactccaaattttctcacattttcctgtcttctgggctctccaaattgttccaacttctgccagtcacccagttccaaagttgcttccacattttcagaattcggctgtgaatccatctggtcctggactctttttggttggttcttgacataaagatataactgtgtctgtgtgtgc

SEQ ID NO: 479185 - DNA, 619 bp, Homo sapiens
tcctgcttttcttcgttctccatgagtctagttgtttccctgatcagtcccaatgccagtacctggatatttcaattgaaggtgctctatggtgggctcccccttgttcgagtttcccagcccctttgtttacctactcaagcctcagtaatggcagttgcccctctcccagccaggctgctgtctcacatatcgatctcagactgctgtgctagcagtgtgcaaggctccatgggcatgggagccactaagccaggcacaggagagaatcaccttgtttactggttcataagaccttgggaaaagcacagtatttgggcagcagtgcccgtttttccaggtagtctgtcactgtttcccttggctaggaaagggaaatccccgaccccttgcacttccaagctacccccgacacccaaacagaaatatgaagtctgtgttttaggagaacacgtacgttatcaaacatgctgaaattttcagtttgatattcagcttagcctgacactgcaaatttagccttgatttcatctcttacattctcaagaagagaccattggaagttcccaaagcaaaatgtataatatgaaaaaaaaaaaaaaaaaaagaaaccaacaaa

SEQ ID NO: 479186 - DNA, 591 bp, Homo sapiens
ctccatataccttcctggagccgtcccagtgatggccttttgttgagtttcctgtgggcagctctcgggtagcttcctgttatggagattattctggattatccagttggaaccaatctaatcctattcatctttaagagtagagagcctttccaggctgtgatcagagaggggaccactgaagaagggtcagggagatggagattgctggctttaaagacaaaggaaagggaggtgaacaatagggccaaagattatacagatcctctagaagtagaaaaaggaggaaatgaatttacttttagagcctacagaaaggaatgcagatctgctgacatcttgattttagctcaacataatataaaggtgaaagataataggaacaatgaagtagaaatttcaatgaagtcacagtttaagagtgaaagtgacaggatggacaaagcaccaaaagattcaaagaaattcaaataattattaaagccttttcttcagtcagcatttccattttattttgccataaatcgtagtactgaaaaatcagatgataatgaccaattgaaaagcctgaaacatattaatcttctgcta

SEQ ID NO: 479187 - DNA, 778 bp, Homo sapiens
aagaaagtctgcagagtacttaacaagaaagacttgtgagggggtgactcacttactcagcccacagctctcaaaccccttgagggggaggaagcatgtaggcgagcaggtgcaggagggggacgaaatgaatcctatattggcaccccagcagcagcttctaggtgttgccattgacccctagagccccagagggcgatgggggttgtgatgtaccagggtggttttggaaaaggtaatatttgtgcaggaaaacaggaatgcatgttctcccttagggccatgggtccaggaataaataaaatcttaaaggataaagatattggtctggagcttgtccagcaacatgatgaaagtatggattcgtcagtggataaggtaggtgtgattatgccctccttagtgacccagggtctaggcctgattcagcagacccagaggccagccccaccccagtccattacagtggatccaagcactaggcccatcttagtacctgtccagtcccagaagactcatgctcaaggctcaccccagagccaggccagcctctgtgaaccaggttccaagccagccaccagagatacaggctctgggtctgttcacctgctgacccagggcctactcaaagatattagcagtaagcattcccttggatggtgccagatggcctgctgaacatctctggacagcctgattggtgaagggtgttccagaaaaagccagtttgtgaagactggaataagtctctacttctttcaaaggcacagacataagc

SEQ ID NO: 479188 - DNA, 568 bp, Homo sapiens
cggccagagtgggcaccgaggccgagagggcgccaagagcaagcgagggctgccagcatgctaaatgtatgttattctatgtttgttccaccattgtattttctgagcaggtgagttgtttcatttcacaagtccccaaagcctcactcacacctaacttagacgatatagataatgagttttggaactgttgtcttgatgaccttgttttacaccaagttgatgcagtaataggtggagaatttcaggaaccacgggttgagattgactgcaagaacaaactaccaattctgagaggacccacaggccctctgaaggaagcggactgctcctgcaggacccaggagacacctcaaatacctggagaagctgaaagtgtccgtttgcaggagacgttcccgactttacctggagctgagtcaagatggagagccgagctgagcaaaatacaaggggtggaggaggcagcaggcaggccctggaagctcgctgaatccccaggcagcccattcctgcctggaaccacaggaatccatcaggagggaggccagaggagcataaggtaaaa

SEQ ID NO: 479189 - DNA, 763 bp, Homo sapiens
ccgctcccgtcggtgttgagcacggagagcagtctcaggcctttagtgatgatgattaaaggtgttggctgtggccttgaaaacagtcatgtgaaaactcatcaccttaaggtgttaagtgcccagtcccaaggctcaaggccatttgcatcagcagcaaaagccagcaagatagcagaagcaggaagagagccagcaggaaaacacataccctggcttgaagacatacccctgaagttcgagaaagaggcagtccgggtacgacatagtagtcacgtcagactgcaacacttcctgtttacagaggactataaaacccctgtcccatcctcagttggggctgatgccattttaggcttcagccggcctgcacccaggcgctcattaaaacggcatgttgctccacactgccttgtgttgtctcttggcgtgctcccagggttcaaactcataaaagaacctttcacttcttacatgtattgctttatgtatcagcgtgtaacttctttctctctaaaatgtataaaatcaagctgtaacccaaccacctcaggcacatgttctcaaagcctctggagattgtgtttctggccttggtaactcatatttggctcagaataaattgttcaaatactttaccgtttgactcttttgttgactattttttctgcttgtaatttgttaaggagtttcaatctgttatcaattctggaaaatgtttaccagttaccacattaaaaaaaatgcttcttcactgtttttt

SEQ ID NO: 479190 - DNA, 569 bp, Homo sapiens
atcatcctttcttttgtggctgtaatgattcctatctcttttttatatacactgttaaggttccaggaccaacttaatcacacttccatctcagatccaattcacatctctcccttcccccctcccccagagcaggcctggtgtgagataggtaggcagggatgggaagggaggctgggtctgattttgttgttgatgttatctctgcgttcttcctcatctaccattctttggtgggttctagcctatcaagcatcatcctatgttggaaaaccagaaggaggatctgataatgcaatttctatgagcctggctattgctcaggccaagcaggtggtccaacagataggccacaacgtgggggtaaggaaagatagtgccaaaaccaaaaccaaaaccaaaaccacccaaccccctgaaaacatagtttataaggcaatatatagacaatcgacaataaatagacaaatagataatagatagacaaatagacaatagatagacaaaaactaatttaggagcatcaagacagcctcttcatcatttttattgacttctaggtgatgtct

SEQ ID NO: 479191 - DNA, 781 bp, Homo sapiens
aagcattgtgaagcagagtttgacactgtatctgagatgcagagcaagtatgatgaaagcttttaaaaaaaaatccaaccagacagatcagattgacagcagagagaacattgctttcagtgatacagaagaatttaagaaattcaactgccaagtgattggtgcttctgtggattctcacttctgtcagctggcatggatccacacccctaagaaacaaggaggactgggacccaggaacattcctttggcctcagacccgaagtgcaccattgctcaggattatgggatcttaaaggctgaagaaggcatctcattcaggggcctctttatcgttgatgatatgggtattcttcggcagatcactgtaaatgacctccctgttgactgctctgtggatgagactttgagactagttcaggccttccagttcactgacaaacatagggaagtgtgcccagctggctggaaacctggcagtgatactatcaagactgatgtccaaaagagcaaagaatatttatccaagcaggaccaaaatagctgcttggggcatgtggtaacatcccaagtctacatcaattcctaccagatgtaaaatggagaatcaaattcaataaatcacttcacattttgttgtaatttcttctatgtaaatacttttaaatttggggaaatatctaggtcattttatattggcttatgacaaagatctgaaaacaaaccaagtactaacaaatctaaaggagaaatcttgaagtacatgtgcacagtatacatt

SEQ ID NO: 479192 - DNA, 716 bp, Homo sapiens
tttgtttgagttcattctcagagtagtttgatcgtctgaagccttcttctctcaactgtcaaagtcattctctgtccaactttgttccatcgctggtgaggagctgcgttcctcagttggaaatgcagaaatcagccgtcctctgcgtcactcacgctgggagctctagactggagctgttcctattcggccatcttggctccacccccatccgtattgctccaattataaccacaaaaattatttatggaagaatccagtcaatccaaggtaaaattcctaaagagattgctattagatgttcccccaaaccaaaaccaaaaccaacaaaaaaagaagaaaaagtgattgcagaagctggtgaaataagttcttcagttctgaagggggagctggatagcacctgccagatcaccccacatgtgaatcccacacttgtccatgtgcataagtttcctattggctatttagtgtctgtatcaggcaggaaaggttatgctgctgtgaaaaatgcaatgttctggctcagtcagtttcagtttgagactaaggcttcttggcaatagcctctatatggaacgttgctggctttttgcatgtaggaagagcacatgttataccatgtactgattcttaaagcgtttgctcaaacgtgacaggtatcacttctgttaacatttcattggttaaagcatgtcacatggctaagcctaagg

SEQ ID NO: 479193 - DNA, 1077 bp, Homo sapiens
cactcagagggagtctgatcctgcgctgtctgagataagccttcttgaaaaaatgagatgttatcaaaagattgaagaaagtggaagaattagccatactagggaaagaacattccagaagtggaagaaggaacagtttgagcaaaggctcgaagacagaatagtgccaaaggttcctcctgttaggctctgtccacaggagacagtagagggggacagcaagaatgaaggcgagagaagggacttgttccttcctgtttgcttcttgtgggcttcagctgccatcaagctgcattctctgcctctccctgctgcagtctgtatccaggactggcttgctgacctgtacctcagagaaaggaaggaaagagaagggaaaatagaaacagaaggctaccaagggcaggaattttacacaggtctgaataattggccccctcatggatttcatctagcaaacacttgtagtgtggctttgatgccaactactgggccatatggttcaatccagtggcccaagaagtctctgtacagatcagcaacagaagatggaggctttgagatggcttcagagtggctgagtgataacttttccagcactgatcagtgagggagagtggaaagtgtcagctccctaaatcatcatctatgtgttgtttgaagaattccggaaatacctggcagaggagcaggcttaagcactaaagttcctgaaactgggacttaagagtcctgtgaatattatttgttgctgtattgtggcattatttttatatcaatgcagagtgtgtgttgggcagtgtgggaacctacaatgtaaagcataggtctagaccgttgttaatttaggaatagacaagtcagatttagaaggactggtttaagagcatgggctttggaggatgtcagataagggtcacaaatccatgcttactaaatatgtgatcttaaggaatttgtttaatatctctgttactcagagtcctcatctataaaatgggaatcaaaataccgacttccagaaatgttataagaaataaataaaatatgaatgccaagcacttaaatttagagacc

SEQ ID NO: 479194 - DNA, 921 bp, Homo sapiens
gggcacagcagaaaataagattaaaacaggaagaaccttctaatctagtgaggatcaactatggacaatgaggaaattgggcaccatggaggaccatttgatgccttgtccaaggacctgggtgcagaagcagatgctcctggcttcggaaggaaagctgctctaatcggagttcagccgtctagcagacaatccacagctttggagagagacaaacaaaaaagagtctcttattcctctgcccctgcacctgctttcatttttggcttcttggcactgatgttcacagagacatcagctggcagtggcaaaccgctaaaagctcccctgcaatgcagctctgcaaatgccagccatttatccactggtgcatgccagcttaacccatgttacattgaagaaacccaggaagctagagctggagctagagctgggggtaactgttacaagcatttcacaagtaatgcgaagtcttccaagtaatgtggaagacttttggtaatactgctgactttcacagttgtttgcttatttcacaaagccaaagagctatattaccctgtattcctcactgtagctctgatgtgtttccaatactagaagaaggagtataataggcgatgggccatagcatagcatatcagaacttccacacctaaaatgtccttcaaatgatttttcaaagtcctttagcctctctgaaacttgggtttctcatctgcaaaatgggaatgaaattatattgactcttgccaattcacaggcttgttgtaaggaacaaattaatctttattaactttagatcactatacaaatgttcattattataactattatttgtgttactgctttgtaaaccacacaaggctatatgattgccagttataataattattatttacattagaattgtgttggcaa

SEQ ID NO: 479195 - DNA, 601 bp, Homo sapiens
gaaggcacactcagaaactttgaatgatatcatgtgctttcttgactgactcggcagagctgtctgcagggagtgagtcgctgagctattattactccaatgggtttcagctccggggatgacagagactggtttgcgacctgtgttcacagtttccttcaaggcatcctgatgaggaaggtgaaagcgtcctgtttggaagctgcaaatttccaaaggagtctgagaagtcttgagtctgagaagtcatctctgaccattcccttcaaattcttcattacgttcacagccatgataccggtccttattgcagggcctaaatacctgctgctagttagtgggatgcacatttggcgacagatctcctctcagatagttttcattaaactttacggcaagaaccctggaatggagatttcagactgtgtacctttaactcaaaatgggactaaatttaatattggattaacaggtcatttgttgtttaacgatgtaaaagttccagtaaaaataatggctcatgaaaccttaaaatatacttaatacaacattttgaaaggtagaaatcttattttccttcatgggcacttagaattatagt

SEQ ID NO: 479196 - DNA, 723 bp, Homo sapiens
agaaagttgctgttcaatagattttcaaggattattgacgcagttgatgatattttcctacaacctacgttaacagcacccattgttcagaatatagactctcacaggattgaggtgcccttccacgtggaagggcatttcactcaaagcatgactggcagctcaagtagagcaacaagatgagtgtgggcagccctgtgtcttgccaggtcagtgctggcggctgtgagagaggcgatgacccatgcaggcgctgcagcagcaatacagaggctatgcaggaaatggggagtgggagaattgctgcagcagcagaactgccacccactgggaagatatcaactacccagggctcgacctggcaaagggaacattcctgtgattctgcgggctatggaagtcctagatggcattttcttccaatagaaggctgtttcatctacattaaaaacctgcttagtgtaacctccttcatcaataatgttagcaagatcttctggataacttgctgtagcttctacaccagcacttgctgcttcaccttgtacttttatgttatgaaaatagcttctttccttaaaccagcttctttcgttaaacctcatgaaccaatctgctagcttccaacttttcttctgcagcttccttacctctcttagccttcatagaattgaagaaagttagggtcttgctctcgattggtttgtcttaagagaatgttac

SEQ ID NO: 479197 - DNA, 810 bp, Homo sapiens
taagatcatgtgaggacagctgtgtgcgtatccaatgggtgtggggatggccaaagattccatgtccccacttgttgattgtgttttagatccagagcacatggttttcatttgtcctctagatactaacaagcatagagcaccctatcaggaagacaggcacaattcaagaatcagtagagcagcccccctgaaggaaacagagaggggaagaggagtcatcttttgggaagagaaaattgttaagtgttgtgaccaaaacactgatagaaatgcggacagtgaagtccaggccaatgagatctcggatggaattgaggaagttattgggagctggagcaaaggtcacccgtgttatgccctagcaaagaacttggctacattttgtccacaccctacaactttgtggaaggctgaacttaagaatgatgatctagggtatctggtaggagaaatttctaagcagtaaaacattcaagaggcaaatgctgtgtttcaacttgtttgtcagtaatagttatgctggaattaaattttccttgatggatctttgaaaatactattatactgttttctggtttctattgttgctactcaaaagtctgttttcagtcagttattcctttgtagggtccacttctctacactctgacctaaaacatttctttactgagacaacaagtcttgatgatagtacagctccaactcatctgcatttcatttatttcccaagattcttgtcagcctgcggatgttctcaaattcacagacgaatgtggggaaaagggggaggagggcagcagtgttgac

SEQ ID NO: 479198 - DNA, 723 bp, Homo sapiens
cagcatggctaacaatgtgaaatgaccaagttgcctagagtgatgttaaagtcagaagggccagagaaggtggaaggcaggaaaatgttgccgagagcaagaagcataaagcaatgggaaaatgtatttgcattttattcaatggagacagagaatttggtcactcagcggaaagaaatggtgcgcacaaaggccgaggaattgaaaactgtgagggcaacaggtcctcctctgcctggaaggtttgcttgtcagcctcctgatgtcacctctcttggctatattctccataccatcacccagggtataggagagaaggtgttcttgccaagaccacatgattggcattctctgccttggcccttttatctttccccagtgctggccctccctcaccctgcccttgcactcagcagagcagaagtctgcttgagagccttgctatttttacttctctgtgaggggatctcaggttacaaattatataccgatgaggtcaatatcgtactgcttttataagtgtagctttaaagtaagtcctaaaatcagacaaggcttttttttgttggggtggctccaaacttcagatagaaaccaggttttctccatgtatttcctatctttcttggaccagtggttatattggaggcatgtgcctctcatgtaaaagcaggaacatgtacaggtaagcccagtcatataagcacttttcaagttttgctc

SEQ ID NO: 479199 - DNA, 625 bp, Homo sapiens
aactcaggaatagaaaaccacttataagtgggagctaagctatgagtatgcaaaggcataagaatgatataatggactttggggactctgtggaaaggacgggatggggtcaaaaggcttataaactggaagcaccagataccattggaattatgtatgggagtagcagtaaatttaaaaatatggaagcagtgggaagaagaggcaagaaggacccccggactgaccaaagcccacacgccattgcatccctgcatctggtgctacgtcttagcagcattaccaccatgcccaagagaaagcctgaaggggatgctacaggagataaagccaagctacagagaagatctgcaaggttgtctgctaaacctgctccttcaaagccagagcgcaagcccaaaaagccttctttgcccctgcaaagaagggagaaaaggtgctgaaacagagcagcagtgttagtgtgttgataggtgttggttattgttgaggggcatatttgctggtctcttttggagtatattaataggtatactttttggggtgaaaaacggtttgcggtcgctaatcaaaatgttaaaagccaacaaagcacttatatgggcatattgtaagaagctaagaa

SEQ ID NO: 479200 - DNA, 686 bp, Homo sapiens
tgtgttcttgttgctcagctcccacttatgaagtcgttggggtttcctgcttcaacagtgcttggatggaacccagccctcgtcccctaccccggccagccgcccatagccagccctccgtcacctcttcaccgcgccctgggactgccccaaggcccccgccgcagctccagcgccgcgcagcagccgccgccgccgcctctccttagtcactgccatgacgaccgcgtccacctcgcaggtgcgccagaactaccaccaggactcagaggccgccatcaaccgccagatcaacctggagctctacacctcctacctttacctgtccacgtcttactactttgacctcgatgatgtggctttgaagaactttgccaaatactttcttcaccaatctcatgaggagagggaacatgctgagaaactgttgaagctgcagaaccaacgaggtggccgaatccttcttcaggatatcaagaaaccagactgtgatgactgggagagtgggctgaatgcgatggagtgtgcactacatttggaaaaaaatgtgtatcagtcaccactggaactgcacaaaccggccactgacaaaaatgacccccattggtgtgacttcattgagacacattgcctgaatgagcaggtgaagccatcaaagaatggggtgaccacgtgaccaacttgtg

SEQ ID NO: 479201 - DNA, 784 bp, Homo sapiens
ttaggatgaaaatacagcagtttctacattcgtggattcgaccaatcccaaccctgatggagaaaacagtacctgcattctgcattggtagaatccgcggatgcagaatctggcacctcctcaccgcaccccctccatcccacctccccctgccacaagtgttgctaaagaatgcagcaaaatcatagaatttggcagtcccattgcgggtcccctcggagactcacaggtcggtggcatggttcggagagcccaggttcacagcgcagcttgtggggcatgtccaccttgcaggtggctgttcctccacatctcaagtcggggctcacagatgacagtcatagagaatcctcgaggctctcaggaaatttcactccacttctcctgctctgtggtctctttggtcatcagagtgttcttctgcatctctgtggccttcagcttggccttatccaagctggcaatttcttccaggtctagtttgtgtgccattttcttacccactttcccatttgccctgagaatactctccagcggggcttgtggctgcagccattcctacatgggatgtgaacatcgttctcaaacagttgttgcccgaagattgatttgacaaatccggtttttccgaaatagatgattctgatgattcagcctatttttatgttagttctgtttagaaataacttcaggaacggtttttatattttattttcacatcaaaagtcagtcagatttgcttcagcctcaaagagcctgtttctgtaaaattaaatgagcactg

SEQ ID NO: 479202 - DNA, 1148 bp, Homo sapiens
tcacacgagatggagcttaatcttgcacaagctagaaccatagagggtgtcgaagagaagcagcagcagcttcccgctgcaaaaaggaagcttatctatgaaaaagtgaagcactatcacaaggaatataggcagatgtacagaactgaaattcgaatggtgaggatggcaagaaaagctggcaacgtctatgtgcctgcagaacccaaattggtgtttgtcatcagattcagaggtatcaaaggtgtgagcacaaaggtccgaaaggtgttgcagcttctttgccttcatcaaatcttcaatggaacctttgtgaagctcaacagggcttcaactaacatgctgtggattgtagagccatacattgcatggaggtacccaaatctgaagtcagtaaatgaactaatctaccagcgtggttatggcaaaatcagtaagaagcaaattgctttgatagaaaacgctttgattgctcaatctcttggtaaatatggcaccatctgcctggaggatctgattcatgagacctatactgttggaaaatgcttcaaagaagcaaatagcttcctgtggcccttcaaattatcttctccaagaagtggaatgaagaaactgaccatctattttgtagaaaatgttcagatgtgtccggagtttcttccttctggtgggttcgtggtctcactgacttcaggagtgaagctgcagacctttgcagtgagtgttacagctcttaaaggcagtgcatctggagttgttttttccttcccatgggttcatggtctcgccagcctcagaagtgaagctgcagaccttcgcgggagttgttggttcctcccgtccggagttgttcgtccctcccagtgggttcgtggtctcgctggcttcaagagcaaagctgcagaccttcaccgtaaagtgttacatctcataaaggcggcgtggacccaaagagttagcagcagcaagatttattgcgaaaggccaaagaacaaaccttccacagcgtgggagaagacctgagagtgttgctgctgctggttagggtggcctgcttttattcccttatttggccccacccacatcctgctgattggtccattttacagagagctgattggtccattttacagagagcttatttgtcc

SEQ ID NO: 479203 - DNA, 486 bp, Homo sapiens
gggaagcggaggttgcaacgagggttccgagctcatgccactgcattccagcctaggcgacagagccttcactgaattgggtgaggcccactcacactggggagatcaatcttctttactcaggttacagattcaattgttgatatttatccggaaacactctcacagacacattcagagaaactatgataaatacttggacctgaccaagctagatggtccaggagcgttttcctgggaaagcaatttgtcagttgaaggagtcatcctgacgaaggagcagggcaggagtgtttgggcatcgcacacacaaaggctccaaggtggatggcaggtgatgctgagggaatcaagaaggtgcacatgcagatgcacagagtggggcttagcaggcttaagaggcggagcggggtcacatcaccctggggcttgtaggccacattaaagttgtctttgatgcatttttagttaatttttatgtatgtc

SEQ ID NO: 479204 - DNA, 635 bp, Homo sapiens
aggtgtataattcgtgcttgaactataaactccatgggggtaggatgctatctgtcctcttcaagactgtatccccaacacccagaacagtgtcttgcacatctttcccagcagagagatttatctggaaacacatttaaaagttggaaagtagacaccaggttgatgggcctcacatgtggcctgagagtctctgatctggctcagcagttactgctgggctcagaagagtgtcacttctgtatggatgatctgttttattattttcttagcacttttacaaccatccttgatacagataataaagtccaagcggaagtggtctcagacggagatgaggaactttttgggaaatggagtaaaggtcactcttgctatgcaaagagactggcagcattttgcccctaccctagagatctgtggaactttgaacttgggagagataatttaggatatctggcagaagaaatgtttaagcagcagactccaacaggaagcagagcataaaaatttgaaaaatttgaagcctgacaaggcagtagaaaagaaaaatccattttctggggagaaattcaatccagctgcagaaatttgcataagcaatgaggagccaaatgctaatcaccaagacaatc

SEQ ID NO: 479205 - DNA, 653 bp, Homo sapiens
agggacctgatcataaaagcactatgagaggggaggggggaaaatgtgaaaaaacagttgatgtgaagaaaagtaaattctgtgaagctgatgtctccagtgaccttcgaaaagaagtagaaaatcattatacgctctctttacctgaagatttctatcacttctggaagttctgtgaagaacttgattctgaaaaaccagctggtaaatggatgccctaccctttgcctctcagcccctgtaatgctaagaaccaggtgctgggatctcagctacagctgctgcagaactatcagatgcctctacagcagtgctcactgatggagatcgtggaagcacagcctccacccggtatctcttctgcctctgagatttcaaactattgcagctgcttggaagaagctagatcccatgtggagcctgggctaaagagtagtatgggaaatgcagcaaactttcatggtgtgaggggagtattttgtaaaggagcaaatacttcttagtgttggattcttttggttttctgctatagatttcagaggcatatattttacggatatagatccccttcagtaacacaaacctttggaattgtacttattgaataaaatgaccctgtcaacatgtttctaagtgccagacagaatcaaacc

SEQ ID NO: 479206 - DNA, 1306 bp, Homo sapiens
cccagcatcccaatttgggaagtgcattgtgtgctgacaatgtgtactccccggtttcatttgggctgtcagtgcatactccctggtttcatttgggctgtcagtgtgtactccctggtttcatttgggctgacaatgtgtactccctggtttcattgggccaagagaaggaccctgcataagaagtccagagacatggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgtacacagtagtgacacccatgctgaaccctttcatctacagcctgaggaacaaagatatgaagaggggtttgaagaaattacaggacagaatttaccggaatggcatcttgaaggatggactgaattttgaaagaggaagtttcaaaagatgaagaaatgggcaaagcatttcaaatagtgaaaaccacccaagcatgtggagacaataagcactgcaatgtgtttgagggacaatgaaaagctgaggcttcatcagtttgagagaaaggagaatac

SEQ ID NO: 479207 - DNA, 2165 bp, Homo sapiens
accgtggggagagggagagggagagggcggctcggaaaagtttgttattaccaatcgtctgaagccttcttctcttaactcatcaaagtcattctccatccagctttgttccgttgctggcgaggagctgcgttcctttggaggagaagaggcgctctgatttttagaattttcagcttttctgctctgctttttccccatctttgtggttttatctacctttgatctttgatgatggcgatgtacagatggggtcttggtcacagaaaaattgatcagaaagtacaaggggttcccatacctcttgctcccacacacgcagtttcccctactatcaatgcccgccatcagagtgacgcatttgttacaattgatgaacttattttaacacatcattatcatcgtagtttacatcaggatttactcttgaacgtgaacaaggtggccacatggagaaggttgcctgataggagctgtggccttcatcagatggatacaggagtgaaatacagcatcctgaaaaatattggtttctaccctacaaggcagttagaaaatgttcacattttaacaaatttgaacaaactacaagaaacttatttatgggatcatcttgctggtaagaactttctagaaatgtagaataaccatgaacaatgtataaatctagtatctatgtgctccacagccctataacccaataactgatttgaagaactcaatatgtccaacatggatcatttttacatgtcttgattgttaatgaatgtctgctaatgatgtatagtcaacttgcaccttctaggggttcatttaattttttagcaaagaagtgacatcatttagcagcaattagagcaccttcaagaagactttaaaaatacaatatccaattagaaaagccacattttaaacatttgtacaagaataagctgctgaaacttagtgattgaaatatgacatctgtacaacactttacaatagagctagaagggaatttatcgttatcctgcatagaaccggtctgcatttggtacatactgtcacctgttttgatgcacaaggcctggtaacaaaagaaaaatacctgttatcaattctaacgtgttgaaaacactggcaatattacaatttagtgaattcaactgatttcaaaacaagcagctcattttgtcaaaagtgtaaagtatttaggaataatagctctccctttaatataacaagtgaaagaaaatggacatgtgatttcaaggtgcaacttggtaaaagccagaatagacaaatgacaaagcctaactttgtccaaagattctaactgtcgcattctattactataaaacccaactgtcactctcattcagttcttactttggcttcagcagattaactgccaaatgctgaagaatgtatccaggcactgtagtttgtgtgttagaaatatgtctcatatttttccatgtgtttttaaatgatgaaaaactacccttcatattagaactctggtaacaaccaaatgtatttaagtattataaatgttattgacagtgttcccccaaataaaagaccaaaaatgtttttcttccatcttaacatggtattcctgtttctttataatgggcagtcacccttcactgctcaaagttgtagtcagaagtgtgcatttattcattgtccatgatccagtctcatacaaatgacactatgaggaacttcagctcacaaacagtttttaaccatgtcctgtgtaaaaaaaagaaaacaaaaaaacactcaaatgctcttaaactcaagtgtgcatctggaagcaattcaaagatatcatgtcaatcttggaggaaagtcggagcctctctcagctctcagttagtccctcactaggcaaggtgtcctgaaccttctctttacttatttttggtgcttcttgtattttctctggtgaatcctagcattctcttctagatggtctgtttgaaatgtacctactttctattctggttcctctccctggaggaggaacatactaccttcatctagtcagccttcttaatccctttcttgtctaaactgttctattttccattaaattcatactctggatgaagcaactttagttcatcttcttaggatgttcaaatcaggtcttccatcttatcacattaggtatt

SEQ ID NO: 479208 - DNA, 1961 bp, Homo sapiens
gcaaaaagttccaacaggggtctgtggacccttgccagctaggatgataggattacttctaggaaggtcaagtttaaatttaaaaggggtacaagtacaaacgggagtcattgattcagattacaatgcggaaattcaaattgttttatctacttctcttccctggaaagcagagccaggagagcatataggacagctcctgattgtgccatatgtggaaatggggaaaagtgaaattaaacaggaggatttggaagcacaaataaagcaaagcagcttattgggtcaccaacatcaaagaccaaaggtagataaaaccacaaagttggggaaaaagcagagcagaaaagctgaaaattccaaaaaccagagcacctcttctcctccaaaggatcacagctcctcgccagcaagagaacaaaactggatggagaatgagtttgacaagttgacagaagtaagcttcagaagacaagcaaatgctgagagattttattaccaccagccctgccttacaagagctcctcaaggaagcactaaacatggaagtagttaccccatttcacctgacttctataaacttatagaaaataaaagcaccaatattgctctcctagttttcctggcagctaggggatgtgttggtgaccaaattcttgaccagtcagatgcaccaccttattttgaatctagacatagtagtgaaaagaataagaaggggacagttctttctggaagtggtaataaccagtttatagacctccaagaactatgcccagtgactactgctggtagtataggaggaggggatccggaggaccaccaggatgatgcaggcataggaggcagtaatgaaggccagagctccactgattacaacagcaccttctgtgtgaatcataagggtgttgagaaattactgaaagcctatacaggaattgtcggaggtgtccagaaacttctgtgctctggtgtgcaggctcctaagagcagatatttacctttcagctgtactggccctggctctcccaatccgcctcaggcagcatctgtcatcatgtcttgttttgacagcagcgtggagctgaccactcagcgaagacagaggaaatttccaagaatagaagaaagaaaagcatcagggaggggctgtaggggtagagccaccagactcctggtggtgcttctgctcttcaggggcaggaggacctgtctagggaaggtgctggcagctgatgatggccaatgcaatgtaaaagtaggacataaggatgcagacaaagggcgcaatcagcagtgttcctgccacaaggatgagcaccagatcattgacacaagtactggagcaggccagcttcaggagtgggaccagatcacagaagaagaaaagcccaaacaaaagagcctgctgctcctggtgttcagagaagcccatgagaagaaattcatagatgcaggtgctccacataggataggtggtcctcacaggtgctcctcacagatgctcctcactcagaggtgctcctcactcacaggtgcttctccagtcagtttggcttctcctggccccttggatttaaaaacctaaactttagatggtctattccagctcctgaacccttccttgccttattatatttatttatgagatttatatattttacatctaaatagaaggtgagcttcaaaactttagctttcatgtttaggttttactttagaaaaaaatgtatttcaattaaccagtgttcaataaatgttgttgaacctaaataacagtgagagagaggctctttaaaatgaatgatatttatttgggaatgggcattgcaatgagaatacatgtgccatagtaaatgatgtgcatattcaggaaggtaaaagtttttaaaggaaagctgagaaaaatgaggattactcgattgtttgagataattatccttggctacaggaatcaataa

SEQ ID NO: 479209 - DNA, 849 bp, Homo sapiens
tgacagcacctggataccttggttgccgttgcagggttcgcatgctgttttggttgttttctgaattcaactttttaaaaatcccacaaataaccaccactgtcatcgcccaatgggctcatgaacaaaatggccatggcggcagggatggaggttatgtatgggttcagcagcatgtactcccactaaccagggctgacctggccactgccacctttgagtgcccagtctgccagcagcagagaccaacgctgagccccccaatggcaccattcccaagggtgattagccaattacttggtggaaatattcatggggaaaggattagattaaagcagtttttggaaaatgagaaagtggaaaaaataaatctttccaagaaagaggagacacagacaggaaacgattgtgatttaagagatacaggccgaattgttgggtcatcatcaatggatgaagttcatcagcatcttggggacaacgcttgttgtaaagcaaatatcagtgagagacagaaaactcaagaagaaatacataggggtctgaagatgggggttgaagcgaatggccaggatgatgagcaggttccctgttatggtgaccagggttttgctgctctcaaagcatgtggtgtagagggcctccagatcaagctcaatgagtctaaatgagtcagatggtggttatgacttcttaattcatgaaatatttgaaactttcagaaaggaaagagaaagtgccaaactgggttggctagtaccaaatatagtgtttgtttggcatagaaattcaatatgtggttaattaattatttatattgtctatgacctagtctttcactttcaggaa

SEQ ID NO: 479210 - DNA, 1196 bp, Homo sapiens
ccagcagctctctgtttctgagtttattggttcaggattcaaaatgaatatcagcgcctccagagcaacagcagtccctcttcggaattttcctgtgtatgtatcttgtcaccttgactgggaacctgctcatcatcctggccattggctctgacctgcacctccacacccccatgtactttttcttggccaacctgtcttttgttgacatgggtttaacgtcctccacagttaccaagatgctggtgaatatacagactcggcatcacaccatctcctatacgggttgcctcacgcaaatgtatttctttctgatgtttggtgatctagacagcttcttcctggctgccatggcgtatgaccgctatgtggccatttgccaccccctctgctactccacagtcatgaggccccaagtctgtgccctaatgcttgcattgtgctgggtcctcaccaatatcgttgccctgactcacacgttcctcatggctcggttgtccttctgtgtgactggggaaattgctcactttttctgtgacatcactcctgtcctgaagctgtcatgttctgacacccacatcaacgagatgatggtttttgtcttgggaggcaccgtactcatcgtcccctttttatgcattgtcacctcctacatccacattgtgccagctatcctgagggtccgaacccgtggtggggtgggcaaggccttttccacctgcagttcccacctctgcgttgtttgtgtgttctatgggaccctcttcagtgcctacctgtgtcctccctccattgcctctgaagagaaggacattgcagcagctgcaatgtacaccatagtgactcccatgttgaacccctttatctatagcctaaggaacaaggacatgaagggggccctaaagaggctcttcagtcacaggagtattgtttcctcttagatgtggtgacagcaacatttaatgaaaagacataggcttggagtcagacaaacgggcttcattttggggtctaccacacactagccataagattgtagtctggttacttagcctctctgagccttggttttctcatttataaaatggagataacagtttctatctaataatgtaacttggaggattaactgaaataaactatgaaatgcattcagtatagtagtgaataacagtaggtgttcaataagggatagc

SEQ ID NO: 479211 - DNA, 2380 bp, Homo sapiens
gctgactctcttttcggactcagcccgcctgcacccagctccagatgctgcagagtcatggaaaaccaatccagcatttctgaatttttcctccgaggaatatcagcgcctccagagcaacagcagtccctcttcggaattttcctgtgtatgtatcttgtcaccttgactgggaacctgctcatcatcctggccattggctctgacctgcacctccacacccccatgtactttttcttggccaacctgtcttttgttgacatgggtttaacgtcctccacagttaccaagatgctggtgaatatacagactcggcatcacaccatctcctatacgggttgcctcacgcaaatgtatttctttctgatgtttggtgatctagacagcttcttcctggctgccatggcgtatgaccgctatgtggccatttgccaccccctctgctactccacagtcatgaggccccaagtctgtgccctaatgcttgcattgtgctgggtcctcaccaatatcgttgccctgactcacacgttcctcatggctcggttgtccttctgtgtgactggggaaattgctcactttttctgtgacatcactcctgtcctgaagctgtcatgttctgacacccacatcaacgagatgatggtttttgtcttgggaggcaccgtactcatcgtcccctttttatgcattgtcacctcctacatccacattgtgccagctatcctgagggtccgaacccgtggtggggtgggcaaggccttttccacctgcagttcccacctctgcgttgtttgtgtgttctatgggaccctcttcagtgcctacctgtgtcctccctccattgcctctgaagagaaggacattgcagcagctgcaatgtacaccatagtgactcccatgttgaacccctttatctatagcctaaggaacaaggacatgaagggggccctaaagaggctcttcagtcacaggagtattgtttcctcttagatgtggtgacagcaacatttaatgaaaagacataggcttggagtcagacaaacgggcttcattttggggtctaccacacactagccataagattgtagtctggttacttagcctctctgagccttggttttctcatttataaaatggagataacagtttctatctaataatgtaacttggaggattaactgaaataaactatgaaatgcattcagtatagtagtgaataacagtaggtgttcaataagggatagctattattattactattagtattcttcattcctcccccaactcagaagtcaaaaaatcttttctctgagatatatttgttcaataaatatttactatctatggtgtgttggaagttattgtaagtgctagggttatgacactgagcaagacaaagtccctgctttcatgacactttcattctaggttattaatttgtcgatcattaaaattttgggggcacttgttttgtttgtggcattaagtggggagtaagacaaaagaaataaagatggaggctgcattccatgtgctgcagaatagctaaagagatccccatcaaaaggttcaaattcaatgtttaggtttccatgcgggttgcccaccccacggttggctaatgtttcactaggaagggggttaaagctccttgtgctacctctgccccatgctggtcagaaacgtgcaatgccaccatccttttagtgactattagatgagaggaacgtggaaatcctctctccttatttgactgcaggtttgcgtccacatctaaaaggggcaccagcagcttaaattagttgcagagatggaaaaaatgatgtttgaaggtaaatggcattctatctgtctccaagaatcttagaaatattaaaaatattattttaaatataagggctatatagttttgatttcttacatctggtatcaccaggtgtccactggctacctaaactccttcctcatttaagtttgtttctcagacctaacctattctaaaatgttttatgattgctgcactttttcaatgaatacttatggagcatctttcatggaatcaaactgttccaggcttcagctattagtaagtacaaatgtgaatcatttagatgccacatcttagtacgcgaggattccatttatttcatgacctggaactggaagtctgttcttctctctagaactcctttccagatgttccctcagagagtccttgaatgggatgagcagggcatcgtcatgtaaccagagctggagatggttgcaaacttggagttctcctgccctcatctccttagtctacaactctccttccattctgttgacatctatcgctccactgaccaaagaccactgacagtctcctccaagccat

SEQ ID NO: 479212 - DNA, 1570 bp, Homo sapiens
ctgtcttcagaaagttcattcaaacatgatgcgacaagtagacataacagataactgcgattcagtgtggatggagggcaaagccaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcaggtaggtttcttccgacactgcagcacgttttctcttcacccacatatgagtatgtgcatctgtatgtacaaatgtatgcacacacttgatgagaaagaagcttttgctgatagaagatgaaagttgattacctggatgttttattttttggacttctcgtggctggcaaatctgtacatagtcctagagtgaggtaaaagcacattcgtggtctagcagtgacggcacataaatgtcgcactgaaaggattaaggtacttatttttgtatgcattccttcgattttaatgggcacctactatatgctagacactgtgcttggtgttgggggaaaagcagagcaaagctggacacagccccccttccttgtggagcttgcattctaaaagtggcagagaagtactataaacagttaattgtatcatggaacaaacacaatgaagggaaaaacatggtcctgtgggaagggaaagtaggggccccagagaggtgggacggatgctgtgggagcacaaataaggggtatcaaatcccgaagcggttagtcagagaaggtttcaaggaggaaatgacttctaagctgagacctgaagaataactgggagttgaccacaaggcctggggagagggtttcccagcgagaggaaatggcacaggcaacggcctagaggggagtgatcccttgaggtgcaagaaggttggttcatcctttagccaggggagtaggtaccttggaggatccagaacctcagtttggtgagtcaacacaaggctgatcagactgagaagaacccatttacagtgaccaaactcacaggagatcaatacacaaataatagaacattttcctttaatgcagtgattcctaaacttatccttttctgaagtcacactcccactaggaatatcaaaagatacggaccctcttgccagaaaaatgtccaatgcatgcacacacacacacacgtgcacccacacgcgcacatgcatacacacacacattttgcagatagtcttaaggggtgaatggtccctctaaagacctaggtcaagaaaccttgctctataatgagaaagaaactgccaggtagaccagaacatctgtgctg

SEQ ID NO: 479213 - DNA, 1047 bp, Homo sapiens
aggtgtgtgggctttattctgggggacagggatctggagacaggcccagacagggaagcgacttggtcagatgggcatgtgagcaccagctaaggagaagcttaaggagcaccagctaagaagcgacttggtcagatgggcatgtgagcaccagctaaggaggcaggagggccagacgggagggatgtggtggcctggaccaggacaggggcaggagtgaggtggcaagaacgacgcagatcccagagctattaaggagatggactcgccaggctttggtgaggaattggccatggtgggcatggagccggaagatgaagttaccttggggcatatcagtgctgacaaaggggcctgggggagagatgatgagtctgatgtggctctgagagcctgagagcctgagagccaaggggatgtctggagaggatgtctggagaggtatcagcctagagcctgagagccaaggggatgtctggagaggtatccaggaggcagttgaaatcaggcctggagatattcacttgggagttggaaggctccggcttgtgctgtcccttcccgctgtctggattttggcctgtctgtgggaccttgaggagcctggagcctggagctgccagctcgtctgggccctccaggctccaggatctctggaggccatgggtggggctggtgctggccttgttggtgttgctcctgctggagtagtggtgccctctggcatctgtgccttccacggcaggggtgctgcagggatgctgctgaataccctcccgtgcacgggacacccctgcagcacagatgtttctaacccagaatgtcctggtgttgacgttgagaagccctgatctaaggtaacgcaaccaaaaagtgacataatcagggtttgaacccaagctaggggctccaaccttgcactctaccgcccttgtcatctccctccagggtttagttggaaagggggggaacatggaggggttaggagtaggtgtctgaggtcgaggggcctcctgtgccttccaaattgtgcctggatccttccac

SEQ ID NO: 479214 - DNA, 2666 bp, Homo sapiens
tgggtgagacggttgtctgtgaagcttccagacccttctccctgccctccctgccaaacagccatgctctctccttgctctgttgattccaggcacacctccccagccgtcatagctcgctggatcagaagtatttgtaggtgtcttatcccctttccacctgctcccagtggaggccaagtgcctcgtgccagtgcctgattcatgtttggggcccagggcctagcacagggaaagcttattgaataatcaagcaagtgggactcagggtgttctgagcagaggccagggaccggccccaaggtgggaatgcggggagcaggttctgcgaaatgaaggcccgcagggtgacgggagcaggggcgtgggttacagcggcagctggagaggcggggctcgatccctcagagcagggcaagaaagatggtgactcaggaacttgtgttcgtgtcatgatggaatcaggggtgacgttggatgggactggactgagacctctgggccactctgctgtggccagcaggggaaccccagcagccctgctcctgcagcgtaacttgaatcatctgagtgcgctgactcctcctccccgcccaatccccacccccttgaaaccttcaaaagtagagatgaggtttctccatgttggccaggctggtctcgaactactgacctcaagtgatccacgcacctcggcctcccaaagtgctgggattataggcatgagccactgcgcccagccaggagctgggttttaatgggggcatttcattgtggacattttacaaggctttgagctaggtttaaatcttatataactttccccagctctctccgtgtctctgagactcaacttcctcatctgcaaaatagggttaaccgaacttccttcataggtctgtgtgagagatttggtctgcacatggccataaaatgcccagctagtgcctggtgggcacagtgggcactctgtgagtgagttagccctgttaggagtttctggaatggagacggtggtggggagcggggctagctcttgctgacatccttgtggctggaggtgggccttcccagggcagcgtagggcagctgtgtgcaccccctcatccagtctctttgttcacagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaagtaactaagactcctggagcctcagagctggcaggagcctcagagatcattttgtttgattttgtttgactgtgaccccaaagcaggaatcccatctttagcctccctgaccagatggtctgagtggacccctgcataggtggggtgctggtcatgtggccagcgtgtccacaacaagcactgccaggggtccctgcatgcccagcactgtgctgggagccctgggtgagggaaggaaatcagacatggataagaaccagagcaagaggagtagtgtatgtcagacctggtgccagggtcaggggagctcacactgtcttccatgagaccctttccttgtctccatctgtatccccaggtagcccccctctcggaggaaacgcctcacaggcagcagaaggtggcattttggaaacagccttgggcatgccaaggtccagggcctattgaagacaggcaggcaggacctggcaaagccaagctctccagagtgtggttggatttggggttaatgtggccctttcctggaggatccctttaaaggatgctgaggaacctgggaagagtcagtcatcgtgctccaagcgaggtgcaggaaagtatttgaggcgctagtactgtgcctggtgtggtgcactgtaggactcagaaaatgctcgtagtgcgtggcaagggagggttctgggaggcagaggtgcatcccaaataagctcctgcagctttctcctccttccttccaacatcctgtccctgactcctgacccaaactgataagagcagttgacctggttcataacaggtactcaaaagcatctgtggaaacaagttacttgaatccgccctccccagatatttttaaacccaaaggcaagattgttaatccaagatgtctccaatttggagcgcaatgttcaggtctaaaaccaaccaagcacattgaatattttgaaaaataaaatcaagaggtggaattcgcagccaccttgttgggggtgatatgaaaacacaagctctcatgtctgctggctgagttcctggagagctgggcactccgggggcttggaatgaacgg

SEQ ID NO: 479215 - DNA, 709 bp, Homo sapiens
gtgtcctatttctcctggactgtggttattgtgctgtctacctgcagcgtgagggtttccccatcaggttacttaagattgtacgtccaatgcctgaaccctgaaggctggtaggtgagccgaggccatggtgcccagcggaggagcaggtggccctgagaacccaaacatcctggagaaacttagagatgagggaggtggccactgggtgcggggatcgtggattggtcccttcagatccgccccggtgtccagaggagccctagagaatgccttggccggctcgcagggcctctccaacgccctgctctggctcgtctcacctgcaggagagaggtaccctgcgagtgggcagatacctggcgcccccggtggccgtttgcgcgcatctcaggctctgccagccgctgccgcccgggcgcagttcagaaagagccaggtgtcctccggagcccaggccgaggcctcttccaaaaggtctggggatcacgctggcttcctcccattctctgcagatctgagaagccaggtcgccgaggagcatggggggggaaggcagctcaaaagggctgtagggagattggggaaggtttaatctgtgaaagaaatcttcgtggtgtcaagccgctgaaatttcaaggttgttacaatataacacagcctgtcctgccaagtacatgaagtcaatcttggacactcatgttttgct

SEQ ID NO: 479216 - DNA, 845 bp, Homo sapiens
taagattcttaacccatttccttatcctgtaagccatgtgctctaggggcagcgtgacatgtggctggctgtgaaagtcaccctggcaaggcacatgtggtatcagaaagaggaaaggagagttgctggaaacaaagagaaactccatggactagagccttcccttagtttatcattttgttcagataaggatgtggacaagaatcagaactggagtcagggaaggaggccaggatgcagagacatggacagaggagtgacgagtgagggagtcgaaggcataaatggagatgcttctgccatggttgccatcatttactctgaggaaaacaggggatatggtgaaactccagacctggtgaccctcggtccagctggagctttgccccaagcagcttcaggggcctgggaaagtttctttacctctctggcctctatttccttatctgtaggaagaaaaagttgggctagatgatttctgaagtcttttccagtttaataaggagtctataacttttgctcagattttaaaggaattagaccaagtattactatttggaggtaattttgggcagtgtttagcattgggcatatgaagtaacttttttattccagtttctgtgcctgagtggatggatcctcttatttatctgaaagaaggcaatcaaactcttgagaaaatttttgaagagcagattttatttcccttgctatgacccttaaatactgcacttgttacatctgagtgctaattactagagattaattagtcagcatgaaagtacttctccggcagccccccaattactgaactgtacttgatatgtgctacctgcaggctctcc

SEQ ID NO: 479217 - DNA, 762 bp, Homo sapiens
gaggaggccagaaaccagtggggggttgcacagaagttcagacaaactaagtcttgctctgctgcccaggatggagtacagggcacaatgtcagctcaccacaactcctacgtcccgggttcaattgctgacctagtgaaaccggacattccggaggcagtcgagcatcaagatgtgttgtcaggtctgaatccttctgtgtttttggatggagaatcacaagatgttaagagcataccaggaaaagatgggaagcaacctcaggatggggttgaactaggtcttcaggttcccactgggagtataggcctgaggaaagagggagagaggagaccaaggagaaccacagaggactttgcttgtaaggggtctacagtctctgatatgaaagccttggagtcagatttgtttcaaaacttagtgtttttggatgttataatggtaacacagaaaaacactgatgtatgtattcccttcactttatcatatcaacttgctgaatttcttgaaaagagtgacaataatgacatagttgttttgtatctcactttagagttccacaagcactacattttatcctcacatcagctctgtgaggtctggcttaacagatgatagctggattttcgtatctgcttccactttccatcatctattgttctatgttatttttgttgaagtatatgaagaaaatcaggcctcacacagttatgtagttggaaaagggagaaatattttagcggtattttcatataatttttt

SEQ ID NO: 479218 - DNA, 479 bp, Homo sapiens
acccattaggcttttttttttttttgagacggatgatctggtaggggatgaaaggccctcctctaactcattaccttgataatgttgaaaaagaaaatctgatcaaatgtggccctaggaaaaagttaagtcctggtaagagcagctggttctttgatgtttatcaggagtggactcggagcctagagaagtgtacatgtgctcatcagcaatcagacaggagtttcttatttcttttgggtgctgaaatgcaggatttcttgctgatgataataaatgtggagtgcaccatctcaggcagccagcctctacagcttgcattgctgggctcttcatggtatgatccaaagcttcttgggagaacaggggcctccggccctagtgaagcaacggacttctatgctttaccttggaaaactccttctgtttgtgctgtggtctatagacagtttccagcctattgttggaggtaacatctt

SEQ ID NO: 479219 - DNA, 1399 bp, Homo sapiens
tagctttaggagatatacctaatgctaaatgacgagttaatgggtgcagcacaccagcataacacatccttgcccacacttgctatctttcgtcttatcagtgatagtcattctgacagagagccaaacacgcatggcccaggagtaggagaaattgaagaacaagatcctgcaatagctaacagagcaacatggttagtcagtggcccctgccaacaaagtgaggcagcagatcagcagcagatcagcagcaaattgtgtgagttgcaacagtgcctggtgtaccactctgtgcttctgagcacaagagaatatggctgcctcacttccgctttccaaatttgtaatacaccacaaggaccatttgactgtcccctctggcttctgcatcttgcttccagcatgaacagacagcaggctaccctcacagccaagcaaaaaggtggtttcatggcaatgagtagtttttctggtaccagtgatgcagctgctaagcaagtaggctgtaagggagaggctgctgttggttcccatgctccttccaagcttaggagaatccagagccaagagatggaccagaaagacttgtggtgacaatatttaagcatctgcatccaaaaatacatacagaatcatatctattctgagaaacaataaaatgctccccctaactacaagtcattttgcaatgtggcctctgtcacttacagcagataaagaactgactgatagatccttacactatttgttaaattgctttcattagagatttaaataaaattatttcccatctccattttttaattagggaaagtttcaaacatacagaaaagaggaagaatagcaaaatggattcccatatattctccactcagatttcaactctttctctttcatctttgctgcaccacttgaaagtacggtttagatagtgtgacacgttacttaatatgtacaatatgtataatatgtatatatgcatgtgtatattaatatgtatataatatgtatatatgcatgtgcacattacttaatatgtatataattgacacattacttaatatgtataatatgtatatacgcatatatatatcataaaaatagttgtgcataaacacaatgttatcatacttaagaaaattaacaataatacatttcgaatattcagtccatatttaaagttctccaatttcccaagtgtgccctttatggatttttttttttttttaccagaataaagatcctattaaggtttacccattgactttgattattatatctctttagtctagaactctttcccatcttttttaataaaatgacattgacctttacatttttaaaaaaactattttaaaattcatatttttaattgtcatttaataattgtacatattta

SEQ ID NO: 479220 - DNA, 1234 bp, Homo sapiens
ctctctccttctcccactgtagagctataagcaagacactgtcttctgcaaggtgcgtgggggtgtggccatgcacaagccagcaggggacagccctgcgaccccagcgccgtgctctgaaaatttgcagcgtaatgatgcagtagaaaagaaaaacccattttttgaggagaaattcaagccagctgcagaaatttgtataagtaacaggagccccatgttaatccccaagacaatggggaaaatgtctccagggcatgtcagaggtcttcatggcagcccttcccatcacagacccaaaaacctaggaggagaaaatggttttgcaggcaaggcccaaggtccccatgctgtggtagtacggaagggaaatgtgggattggagccaccacacagagtccctgctagggcaccacctagtggagctgtgagaagagggccaccatcctccagaacccagaatggtagatctgccgacaagcttgcaccgtgtgcctggaaaagccatggacactcaacgccagcctgtgaaagcagttgggaggggggctgtaccctgcaaaaccacagggtggagctgcccaagactatgggaacccacctcttgcatcagtgtgacttggatgtctagcaccaattctttccatattttaacttatatcataacagagattcagcattcaaagtgtttgagtccttactatttgacagggacttcatttttaagtggctaattgggaattcttggagggtcagaatagaacataaggcttgctgtgtgctaaagtcaagttgacagagggggctcttgggaacacaattcgagttggcaaaagactaaacgtttttaacataataactgctgaagatagggagaaagagggatgagggagacttccaataataccatttcctttcattagtactttaatactattgttcatgtgaacaaagtttcggttattggttctagttattggtagggtttaatatttgacaaatagagggatgctgttaaaaatacaggtctcattttattgaaaaatgccaatatttctaactaaatcattctgagtcttaagaaggcactctggctagattagaaactttaaaggttaatgatcatagaaagactgactatatttctttatgccttaatagttttgaataaagcatggtagatgaaatggaaacataaaaaattggaccaggtcaggcagacttggatttaaac

SEQ ID NO: 479221 - DNA, 1562 bp, Homo sapiens
gaaccaggagagctgatagtataattccgcccttcaactgatcggatggtgtccacccatgttgcagaagcgactattgacattcttcatagaactagaaaaagatttttaaattcatatggaatcaaaaaagctaaggcaatcctaagcaaaaagaataaagctggagtcatcaatgcaaagggatttcaaactatattacagggatacagtaatccaaacagcatggtagaggatataggcacaggcaaagatttcatgacaaagacaccaaaaacaattgcaacaaaagcaaacattgacaaatgggatctaattaaactaaagagcttctgcacagcaaaagaaactatcaacagagtaaacagacaacctacagaatgggagaaaacttttgcaaactatgcctctgacaaaagtctaatatccagcattaataaggaacttaaatttacaagaaaagaacaaccctattaaaaagtgggaattgaacaatgagatcacatggacacaggaaggggaatatcacactctggggactgttgtggggtggggggaggtgggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaaaattattttcatgtatactggaaggttttaggaaggcttcttggtattcacttttctttatcattcctatagagaaatggtctttcattttctgggctttctttggtgtcctaaatcttaactggacttagaacaactttgaataagatatatacttcagaagagaagtcagaagctcatagtgtttatccgggggaatgccatatcaggtgtaccaattattagggggactagccagttgctgaaacccccaatcatgattggtattaccataaagacgattataacgaatgcatgggaggttaacagaacaccctttttcaaatcctataagataggcctagtggtaatgaactctcttagctttcatttgcttggtaaagtttttatttatccctcatttctgaaggatagctttgccagctatatccctcccccatgggtttccatgattcccttgtaactttgtggtggattccttttatcttaaggttgaatttttttctgtttccttcagtgaaaaagggctaaatgactactgttacacattagtcgcagagtaagagctagaaaacaggtcacaacaatcagtgcactgccttttaactacaagtcttttacggtttgttgagtaatactttacatagcttatatttttaaaatgtaatgctgagaaaccaaactgttaatttttccatcatgatgattcttaaaattgttcatgtttgcttatctatatgtattatatttagtttacttaaaatttaataaactgtaaaataaaaatagcatacgtatctactacttaaaataaatgttagcatttataatattgcttaaaatttgttcacttattc

SEQ ID NO: 479222 - DNA, 2016 bp, Homo sapiens
catcagctgagtttgttcgggttttgctttctgctaacccaccgtatgtggcggccggcagtcaccacgggaccccggagcctgtgattggctctgacacatccgaccgaaagggctcttattccaagaatgatcttcttttttagatggttacagaaaggtctaatcaattgtcaaactctcttttatcaccgagaaggtgccgctgacctagtggccggcacccttgaacccttacaacagcaacggccttgtcaaagcaatttgcttgccgctctccgtgaccagttatttcagcggcagagctgggacaccccgctggagagggcactccgctcgcctggctggcagggagctgggcggaacagcctcgttatttctgatgactttacttttgaacccagccggagttggagctatgtctgcaagttacccaagcatgaggaccaagttctaggcctgcctcagctgatgttctttgctgactgctgcctgcaagccatagaacttagcttaaaaaatggagagttgaagtcatggactatgaagagcaaaacacctgccaggataataagcaggatttacagtagaagtttgttaaatcataggatggagacatccatgcaagagaaagaaggacagataattgggagatgggagacgtgacatgtcagaaatgctatatgtataaatattactcgtaagtaaattaagtattttttaaaacaggcaaggaaaggttttcccacctgagctgtcctgaaatatgagatatctctgaagtacaagttggtatatttttcccagttgaataggaaaaatatgtttgattggacaaatgtcttcagcaatgataattacatgggtacctgaaacattacctgcctggtcattttctgcagggttaatattagcgtaatacaagttttatttaatgaccttttctctcttttcctggtactagttttccctgtgtgatttctgacttgggtgtcagattgtagaggaaagcagttgagaaagtatgggtgataaaaacagccctaatcaatttttatagggccagtagtggtgatgacttaattgctaccttggtgaaaaggctgtgattcttatgctaaattatttaaaaaatagctttcaatgtaaatgttcagaactttgtccaatctctcagcatttgaaatagtaccaacacaatgcaaatgcagcaatgcttaagaagagcaagttcacagctaatttgaaatacaggatttcaacagctcagtggagctgggcgctggagagggtggagcaggcaaagggaaatgcaggctatgtacataatgagggcaatcaatccaacttggtagccagcaagcaactgttgtgtttaaaatggagtattgtgcctcctgtcatggtgacatattcaattaagcgatatcctattattatttctcaccctgtgtgatttaacaaaaacattattgaaactagaagaaatcattctacacacaagcaaaagaaaattctttgattggaattataatgatgtctttcacaatctctgacaggtaaattatgaacagttgcagtaaaactttgctgtataatattaatttgaaataagttcagactgtctccagggcttttatttttataaataagtgttgagctattgggagggagggaaactactgcttcttctgaaaggtgatgactttagcatttatcttgtaggtagtgataagtaatacaaagtagagaatgtcagattaggacatggtgctgcctggagaaagccctatatgaacagcctttctcagaactctatctcccctaaagctttcaaggtgggggtggatgattttcacttacttaacttactctgtacatcactttccaagcatgacatttccaactgataagattttctaacctattagtcaataattcagcataaagttagagcagttgcttcaaattattactgtaccaaacttgggagattttgaatttcacttgctgggt

SEQ ID NO: 479223 - DNA, 659 bp, Homo sapiens
tcggaggtcgacctggaatcgatgagaaatctgaaggctagcttggggaacagcctgagggaggtggaggcctgctacaccgtgaagatggagcagctcgacggaatcgtgccacacttggagtcagagctggcacagacctgggcagaggaacagtgccaggcccagcagtacgaggccctgatgaacatcaaggtcaagttggaggctgagatcaccacctactgctgcctgctgaaagatggcgaggacgtcaatcttggtgataccctggacagcagcaactccatgcaaaccatccaaaagaccaccacctgccagacagtggatggcaaagtggtgtctgagaccaaagataccaaagttctgaggcattacaccagcagaaattacaactgcatggcccaggaaaggcgcaatggcaaagaaacaggaagtgattcttacagtggggaacccctggaagctgaggatgccaaagccttggctctgaatatctagatttacgtctcttctgtccaaacgtaatgtctaaagttgcctccttcctcttaaacaggtgttaatatcaggccataggaaagaaggcacttaatctctgactgtgcctagtttagcccatggacaacttcttctcagaaaagagaacattcacttga

SEQ ID NO: 479224 - DNA, 625 bp, Homo sapiens
tcaagcaaaatttgcgtgagaagtggccattggatttggcaatatgaacatgcgtagtgaccttgacaacagcaaattcagtaggatactagggatggatgaccaagttgcccaaaggcatataatcaattcccttgttcacagggctgttcatgagacacagtctggccaatgtgttaaaagcagaaataaaaaggagattgtagggaggactccaaccgtaagaattgagtacaaggagttgctcagtgatgtgaagctgaagagggcatctgaggagatgagctgtaaaacatattcacaagagggacgtgtgaagggagtgaccattccgaagaacccagacagctgcccacaggagaaggatgccatcccaaagatggtacccatcaaagctatttattacaccaattacactcataaccccgtaagggagagaagggagagagatatgaagatggctagtgggcaggccagtcagacaagctcagctgttaattcaccctatgccattccaaatccctgatggattagtagttcattctggtgtatggtatgaggtataaattcatttttcttctatttcaataatttctgatgacactttcattaacactaactagaa

SEQ ID NO: 479225 - DNA, 643 bp, Homo sapiens
tccttgttatgaactgaatgttcgtgtattcccaaaaactcctatgttgaaattcttacccctaaggtgatggttttaggagatgtgacccttggacacatgataaccctcagtcaattttccttgccagactggtaccaggaggtcctctgctccccctttgtatctccaactctcacgctttgttcatttcaccctgatgcaccaccatggatgaggtcgcaaatcttaagcaaatattcagatcactgtcgaggagctgtaactcaattggatcagttcctgctctgccaacatcccagtgcatttgcatgggggtttgttgaagctagtcacgaaaagcatgtagggttcatactgttccccatttctgaagatgacaaaagtgaaggaatacccctgataatacttgggttgagaacatttcttgtgtgcctactaggttcccagtgtggatccttatatcaaaatatgaagattgcccataaattgtaagcataaggcaaggaaacagggttcataagctacccagctattgctataattgtaaagaggtggagttggggggttgctctttcaaaaaataactgtcaaacatagaaacttacatgatactcacatagcctcattgttaacagcattt

SEQ ID NO: 479226 - DNA, 609 bp, Homo sapiens
tcaggaaaagtccttctgaggaagaaactacacctcttacaaatgcctggaataaatattaaaattaactacaaagaaattcttattgggcaaaataggagaaatggaaaacaagaagaagaaggcaaaatgagcttgaagacactctgtcaagcacattatcgagatgctgtgactcacaatttgttgtcttatgatcaccctctaacattttcctctgaagatacaactattttgatgattgaggaatataagtcagtcagcagttcagaatttcataaccaattgccagagggcaatattatatcaggaattggagaaggaaagggaagaacagcaactgggattttcttgagtaaatacaatatagataagtggcagttttcataccaaaatggtgccgcattcatagcacatcacctgtctcatgtgacaaaagcatgggaagtacaagccatttctgagtgctctgaattctttggagactctacagattatattatacagtatttatggaagtaagtgctgctttaggcggttggaaaaacacttgctgtataaccctcccctattttcacaagcacaaaagttcccagatgaattttcagg

SEQ ID NO: 479227 - DNA, 629 bp, Homo sapiens
tagcaaaatgtcttttaaagcattgagagcaagggaaaatgatggtaggggctagtggattcgtcactgtgaatcctggagaagacaaaggcaaagagttgtacttcttagtttgcagaggacatgggggtttaatgactctaactgggcagtccagaaaaggattgaagttctggctccaactgaaagaatgcttgggatccagagcacagatgggaaagttagaaaggaggagagacatgcctaagaggttaagaggaaaactgagaacaggaattgatgtgataaaattgaaggaaatacagttccgtgttgatcataggttctcagctcttttcaacacgctctcatatcaagatttcgatagcaagttcagagacgtctggagttgtactgagctcctgaattttctctaggtttgctttcgatattagtaataaggatatctaaagcagtcttgtctcagtcgttacactaaagataaatgttagatttcttagaagctcttttcttctattctcgaagtgaaagaggagatccactgacagtttcatctttacagatgaacaattattaagtctttcatgggcatgtgcaaagcagtaaaaaatttgaggagctgaatgtgc

SEQ ID NO: 479228 - DNA, 639 bp, Homo sapiens
gcctaaggtgttcttgcagccagccacccagtgacagcacaatggcagcagatctcaccagtgtgacattaccatattttgcatttgatttgcctatcaatgtgcagccagaatgcctggcactggagacagtaactgcatcggttgacaattctactctaggcccaggggggataatgagacctggagcccctaaacatggtgaaaacattggggttagcatgtctctgcagttccacatcaagaacaccgaaaactataccaggatggaggggaacaaccagcaccagcctgtacccccatttggtcaggtagcctggggctcacctgctcacaccacattggttgtggctacaaacaccagcaccatccttgcttgttccaccttcatgccaaatacctggcatgcaccactccagaacccaggtgttgcactaggaagaggcaaccacattcccattgttggagctcctcgtggttcctttttccatcagtccatggtcggtccacctggacaaaacacaggtagtgcatctacagtgaattccaccatagctataatgagaggccttcatgtgccgtcacagcagccaagctcccaaggccacctggacaatgattagatggtgtcatggggga

SEQ ID NO: 479229 - DNA, 582 bp, Homo sapiens
gccgataaaactaaaaagcaagcacactgggtatgcccgtgccttgggaagaagcaactggatggggtggaaaggagactgagttacctacagcagatcaaaccagagcttctggctgggatactggtatcttgagtgagtcacagcaggagatacgtgctggagctgaagaggttggagaggcagcagaaaaggttgcagcgtttggtgaagaccttttttgccttttgattggcatctgcatgggcctactggcctgtgttcatcattcccacaatccccttggttttggggagcagaccttccttcagctttgtgaattagaggtcatttttgtggagtctgggtgggagatagaggagaacaacctctggggagccttttcagggtcaagatcatctgcattagtcacccggatgcacttctttgctgtggtgactgcatcaatcaatgtgctgctgattctaaagagaggaaaaataaatttcaaatgactttttttcactgctgttcatgtttgctgccaatgtttgcctccatgcttgaaaacatgagcaaagatttgttatttggaagagctct

SEQ ID NO: 479230 - DNA, 658 bp, Homo sapiens
ttattctgtgtcaccctcaggattgccccatcctccctcccatgctcattggcacccaaagtccagaggaggccaagcagcagggtgctgccatgtcaacactggcccaagtgcatacacatccagccaggttgcaacagtgcctgggattgacttcaactttgctctgcaccagagtgggcctggagcagggagagaccagggagtggaagcacgcacttctaagctcacagaggcagggaggcatcttgggtccccaagagcttggggatgctcaggtcccgagctgtggctgcacagctgaagctgtgcctgggagtgcagagctcctgtcccaccaactcagtagggggtgcagtgctgcctcttcctggtcccaccagttccacagagcccacagcccaggcaacacctcccctgctgcagctggcatatttgcagcagccactccagatgggcagttgctgccatcataatgacctcttttttgtctattcttaaagttttttttttgttgttgtgttttgttttttttactttaagctgactttatctgatatgtctactcctgcttgctttttgtttccatttgcatggataactttttccatcttttcactttaagactttatgttgccttgaacagtgagatgcacat

SEQ ID NO: 479231 - DNA, 2689 bp, Homo sapiens
atcgcaacatgtgggtactatgggaactagaattcaagatgggatttgggtggaaacacagccaaaccatatcagagtatcctttccttaatgcaagacgcaggcctttggaatccaggttctcagaattgtatcagctgcaggcctatgattggaggatgagtggtgggggtgccctctctcagctggagcagcataagtgggtagcagaaaggagtccggtttgcttgtgccttggttccacagaagcccacagcaacagcagtgggatttgtacttacgtctctgacagtaaacagcgatttgaatttggagctccgcatgcagagtgcccaccctcccctccatcttacccccaacacggttccccagacaaagttgctcagttaagtaggcccactaagtaccagaaaatgtgccagggatcccactcacacagacctggggtgggtggacccaaagtggaggcaagtgtttacttgcaataatgatgaggatttaattgtgacggttagaggaacatttggaggaggtgaagagtaaaatcactttaggaagggagaagtgcccatgtaaaggctaggagatgaaacaatcatggtagaattgaggggctgaaagaagaccaggccctagaatgcaaagcatgaggaaggagaggatggagctagataatacagggacatggtcctgggttaagggttatccaaaggttcaagcaggagtaatgtctgattagatccttcttttaccaagaccactctggttactttagagagtggtttggaggagggtgaaaccagggactcctgcaataactctattaaaagataatgggttataaaggatattaatatatagacagttcaatctgtgcaggaactctaattttctgatcatctttacaaatttgacccttgcatctggacattgtctggtcctaaagcaatgtacttcatcaacattaaaaactcagtgacacacccttctttctcaaatgttttccatttatggacatttctggggaatcatatatctcttcctctggaaataatattgtcattgaaataacagaggggaagtggctttggagagaagatagaatattttctctcagtggtaatgatgttttttgactatctgaaagcctcggtatgataactctccttatctcagcccataaattaataaataatttagggatggtgatgtagataagtggtaaatcttttcaatttcaagcagtattataaagtcataatgataagattcttgaaaatcttccctatggaggaaatgaggaaatatttaccagaaaaaactgtaagagatggatagagatgggtaaccagaacgactgtgatcattcagtgaggtcaaagcatatcaagcatttctcttacatagattttctgacagtttgaagcagataatcatataggaaattgtaactgaatagctagatcacagggaatcagagactttaaaatagaaaaaaaaaaatggtcttgagagagctaaagttatccatgccatcaagaaaagcccctaggccccatagccaagaaattgtaactgaataggtagatcacagggaatcagagactttaaaataggaaaaaacaaaaaggtcttaagaaagctaaaggtatccatgccatcaagaaggcccctaggccccaaagacaagaagaccatgtttcgaaaggaaagaaatagacaattaattgtcccctaaactgtatctggcaatctacactcaggccagacttaggttaaaatacactcagaaaccttcaccttatgaactaatctatttatatgagtttgcatatatttctctacatttcccaaagcaattgccacctaatgatgctgattctgtccatttacatggcagtaggcaaggatcatctattactcatctgctgttctgaaaaatatagctatttcactaatcaggggcaaaaacatttatactatatgtttatttagacatatttatactatatatgtctaatactgatatcacatccattggttcatgaaatgaattgagcaattatttctcctaaagacattttatttttgtcaagcaaaaggtttgtatattttaaaggtagtcaatggtctataacaaattgcagcctcttttgctgtcaaaggataatctaatttcccttttggttactgacaaagcttgtgttgaaattcattattttaaaagcctttgacaatggttaatatagattaatatgggcattgtttttattgttattctctaatataacagcccttaactcatgcacaagcacattcatggaaattataaatgaaaatttgcatatgttatattaattaaaacttaacttccttctaacactgaaaatatatacccatgtgttaatagcttttccaaatgacatcagtacataagtggatctgaacgtacttgataaaagctggtcagtgtagattcgagaactattgtttaaccaatatcatgatgattgatattcccctccaaaaaggttactgagctgttccaaacgtcttgatttataaaacctgtggaatttctagtatacattatggccacatctgtgtattttatggatatggacaataatcaaagacttcatttaacttattctttctttgtagcaaggcctttatttatcctgccaaa

SEQ ID NO: 479232 - DNA, 908 bp, Homo sapiens
agccatgacttaaaggggccattatagagctcgggccatggcttctgatggtgcaagccccaagccttggcagcttccacgtggtgttgagcctgggggtacacagaattcaagaactaaggtttgggaacctctctctagatttcagaagatgtatgaaaacacttggatgcccaggcaaaagtttgcttcaggggtggggccctcatggagaacctctgctagggagatgcagaagggaaaagtggggttagagtccctacacagagtccctactggggcatcgcctagtggagctgtgagaagagggccaccatcctccagaccccagaatggtagatccactgacagcttgcactgtgtgtctggaaaagccacagctgctgacatgaaaatattttatgtgaaaaacagaaatatcaaagaacctattcaccctccagcaaacattcattattttatgctggcactgctctggattctggccattccaataaatgtgtagcggtatctcactgttgctttagtttgtttttccttaatgatgtggaatatatttttatacaattatttcacatctgtttatcttcttagaagaaaagataagccatttaagcaaaatgtatttttgtaaaattatcctgatcacatgggaagctatactgttttacagtattaaaggggacacaaaggatgtttgcacactaccttaataaacctccggcaatttttgagtagtctaaaaatgcctctgtcacttaagctttgtatacttgtactgagcccaaagctgtattaatttggctgtcatttaaatatatttttctcttatcattttccatttccatttcatcaatgtgcatttgcaaaagaaaggtttcatagtaaagaatatttatctgttatac

SEQ ID NO: 479233 - DNA, 638 bp, Homo sapiens
ttaaggcaggaacaggccattttcacttcttttgtggtggaatatcatcagttaaggcaggaaccggccatctggatgtatgtttaaggtggctcactcacctggctggcagttgatacgctctgttggctgggagctcagttggggctttgaagtggtttctgagggaatgtggtctctgcttgtggtttgggcttcttgtgacctgactgaaaaggaaaaggatgagttggcttactatgtagataaaccaaaaaattacggctgttccaaatcatccccaaacagggatagctttgaaagacagcaaattggaaagattactgatatgggcaaagtttcaggcagagtgggaagagaagtggccaatggaattcaaaaccagcctcggctgttagaggctgaaagattgggggtcgtgatcaactcagtataccactggaggctatatgagtaaacagcaaactgttctcataaactcaatgttggcaagctgacaaactgcatatgcctctcagaaggaatgctgtgggcagtcacgacccaggcaaaaatgtttcttgtgattaggtacatctgaagcctgttagtaataatatgaacctgtgatcagttcagcagctgactagtggttacct

SEQ ID NO: 479234 - DNA, 589 bp, Homo sapiens
ataaaaatcctctggtcaacctgaagaaaggctctggcttccaagaacaagcatcccaagagtgagtgtcatgaaaaacctaggtgaatgctgcaaggtttcttatgatgtaacctcagaagtcctaagaacatcacttccactgtatttcactagtcaagaaccccacaaaggcttgcacagatttgatgggaagaaaatagactctgggaaggaaatagcctctgctgctcactgggaggtgtatcagtcagtagcaacagaacgaacagtgtatatgaatcttctggctgctgtgctgagaatagaccttcaagggggaagggcagaggtagcacataaggaaggcggcatcagctttggcgtaaaccatggtgaagatggagttgatagcaacaaaactgtagaagactgcactggagtaggtttaggcggcgaaggactaggaattccatttcagacaaccaagtggagaaataaggagatcagctggagctgagtctaggcttcccagaaagagacatgtgttttgcaaatattttctcccagtctgtgacttgtcttttcatttttaaatagtgtttttcat

SEQ ID NO: 479235 - DNA, 1514 bp, Homo sapiens
tgcttcagtgtgccctggatataagactatgaactcagactttggggttaatgctgaaattgaagaactccctttagcatttcttgtaggacaggcagacgagcctctccctgtgggcaccaccactaccgacccatggagggttctgccaggccactgcttatgttcacataaagcccaagggctctttggtcaggttgtggtgaatgctgccaggcctgagactcatcctttagggcagtgggctttcctctggtccagggaaggcccagaaatgctgttcaagtccaagagcctaggcctggacagagggaccccaagagcctgcttggcgctctaccccactgtggctgagttggtacctaaggagcagcagcagaattgtcaggacaaatctgaggaactaaagcaagatacggaaatctgcgaaagaataaagggcaagagagcaaggaggaaaagaaaaagtgcaggacctcctgatgttctagactcacctgcaccatgggtcatggtaggggaaaggagaaacaagagaaggcctttgacagaacatttccctgaaaagatctctcccaaggagaaacaagtagccacttgactatagatgaaggtatgcattggtaaagaaaatatgggggctactgagaaggctaccaagtatatttttagagtaaaccattgtcctaagtactatttttaagaccattagttaatataatttatgctcaaatatcatactaaatactttcatcactgataaagtacagctttcattagttatgaaattcctacactctgaacctgattcttggcacagagaatgataacatatttgtttgctagggctgccatagcaaagtaccacaaactgggtggtttaaacaccagaaatttattttctcacagttctggaatctagaagtctgagatcaagataaagatgttacagtgatctttgtaaagctgagcccatggatagactgtcatttaaaagtacaattacattgccttaaagataggatacttcctgattgttagtagggacattttaatataaaaatatagctataaatataagatcaattacctacatcattcattcagataacaaatatttatcgatcattgtttatgtgccaagcactgctcaggtgttagggatacatcagagaacaaatcaaagattcatgccttcttggatctcacaatttttatgctcagaatatgtttactgtttgaaaatgaaaaaatataattactaagcatcttgttcttgagaaaattttaatctattaagctagccaacaaaacagtaggctgatatttgccatggatataattattgtatatacatacatattgtttgtttaatttatttaattatattgtaaggacttagagtatcaagatctatgtcaactgctatttaagacatagacctgccttaaatggcttacattttaaaatgaaagctgtgttgtcaaagtaatactgctgaatggtacagaata

SEQ ID NO: 479236 - DNA, 850 bp, Homo sapiens
gcatcttgatggtagtgctgacgacagcagcagcccttttgtttttagacctaattccttttccccaggaatgagtcacttctccagcagaacatgtgaaggaaacgccaccaactgccattcttgtgaaggaggccacgtcctgcaccacggagtgtgccaggaaaactgccccgagaggcacgtggctgtgaagggggagcttcccacaggagagcaaggctctgctgagccaccagttgggggccgattatctgagggtggatggcaaagagctgtgggaaccagtctccctaccattcctgaaaggtatgtctctgtgcctgtcatcagagaaactgaggagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagaaacacaaggactttggatccattccaatcacccagattatcctgtaatagatagtacagacacctctaaaagtcccatacctttcctgaagcactggagcagaagcagcaaggcagttgctaaggtcctgggctcaactcctgatactacttagcgcactatgtattcaaaaataaatgcaaaagggacctttatttgtcaacagacaattaaatacattccaacaattgctgtattcgtgataagctcaaggtactccggagagaca

SEQ ID NO: 479237 - DNA, 652 bp, Homo sapiens
tctctggcttggaaaagtaggcatacacttctctgcaccctatcccaacccactgttattagcaatgaatctaatgagtaaggtaaagaggctaaagtcactcagcttatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaagtatctagtatcacaccttttgaagcagccagcaggtcaccccaactctcaatcttgcccccacaccaggtcatctggtatactaatgccagaactgaggcccatgaagagaccccagaagttgctctgcatttgttgaattcatcccatggggttcagtctgaaggagagcagatggtgaactgctctgagttttaaagaaatgacaaaatgcctatcttttaggtcccagagctcctgcagaaccttagaagcaatgatagatgtagggtgttaaactttaaaataatagaaagccttctggaaatcaacaaactgccttttgct

SEQ ID NO: 479238 - DNA, 1009 bp, Homo sapiens
tcccacagtgcagcgacgggctgaagggctcctcaagtgccgccaaagtgggagcccaggcagaggaggcgccaagagcaagcgagcgctgtgaggactgccagcacgctgtcacctctcagtaacaattgttatcactgggtgcctggagcaaaaatgtgtccagaattggtgggttgttggtctcgctgacctcaagaacggagccgtggaccctcgcggtaagtgttgtgtcccgagtttgttccttctgatgttcagatgtgtccagagtttcttccttctggggggttgctggtcttgctgacttcaggagtgaagctgcagaccttcgcagtgagtgggcggcgcatctggagttgttcccagagggaaaagttctccaggtctccacccaacccaaaagcccagctggcttcacctctcaatggcactggccgccaggacttttgggcacctaccccgggcattccggcaacccagagggagctcgtacctggatcaagcccagcaggcgccgagtgtgggacccgctcccagcccgcgcccacctggaacccgtgctggcccactagcgccacagccccagctgccgccctcgcctctgcctccacacctccctgtgagcagagggagccggctcccgcctcggccagccccagagaggggcccccacagcacagctgcgggctgaagggctcctggagtgtggccagagcagatgctgaggccaaggaggcaccgggagtgagcaagggctgctagcacgttgtcacctctcaaaaccacttgagctttaccatccaacataatatcctttcgttatctcctcactatagttctagaactatcatttgcacattttatgttagatatgatggatcaaaattgtttaccagaacttaaatggtaaaaagaggccatattaattacatactgcattgacaatattgatgatgctttgtttcagatatactatatatcgatgttaactgcttttgaaatattt

SEQ ID NO: 479239 - DNA, 549 bp, Homo sapiens
ccaccacgattgtaagttacccgagccctctccagctatgcttcctataccacctgtggaacctgagtgaatgcgcagacctgggcctcctggctgggaggaaaagggttttggagagccatggggtagtatagggtactccatccaccaagcaataatgacaaatttggaggctgaagagaggggactgaagacaaacagcttgcttctgaatgttgccaaaggctgccctgtccagaatggcagtcattggtctcagcaagcacagtggttctctgatgctactggggcagcagtcaacagctcaggctttccttggcacatccacgaccataaaggtgaaataaaccttgagcccataaagagtttgctgataattaaagaagctcaagaaggagccaccaagacacaacaagcgtggcaggaagcggaagctcaggacctcgtcttcatctttggggctgtatgtttcattgtccaccagaaagacctcttccagtccctccgctgaagaaacttttgctcgaataaatatttctatccagtttc

SEQ ID NO: 479240 - DNA, 531 bp, Homo sapiens
agttaagaagcagtaagattcgtatgcagtatatacgaaagaaaaagcagataattgataaaacctgttcattgaaagacagaagagttgattctagtgcacagatggagagattagcaataaacaggaaggatgatgcctcttctctaagagaggttgaggaaatagccacagatgcaaggaatgaggagtcagatgtgaaaaacagtgaagagggctatgaagaaaggagatcatacggctatttgttcctacagcacaccctcatttgtcatcgccgatacacatctttaacccctcaaaagttaaagatcactttaaccctaatgaatgaagtcctaacagaagacgaattccaggaagaatttcttcttctcttcataccgatgagagccatatactatattgaattctgccttagtattccaattacctctgagtaacatttctccctatggtagcatatgacacattgctcttttttccttcgtaagtcacacacaatcactcatgaaggaaaaaattgtgcac

SEQ ID NO: 479241 - DNA, 555 bp, Homo sapiens
tctggagcctgctgactgaggttcagatgtgcccagcagcgtctacaggaatggcgttggggctttaacatatgggcaagaaaggctctcttcctcagctttctgttcaagagaaccagccaccaggcttattaatacatcttccaggactggattccaggaccggactccaggacgtttctctggaagaactgaatggtcccaaagaatacatctataggctcaggcatttaggacccccccaggtttcacccacctgcacagagattccagtcagcatgttagtgcctcactctgaaatatcaatgcacagccacaaaccactagacttaggccactcttccatagggctgctgtggtttgctgggggtccactccagatccgagtcacctcagtccctccctggacgtatcaccagcgaaggctacgaaacagcaaagatggcagcctgctccttcctctgggggctccatcccagggggcaccaacctgatgccagcctgaacgttcctacaggaggtgtctggagacccctgttaggaggtctcacccag

SEQ ID NO: 479242 - DNA, 1792 bp, Homo sapiens
agcgagtcatgtcaagattctgtgtgcctgcaggcttaataccacatggaagctgccaaggcttatggcttgcacattttggagctggagcagaagcttgagctgtacctgggcccctttgagccacagcaggagctggagctagagcagctgggatgtggggagcagtgtcccaaggctgcacaaggcagcagggccctgagcttggcccacaaaaccgttcttccctccttggcatctgggcccatgctgggagggcctgctgtgaagccctcaaacacttccaacctctacccattacccagttccaaagctgcttccaaattttcagcaatgtccaattgctttacagacgagaagctgatgtccagagagactggcttgcccaatatcatggaatatgtctgtctatacattatttctgtggacaataaggaaaagattccaactttggaaaactagaatataatgagtttggaataaaaaagtaaagccctattcacggccattgtgttattatgtatgatataattttcacaatcaaaaaataccatttggatattcatgctatcatggttgtttggtactttgactgctgccgctgtttcagctcagacaagagtgtgatttcatcctgaggtcaaatcccatgcaagcacgatttatcgaagcaaaatttcatctcacaaaagcgtaatgcattctgccaaacctgttcatgccaatgcaggtcatttaatatataattggctgcagctggcactcacacaagctgtgacattttctatcagcaacagggtagtatttggaatgccaaagaaacaattacatgctgcagatgagagcctgaagtggaaaaagaggaaatgcagtattaaagaaaccagcccttttccatttcaaagagctctcctccttacctgttgtgtagcctgactgttcatttatcacttttcttgcttcctaggttatctagattttagtttacattgaacaaaactttgaagcatgaagtacagaaataattgttctgtagacttaattgcctctaataaattgaccctttattgggtccattttccttttcccctcaaagacatttagttattccataattgctgttgacataacaaaaactttcaaaaatatttatattgctactctccaaaagatagtaataaaacaagagttcactttcatgatatgtagaagttcttcctagtaacttttccccatatatatttcattatttgcatctccaagtgattaaaaggatgcagtacattttaaaggatagatttggacaaatgtggacgttattcagaaaataataatataattgtttatcattttgtgcacatcctcaagttattgtacctttacttagaaatataacaaatatttgtagtttttttattaagaacagccattggaatcaagattaaataaataatttttgtttggtaatatatattaaattttatgttttgttactaaggaacagtttaagacttttgccccatttcacatattcagactttcatgatcaccctttcaaaatgataagtcaggtctaaaatggattaaccttcctgtttctcagtgtgagaagtaatgagtgaggcaaatgtaaattacttttattgtttttattggcacaagtcaaagaaaatgcatcaaaaagaacatcaactctgaaggagtaagttggtttcctatttcagccaatacttgctgccatctgctggcctaaacggaaagctgcaaggaatggacagctgtgtagagggag

SEQ ID NO: 479243 - DNA, 642 bp, Homo sapiens
gaagcctaacagccgccttgcgattgtgtccgcactgacaccttggcctgtatcctggacctttgagttcaatgtgttctctaaaatgttttcaatccttcttccccgtcacttctactccccatcccacccattggctctagtttggtagattcagtgggtacatgtgcacgttagttacatgggtatattttgtgatgctgagcaatctaatcaattgcctctcaacatctaatcaattgcctctctacctcacctccccacctcatctagcaattatggacttttcctttaaacagcatcctgaatttattttggaaccactgcatgcagcttttgcactgagcaactctggggatgtaatacacattttagttttgagggttcctcagttgtctcttgctatgtcatatgtggcttctcagggcctagatcaggggaggccacatgatcctaaaattgtaccaccaaactgttcaggaccaattctcaacagcagggaagtttggcagtgggtctcaaacgcccctcaggggatattcggcaacacctggagacatttttggtttttacaactagggaagagagtgctgctggcatttaaggagtagaggccagggttgttgctaaacatcctacaac

SEQ ID NO: 479244 - DNA, 765 bp, Homo sapiens
actaatgtcagggcaaccagtgcagatgccctgcccagagaggaggaatctagagagacagtctggctactgcagctttgccatgctgcggtgggctccgcccagttcgaacttcctgtaggctttgtttacactgtgaggggaaaaccgcctactcaaacctcagtaatggtgaacgctcctccccgcaccaagctcaagcatcccaggttgacttcagactgctgtgctggcagtgataatgttgtgaagaaacaattgtgtatgtcagtgcatatctctgcaaaaggcaatatgctacaagctgcagagtattcaaggatgtttgctgccttgatgaccttcgaatcttgtaatggagaagagataatacaaaaacaaaacacaaagcagagggaggagctcacactctgggatggatcaggtggcagtagtgccatgtcggtgccctgtccatgttccctcaagcttaactcttcagtgcatgcagacccaacttcctactgccagcatcttcatttctttgcctgggaaatttctctggccatgattgtatacagttgtattcctcaaaatattccagtgtacttctcttgaaggtggatgggctctgtgactattttgagcaacggcatatacaacagtgagtccatgtattatttggtcccaggctggaaagcgttagcagcccatatttcccattttggggaacatttgctcttagagtctagccaccatattgtaaaaagcccaagcagtagcatc

SEQ ID NO: 479245 - DNA, 2275 bp, Homo sapiens
tgtggattcctcaagctcagtgggattcacagaccatctgggcagatgctttcgtttcagagactgggaaactgaggccctgtgtggcatttaacttgcccagagaagcagccccttgaaaggaaaggaaaggccagctagaccttgggccctggtgacccgccacactaaagcagccagcagctgcagcctcacatccaagccctcgcccagagccctggccccagaatctccctccccgctcgcactcaggggcagctctcccttcaaggatgctcctgctcagatgctctctggggagaagccaggaggacacgcggcctggaagcattcccagggccccccacagactgcagcggaccacgcccagcctcagtgaacagaaaatgggaactaggaacgctggctgcagtgccaggagggggacagagggccccaggactccaggccagagcaatcagagagatgcttcttgaagctggaaggaagaagccaatgtgccacctaccgctgcgcccactggggctgaccactgagcatgggcatcgccagctactgctgtgcccactggggctgaccactgagcgggggcatcaccacctaccgctgcgcccactgaggctgaccactgagtgggggcatcgccagctactgctgtgcccactggggctgaccactgagcgggggcatcaccacctaccgctgcgcccactggggctgaccactgagcacgggcatcgccagctactgctgtgcccactgaggctgaccactgagtgggggcatcaccacctaccgctgcgcccactgaggctgaccactgagtgggggcatcgccagctactgctgtgcccactggggctgaccactgagcgggggcatcaccacctaccgctgcgcccactgaggctgaccactgagcacgggcatcgccagctactgctgtgcccactgaggctgaccactgagtgggggcatcaccacctaccgctgcgcccactggggctgaccactgagcacgggcatcgccagctaccgctgcgcccactggggctgaccactgagcacgggcatcaccacctaccgctgcgcccactgaggctgaccactgagtgggggcatcaccagctactgctgtgcccactggggctgaccactgagcacgggcatcaccacctaccgctgcgcccactgaggctgaccactgagcacgggcatcgccagctactgctgtgcccactgaggctgaccactgagcacgggcatcgccagctaccgctgcgcccactggggctgaccactgagcacgggcatcaccacctaccgctgcgcccactggggctgaccactgagcacgggcatcaccacctaccgctgcgcccactggggctgaccactgagtgggggcatcaccacctaccgctgcgcccactgaggctgaccactgagtgggggcatcgccagctactgctgtgcccactggggctgaccactgagcgggggcatcaccacctaccgctgcgcccactggggctgaccactgagtgggggcatcaccacctaccgctgcgcccactgaggctgaccactgagcgggggcatcgccagctactgctgtgcccactggggctgaccactgagcgggggcatcaccacctaccgctgcgcccactggggctgaccactgaccacgggcatcaccacctaccgctgcgcccactggggctgaccactgagcacgggcatcaccacctaccgctgcgcccactggggctgaccactgagcacgggcatcaccacctaccgctgcgcccactggggctgaccactgaccacgggcatcgccagctaccgctgcgcccactggggctgaccactgagtgggggcatcaccacctaccgctgcgcccactggggctgaccactgagcacgggcatcgccggcatgcggccaccttcctggacacccagcagtgctgccccctgcagccagcacaggctgacccaagcctcgccttccacaccctgcacaactcctcctgctgggatagtgccccggtcttcagcaaactcctccttgggtgctgaggcccagctgtcacctcttctgaggaggcccggctgtcacctcttctgagaagctttccttgctttctgacccagcactccgccagccccactctgctcccacagccaaccatcttgtgcatgtcactcttctgtgtacaaacctgcctctggaccccaggctgggagccccccagtgcaggcatct

SEQ ID NO: 479246 - DNA, 837 bp, Homo sapiens
tgctggggccgagttatggccgagcgtgaagggtcaggggacaaagggacagactcgttcaggagtgtgtatgtgtacgtgtgtgcatcgtgtgtacatgtacatcgtgtgcatgtgtgcattgtgtgtgcacgtgtgcatcgtgtgtgagtgtgcatgtgtgggtcgcgtgtacatgtacatcgtgtgtgtgtgcgttgtgtgtgcacgtgtgcgtgtggcagatggggcaaaggatcggtcatttctgcactttttggagaaaccgcccttgaagattctgattggcatccctggcatagaagcctccggagtggggcaccaggaagcgcgcaccacccctgacaaggactttggtttcttcttctcgctggtgtatgcatttgccgtcctgagcctgctcactcatcgaattccacgtggtcgtctgggagtgattccgggtgcttcctggtttgaatttcacgggaccctggaggacatgaactcagaaataagaggattttaagtttcttggtcaacatgattttataagcttttagggatagatgaagtagttcaacatttacttaaatatttaatttgctcaatcgtttacatctttaaaaacatgaaaataacatgttcttaacagtgggggaaataaataccccaggagggatgggcccagcccagtgcctacagacctaggtagagtcaccaggccgggccggcaggagcccctcagggcagctccgggcccttgctggagggcaggagaggcccctgcggctcagggccagcctccccatgtgggctctctggcaaggtagttggacttttttatgtggcacccac

SEQ ID NO: 479247 - DNA, 2936 bp, Homo sapiens
tgaatgagagaaaaatatatgtatcgcagtcccgaggccgcagtgtttcgcagtcccgaggccgcagtgtatcgcagtcccgaggccgcagtgtttcgcagtcccgaggccgcagtgtatcgcagtcccgaggccgcagtgtttcgcagtcccgaggccgcagtgtatcgcagtcccgaggccgcagtgtatcgcagtcccgaggccgcagtgtttcacagtcccgaggccgcagtgtttcactgtcccgaggccgcagtgtatcgcagtcccgaggccgcagtgtatcgcagtcccgaggccgcagtgtttcactgtcccgaggccgcagtgtatcacagtcccgaggccgcagtgtatcacagtcccgaggcctcggtgtttcacagtcccggggccgcggtgtttcacagtcccggggccgcggtgtatcacagtcccggggccgcggtgtatcacagtcccggggccgcggtgtatcacagtcccggggccgcggtgtatcacagtcccggggccgcggtgtatcacagtcccggggccgcggtgtttcacagtcccggggccgcggtgtttcacagtcccggggccgcggtgtttcacagtcccggggccgcggtgtttcacagtcccggggccgcggtgtatcacagtcccggggccgcggtgtatcacagtcccggggccgcggtgtttcgcagtcccggggccgcggtgtttcgcagtcccggggccgcggtgtatcgcagtcccgaggccgcggtgtttcgcagtcccgaggccgcagtgtatcgcagtcccgaggccgcagtgtatcgcagtcccgaggccgcagtgtttcactgtcccgaggccgcagtgtatcacagtcccgaggccgcagtgtatcacagtcccgaggcctcggtgtttcacagtcccggggccgcggtgtttcacagtcccggggccgcggtgtatcacagtcccggggccgcggtgtttcacagtcccggggccgcggtgtatcacagtcccggggccgcggtgtatcacagtcccggggccgcggtgtttcacagtcccggggccgcggtgtatcacagtcccggggccgcggtgtttcacagtcccggggccgcggtgtatcacagtcccggggccgcggtgtttcacagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtatcgcagtcccggggccgcggtgtatcgcagtcccggggccgcggtgtttcgcagtcccggggccgcggtgtatcgcagtcccggggccgcggtgtatcgcagtcccggggccgcggtgtatcgcagtcccggggccgcggtgtatcgcagtcgcggggccgcggtgtatcgcagtcgcggggccgcggtgtatcgcagtcgcggggccgcggtgtatcgcagtcccggggccgcggtgtatcgcagtcgcgaggccgcggtgtttcgcagtcccgaggccgcggtgtatcgcagtcccgaggccgcggtgtatcgcagccgcggtgtagccgcggtgtatcgcagtcccggggccgcggtgtatcgcagtcccggggccgcggtgtatcgcagtcccggggccgcggtgtatcgcagtcgcggggccgcggtgtatcgcagtcgcggggccgcggtgtatcgcagtcgcggggccgcggtgtatcgcagtcccggggccgcggtgtatcgcagtcgcgaggccgcggtgtttcgcagtcccgaggccgcggtgtatcgcagtcccgaggccgcggtgtatcgcagtcccgaggccgcggtgtttcactgtcccgaggccgcggtgtatcacagtcccgaggccgcggtgtatcacagtcccgaggcctcggtgtttcacagtcccgaggccgcggtgtatcacagtcccgaggccgcggtgtttcacagtcccggggccgcggtgtttcacagtcccggggccgcggtgtttcacagtcccggggccgcggtgtatcgcagtcccggggccgcggtgtatcgcagtcccggggccgcggtgtatcgcagtcccggggccgcggtgtatcgcagtcccggggccgcgtcccggggccgcggtcccggggccgcggtgtttctcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtatcgcagtcccggggccgcggtgtttcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcggtgtttcgcagtcccggggccgcggtgtatcgcagtcccggggccgcgtcactgcaaccatgatcaatctctggttgtcaactcaaacctcagtttctcctgga

SEQ ID NO: 479248 - DNA, 571 bp, Homo sapiens
atgtggtttgtttgtatggggcctgtgtatttagggacagcacagatagaggcaagaaggaatcagaatggaacctacaaacgtggaggggaaggagccacagcccctagagccaccacatgtgcagacccaagttggaatggatctcggagctggcgctctggagtgggccctaatccaatgacggaatccttagaagaaaagggaaatttagacacaggagagcacccatgggaagacagagacacacagggagatccccatttgatgacacagacaaaagttgtcacaatgcagctgcaagccaaggaatgccaagaattgatggccaccaccaggagccaggaattctgttatggcaacaccgaatggatgaaggcagaaacgaatgcaacagccatggcagattatctgggggagcctcttacatccagctctccctcccctcctctccactaccactttgtgctgccctaagtactctggtcacccacatgtaatagacatcctctcccctgcacatggctttgctttggggagaggtatggaagctgatctcaagcttgatagc

SEQ ID NO: 479249 - DNA, 504 bp, Homo sapiens
gtggccaaagtagagcttgggccatgacttcagagggtggaagcctcaggctttggcagcttccacgtggtgttgagcctgtgaatgcgcagaagtcaagaactgaggtttgggaacctccacctagatttcagaagacgtatgaaaatgcttggatgtccaggcagaaatttgctgtagggcagggtccttatggagaacttctgctagggcagtgcagaagggaaatatggggtgggaaccccatacagagttttccaggggaatgtttccagcttttgcccattcagtatgatgttggctataggattgccatagatggctcttattattttgagattctggatatctggatattagatgtttttcagatgtataacttgcaaatatattctcaacttctggacatagatggagctggtggctattattcttagtaaactaacacaggaacagaacaccaaatactgcatgttctcacttagggctgaggctttgtgtagg

SEQ ID NO: 479250 - DNA, 571 bp, Homo sapiens
tgcccaattctgctctggctaaactggtatccaagatgcaagacaaagtccttcccactctttcctcttctcttctggagtgtagagtcggggtctattttggagtcaagagttgtacatcctggagttatgggagagccagccccttctcatccttcaggtctcagtttactgctagttactcagaaaatgtatccctgaccaccagatttaaagaggtatctatggatgaaaaccagctgcagctgaggcacgtgggtacatgcaataacacaatggtggacaaaagccccatttttgacagaagtggctgtgggggcttccagtggaatacactgtgtgatctggatattccaatcagacaggcacctttgtccatctgcagaaatgctaacattctgtgtaaagaggcagtaagactctctacccttcatgcaagcctgagcccagaggacacttctcccatgaagatgcagttacctcaaagtgcccccagaaaggcagtcaacaggtgcaacaatgctgatctcccatggggaagccccagctgtgactgcagtggtaagtgaga

SEQ ID NO: 479251 - DNA, 625 bp, Homo sapiens
cactcgtaagtgggatttgaacaatgagaacacgtggacacagggaagggaacatcacacaccagggcctgttgggggttggggagctaggtggtctgccaaggcttcccttggctaggaaagggaaatgccccggccccttgtgcttccagggtgaaaagatgccccgccctgcttcagctagccctccgtgggctgcacccactgtccaaccagtcccagtgagacgaaccaggtgcctcagttggaaatgcagaaatcacccatcttctgtgtcgatcacactgggagctgcagaccggagctgttcgtattcggccatcttggaagagtctgccccaaggataaactttaaatgccttctcaattggaggtctaaaccttccgttctgccttctaaatccaattctaccaattatgagttcctgtttggggtgaaaagttttggaataaatggtaatgatggtttcacagtgttatgaaggtaattagtgccactgaactgtacattgaaatatggttaaaatggttttatcttcaagatggtttattgggggttttattaatgtgcctcatccacttagagtaaaatagagtgtgaagattcacactgtaaactttcatc

SEQ ID NO: 479252 - DNA, 581 bp, Homo sapiens
ccccagggctgcagtgtgcagctctggactgccaagtcaagatctagagtcagcactcaaaaacactttgctattatgaccccctgtgaagccaagaaagataactcagcaacaaataaggatgctgcacaaagctgtggtcctctgaaaatatcgagaaaagaagtcaatagactgtactcgaattacaccacagtgaaaggaacatcagtccacacagatgagaaaaaacagtgcaataactctggcaacccaaaaagccagagtgtcttgttccttccagataatcgcactacttcctcagcaagggttcttaccaaggctgacatggctgaaatgtcagaaatagaactgagaatatggagaggaatgaagagatcactgacattcaggagaaaaaagaaacaaactgatcagatacagctgaaaaacacactaaaagaatttcataataaaatcacaaatattaacagcagattacaacaagctgagaaaagaattgcagagcttgaagactggttttctgaactaactcagtcagacaaaggtaaagaaaaaagaattaaaaatgattaacaaaa

SEQ ID NO: 479253 - DNA, 745 bp, Homo sapiens
cagggccatttcattaatgagagtatgacagagacctggaagaaggtccacagacaccagatccagaagagccattggtgcagttccagtccaaaggctggcaagcagagaccctggagggttgatgtgcaggtctgctgcagttttctggaagtccgctccagaccctgttcacctggctatcaccagcggaagctgcagaacagcaaagatttctgcctgctccttcctctggaagcttcatcccagaggggcaccggcctgatgccagccggagctctcctgtatgagacattccaaaaaattgaggagaaaggactcttccctaactcattctatgaagccagcatcagcctgatgccaaaatctgagagagatgcaataacgaaaaaagaaaacttcaggccaatatccctgatgaacatagatgcaaattgcaaaaatcttcaacaaaatactagcaaaccaaatacaacagcaaaccaaaaagctaatccaatgtgatcaaatagtctttattcctgggatgcaaagctggttcatcatacacaaatcaagaaatgtgtattcttagcaaactatcgcaaggacagaaaaccaaacaccgtatgttctcactcatagatgggaattgaacagtgagaacacttggacacaggaaggggaacatcacacaccggggtctgtcgtcgggtggggggaggggggagggatagcattaggagatatacctaatgtaaatgac

SEQ ID NO: 479254 - DNA, 1022 bp, Homo sapiens
tgacaggacccgggatgtgatgttccctgccctgtgattgtcttggcaatgcggactctcttttggttctatatgaactttaaagtagttttttccaattctgtgaagaaagtcattgctgcaggtctgttggaatttactggaggtccactccagaccctgtttgcctgggtatcacagcgaaggctgcagaacagcaaatattgctgcctgatccttcctctggaagcttcctatgccctgcccacagatgtggagactacagaggcagctggccttgctctgctgtggtgggctctgcccagttcaagcttccctggtcgctttgtttacctactcaagactcagcattggtggatgcccctgcccctgccaggctgctgcctcgcaggtactgtctgtcatggcttcccttggctaggaaagggaaataccccgactccttgtgcattctgggtgaggcgatgccccaccctgcttcggctcaccctccatgggctgcacccactgcccaaccagtcccaatgagatgaaccaggtctttgaggaattgccacactgtcttccagaatgattgactaatttatccttctaccaatagtgcataagcattcctttttctctgcaatttagccagcatctgttatttatcaactttttaatagctattctaactgcttagtctattctgctgttaatacttataattacattgtaaacttattatcatgtgtttttcagctctatccgatcagttttgttctttcttaaaatggccatattatcttttatctcttgtatcatattttttttttttgatttgttgaattgtgtttcaactttctcttgaatgttgatggtcttctttcctatctatgttctgaattcaatttttgatatttcatccattttaccctagtcaagaactattgctggataactagtgtggtcccttggtggtaatcagacactctggcttttagagttgtcaacattcttgcattggttaattctcatctttg

SEQ ID NO: 479255 - DNA, 976 bp, Homo sapiens
tcctcctgaaacttttctaaaaaattttaaccagcaatgggtccaaaccaagaagaaatccctgatttacctgaaaaagaattcagaaggttcaatattaaactaactggggaggccccagcgaaaggcccctctgctgcaggtctgctggggtttgctggaggtccaatccagaccctgtttgcctgggtatcaccagcagaggctgcagagaagcaaagatggctgcctgttccttcctctggaagcttcgtcccagaggggcactcaccagatgccagccagagctcttctgtggagccacttgaggaggcattctgtttcttagcagaacttgagcactgtactgggagatctgctgctctcttcagagccagcaggcaggaatgtttgagtctgctggagctgtacccacaaccgccccttcccccaggtgctctgtcccagagagatgggagttttatctataagccactgactggggctgctgcgtttctttcagagatgccctgcccagagcagaggaatctagagaggcattctggatacaggggctttgtgaagctgcgctcgccctccgtgggctgcacccactgtctaaccagtcccagtgagatgagccaggtacctcagttggaaatgcagaaatctcctgcctgcattgatctcctggaaactgaacaccaaagctgttcctattcgaatatcttgccagacaccagcagtaaagaatcttaagagctgtgagacaaaagcaccagaaaaataaattatttttatgcttgaccattttacataagcccatattttttgatactttgttcatttcttttgattattttcatatgcattttctgatcgtgttaattcaaaagccctatcttcaagctattgttaaagctttccaatgcattttgtaattctctaaatgtatcttttatttccagaagttctgattagtttttatttaagatat

SEQ ID NO: 479256 - DNA, 658 bp, Homo sapiens
aacagattatgtcatctgcaaatggctaaagtctcctctgggattaagtggaacctaggggtttgggcatgcctggctctgctccactacagatactccctcaccaaacctgtcagctggtttgctgctcctaccactgctctaagcagctgcccttgtcaattcaagtgcttgtggtggtcaagaggtcacctactggaatctcagaggcccatgatttgccacctgtgccctctggaagggcagccaaagtggcccacattgtacctagacacagtggaatcacaccttgaattgctgaggcggtatgctccagaatatgagcagcaaaaacttgaggcagtgccaggcagtgagtgctccggttctgagaacattgaaggttactcttttggtaatagttatgtccctcatttctttatactatttacttgtgatggaagtggaaattccaatgatcttggaaatgacatcagtttcatttttctgttctcttaatgaacggcaccagtcttccatccatccatattaatcttcttgtaaaataatctcttggccaaacttttggtgttctgtcacggacatgcttttttctttattctgtacaacttgagcagactagacattttccaaatgtttaagtgttgacatcttttca

SEQ ID NO: 479257 - DNA, 1147 bp, Homo sapiens
aggagtacagaagcccaacggatagtagagaggaagcagagtggtttacagtcctggacgttaaggatgcctttttctgcatccctgtacatcctgactctcaattcttgtttgcctttgaagatccttcaaacccaacgtctcaactcacctggactgttttaccccaaggggctaaaattatccaaaggcaccacggccctcagtgaggaatgtatccagcctaaactggcttatcctcatcccagaaccctaaagcaactaagagcattccttggcataacaggcttctgccaaatgtggattcccaggtacagcaaaatagccaggccattatatacactaattaaggaaactcagaaagccaatacccatttagtaagatggacacctgaagcagaagcagctttccataccctaaagaaggccctaacccaagccccagtgttaagcttgccaacagggcaagacttttctttatatgtcacagaagaaaaaggaatagctctaggagtccttatacaggtccgagggacgagcttgcaacctgtggcatacctgaataaagaaaatgatgtagtagcaaagggagatcttactctgtggacatctcatgatgtgaacagcatactcactgctaaaggagacttgtggatgtcagacaaccgtttacttaaatatcaggctctattacttgaagggccagtgctgcaactgcgcacttgtgcaactcttaacccagccacatttcttccagacaatgaagaaaagaaagaacataactgtcaacaagtgcatgactacaaaccctacgcagaaactctacaggataggaccctagaaaacaatactgaatctggcactggtaaaaagacaagtagcgaataaaaataaaacaatgacaacacaaaaccattagcaggaaaataaacagatgcaactttaatgtttatagtttattgtaagctaatttggttctgtgtgctttcacgggtaaagactgtatgagttccttggttatatagagtctttgcatggtgacattctcagatgctgtgtgcacttacttatctactttttccccagtggcctgaagtctgaactgtccaacatagtaaataaaacattggggggaaataaataaata

SEQ ID NO: 479258 - DNA, 480 bp, Homo sapiens
ggaaaaagcaaggtgtagaatatcatgtacagtatgctagtatatatcaaaaagagttcaattgctggctgtgatgaaaaggagtggactggtccccagatcaccagcagaaatctcaggatggaacaggcagaacacttaagcagaaggagtctgtgggaagatcacaggggcagaagcagtggtagtgacaactgccaaaagcttgttgctgcctccgggaattggtctctcagaggaactgttctgtggccatcgtgtccaagtgggagtggggcagctgcactgtgggccagaaggtggcaagcccccatttggcagggggcagccgaggtggggagttgtggagcatgcagcctgcccactactattcgatatctcagctgtggcatctgtgctggaggcatgcgaaagtgctcccacctccttgttctctccctggcctggcaacagcaggggataggacagtgacagtggcaa

SEQ ID NO: 479259 - DNA, 539 bp, Homo sapiens
agtcttaaaatggcctataaagccatatatgatctgactattatctatctgattccatctgctcttctactcttcattcactctgcttcagacacattgtactactgtgtaaatgacacatgcttgcataagctccccttttttgctctttttcttcctgctgtgctgaatatccatatgactaggttcttatcttccttcagcagagagaaaaccatttttctttcaggtatttacttagatgtcaccttcacagctattcagaaaggcaataaggaagctgcaagaatacatgctgaaaatgcaatccaccagaaaaatcaagcaattgatttcttaagaatgagtgctagagttggtgctgtggcagtcagaggtcaaaatgcagtaacaatgggcagggtaacaagtccatgtgaggcatagttaagtctgtgggtgcttcattgaggagtagaaccttgaaaaaaaagaattatgttcagacagcatcttttcagtgtaaagaagaaaaatgcctatattaacattcatatggt

SEQ ID NO: 479260 - DNA, 2435 bp, Homo sapiens
cactaggctccttgctacttctgaaaatttctgcagccggcctgaatttcttctcaaaaaacaggcttttcttttccactgcatttgatctactgacttcacaatgtctgaaatcagattcaccaatctcacttgggatcaagttataacactggatcaagtgttagatgaagtaattccaattcatggaaaggggaatttccccacaatggaggtaaaaccaaaagacatcattcatgttgtgaaagatcaactcatagggcaaggaattattgttaaagatgccagattgaatggttccgtagcaagttacatacttgcaagccacaatggaatcagctataaggatctggacgttatttttggtgttgagcttccaggtaacgaagaatttcaggttgttaaagatgcagttctagactgtctacttgactttttaccaaaagatgtaaagaaggaaaagctctccccagatatcatgaaagacgcttacgtacagaaattggtcaaggtttgcaatgggcatgattgttggagtcttatctccctttcaaataacactgggaagaatttagaactaaaatttgtgagttcactcagacggcagtttgaatttagtgtagattcctttcaaattgttttggatcccatgttagacttctacagtgacaaaaatgccaagctaaccaaagaatcctatcctgttgtggtagctgaaagcatgtatggagacttccaggaagcaatgacacatttgcaacacaagctcatatgtaccaggaaacctgaagagattagaggtggtggccttctgaagtactgcagcttgctggttcatggcttcaagccagcctgtatgtcagaaatcaaaaacctagaacgttatatgtgctctagattctttattgattttcctcatatagaagaacagcaaaagaaaattgaatcatacctccacaaccatttcataggtgaaggaatgaccaagtatgactaccttatgaccttgcatggagttgtgaatgaaagcactgtttgcctcatgagttatgaaagaagacagattctccacctgatcaccatgatggctttgaaagtacttggagaactaaatattctacccaatacacaaaaggactcaggctcctgtgcatttgactgtgcatcctagcaccactaccacttcaaccccatcattttattcagctcatacatgtgtatatcctgatgtgattctcttccatgggctgtactgagtaaatccctccatgaaagtattaaaagtgaattctgctaatggctttcttttcttagatcatgtgaaatatccagagtgaagtcagtaaaactggtggagaattaaacgcaatttttaacatagaacacttgatcagtaatgagtataaccttatgtgtcaatactgttgtacaaattggaggtggatggcttagttcagagctaaccaccctaacactgatccatggcaccaaagagtaaactgttttcatatatgttattaacattcttggcagcaggaaattatgaaacgacccctcctttttcatttacattgccaagggaaatatagcaggctgcaggaacccagtacagttgtaaagagggctgtggcctggaatcctgatgccacacacatttcccttgcacatcccaggtcgtcttaagcaccacaagatgatgcccagcaagcccactcactcttgccaattcctgcccaggaatttgatggagatgccgagaatagcacacatgtcctttcttagattgtactcccactccccatcccccattcttagcagaagaaagcataaaacatcttttgacttgaatatttgcccatttcagaaagccacaccgtcaccatataaacttaaaaaaataaatcaaaacattgtgttcactgggttgacacccaatccatttcaagtgttctctaagcatgttttttaaaaccagtgtatcatccttgagagactttcttccaactgaccactgttcatgtaaattattttagcagtgcctttataacagtgttttcaaagcatcttacaagttcctaatttctatgaactttgccaccaaacaagtgaagaatgggaaatgggaaggaaaacttgttgacagctatttggaaatcagtaacagtgggaaagaggaatatgtcacataaaagtttgaaggacctagaatgaaatgagctatctggaaacttaccctggaggggtgaagattcccagaatgttaggcaagataaagattcagcttgtgtaattacacagatttgttctaaagtcttgtaaaggactgaaatatcaagtcttcccatttctactggcaaactagaaaaatgaaaccccctgcatacaggcccctccggatgcttgcctgaaaagaaaaccagctaagaaactctgga

SEQ ID NO: 479261 - DNA, 690 bp, Homo sapiens
cctccatcaaactccagcagacctgcagcagaggggcctaactgttagaaggaaaactaacaaacagaaagggatagcatcaacatcaacaaaaatggcgtccaaagaccacaaccgaaggtcaccaacatcaaagaccaaaggttgataaatccaggatgatggggaaaaaccagtgcaaaaaggctgaaaaatccaaaaaccagaacacctcgtctcctccaaaggatgacaactcctcgccagcaggggaacaaaactggatggagaatgagtttgatgaattgacagaagtaggcttcagaaggtgggtaataacaaactcctccgagctaaaggaattattaaagaagaaaagagagaagaatcaaatagatgcaataaaaaatgataaaagggatatcaccactgatcccacagacatacgaactaccctcagagaatactataaacacctctatgcgagtcatcgcatcaatgttcatcatcaaatgttttggtatcaggatgatgttggcctcatagaaaaccatcaagcttcagatggtgctctaaatggatccaaaaatgaaaccacccttttaccggggacctttaaattaatccgaggaggagcactcgctgctattccccacacaacacccctctccagcagaaagtagccagaggtacatgtgcacaatgtgcagg

SEQ ID NO: 479262 - DNA, 1082 bp, Homo sapiens
agaccaagcccaaaaggaagcccagaagagagaattgaagaagagcaaaaaacagcacaagatggttccagctccaccacaattaaatgagaaagtattaaaagacaagcgtaaaaagctgcgtgaaacctttggtattctacgactctatgaaaaagagaatccaaatatttacaaagaactgagaaagctagaagtagagtataaacagaagagggctcaacttagccaatattttgatgccgtcaagaatgctctgcatgtggaaatggagagtattcctttgtcagatatgccacatattccttccaacattttgatccaagacattccacttcccggtgcccatccaccctccatccttaagaaaacctcagcctatggacgtccaactcgggcagtttctatcctggctcttcttggacatggtgttccacgttcgccccatggcagaaaacctctttgccctctctctggcccacctccttctcaagtcgtgcagatgtacggccgtaaagtgtgtttcgccctagatcttcccccatgtaggcgagatgaagacatattttatagtcctgcacttgcccagagaggtcatgatgatgatgtttctagcaccagtgaagatgatggctatcctgaggacatggatcaagataagcatgatgaaagtactgatgacagtgacaccaacggatcagatggagaaagtgaggaggatgaatttgtgcaccatgatgatggtgagagagacaacaatgaagaaaagaagtcaggtcctagtatacaagcacctcccatgccaggaccaccacctcttggaccaccacctgctctaccattacggcctcctgggccacctacgggccttcctcctggtccacctccaggagctcctccattactgagaccatctgaaatgccaggactccaagggcctttaccccaacttttacctccaggaccaccatgaggcttgaccccctgtccctttcccaggtccaactgcaggtatgcctcctggtccccctccttggggacccccaccaagagtacctccaggtattccctcaccttgtccc

SEQ ID NO: 479263 - DNA, 2498 bp, Homo sapiens
ttttccaactctgcgccgtcgggtcgcggcaggatggttgcctcgcatttgcttgcctacttcttcaaggagctcaaccatgaccaagtgcagaaggttgaccagtatctctaccacatgcacctctctgatgagaccctcttggagatctctaagcggttccgcaaggagatagagaaagggcttggatccaccactcaccccactgcagcagtgaagatgctgcccacctttgtgaggtccacttcagatgggacagaacacggagagttcctggctctggaccttggagggaccaacttccgtatgctttgggtgaaactgtttgaccacattgtcgaatggctggctaacttcatggataagctacaaatcaaagacaagaagctcccattgggttttaccttctcgttcccctgccgccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgacgaccacaactgtgagattggtctcattgtgggcactggcagcaacgcctgctacatggaagagatgcgccacatcgagatggtagaaggcgacgaggggcagatgtgtatcaatatggagtggggggccttcggggacgatggctcgctcaatgacattcgcactgagtttgaccaggagattgacatgggctcactgaacctggggaagcaactgtttgagaaggtgatcagtgggatgtacatgggggagctgatgaggtttatcctggtgaagatggccaaggaggagctgctctttagggggaagctcagcccagagcttctcaacaccggtcactttgagaccaaagacatctcagacactgaaggggagaaggatggcatccggaaggcccgtgaggtcctgatgcggttgggcatggacccgactcaggaggactgcgtggccactcaccggatctgtcagatcgtgtccacacactccgccagcctgtgcacagccaccctggcccccgtgctgcagcgcatcaaggagaacaaaggtgaggagcagcttcgctctactattggggtcgacggttccgtctacaagaaacacccccattttgccaagcgtctacataagaccgtgtggcggctggtgcccgactgctatgtctgcttcctccgctccgaggatggcagtggcaaaggtgcagccatggtgacagcagtggcttaccggctggccgatcaacaccgtgcccgccagaagacactagagcctctgcagctgagccatgaccagctgttggaggtcaagaggaggatgaaggtagaaatggagcgaggtctgagcaaggagactcacgccagtgcccccgtcaagatgcttcccacctacgtgtgtgccacccctgacggcacagagaaaggggacttcttggccttggaccttggaggaacaaatttccgggtcctgctggtctgtattcggaatgggaagtggagtggagtggagatgcacaacaagatctatggcatcccgcaggaggtcatgcatggcaccggggacgagctctttgaccacattgtccagtgcatcgaggacttcctggagtacatgggcatgaagggctggacaaaaggcttcaaggaatctggctgcgagggtgaggacgtggtgaccctgctgaaggaagcgatccactggcgagaggagtttgacctggatgtgattgctgtggtgaacgacacagtcagaactatgatgacctgtggctttgaagaccctcactgtgaagttggcctcatcgatgacttccacacagaatttgatgtggctgtggatgagctttcactcaaccccggcaagcagaggttcgagaaaatgatcaatggaatgtacctgggtgagattattgagagtgactgcctggccctgctgcaacacttagggcttgagagcacctgtgacgacagcatcattgttaaggaggtgtgcaccgtggtggcccggcgggcagcccagctctgtggtgcaggcatggctgctgtggtggacaagatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggtggcgctcatcactgctgtgttctgccgcatccagattttcttggggcaacattccatgggatgttaagcaaaggaaaccaaaggaatcgtttcaaatggactcatggcttagaaatctttattcttagggcagtcagtagtattttaaagctttctgacaagataaaggaagtc

SEQ ID NO: 479264 - DNA, 882 bp, Homo sapiens
agatttcctcctgagagaaatgcagagctgcctccaactgcagtgttcatgtgggggcagggtagttgtgctgaagtctcaggtctaccctcagaaatgaatttcaagttatctggcttaagcaaggggcagggaaggaggatctttctcgctttctgatgtgggcatttagtgctataaatttccctctaaacactgctttagctgtgtcccagagattctggctgtcttctgcaagtctgctggagtttgctggaggtccactccaggtcatatttgcctgggtatcaccagtggaggctgcagaacagcaaagattgctgcttgcatcttcctctggaagcttcatcccagaggggcacctgcatgatgccagccagagttctcctgtattaagtgtctgtcgacctttgctgggacgtgtttcccagtcaggaggcatgggggtcagggacccacttgaggaggaagtctgtcccttagcagagcttgagtgctgtgctgggagatctgctgccctcttcagagctggcaggcaggaatgtttaagtgtgctgaagctgtgcccacagccgccccttcccccaggtgctctgtcccagggagatgggagttttatgtataagcccctgactggggctgctgcctttctttcagagatgccctgaccattgaggagggatctagagaggcagtctggccacagctgactggctgtgctgcagtgaattccacacagtgtgaactttccagcggctcccttaattctgtgacaggaaaaccactttctcaagcctaaataatggtgaacgcccctccccccaccaaactcgattgtcctaagttgacttcagaccgctgtgctggcagcaataatttcaa

SEQ ID NO: 479265 - DNA, 500 bp, Homo sapiens
atcaacccaggtacccatcaatgataacaattacgcacatgctagatctttttacttcagcttatggtgaatgctgccaagcctgggctcccttctggcccagggaagctccagaaatgctgtccaagagccaacacctggaactggggactccaaatgcttgcttggtactctaccccactgtggctgaactggtacctaagctacaagacaaagtccctttttactcatccttgttcatttctcaagcagaaatcatccctgctgccacagccactagagctgggaatgtgctaggtcacatctggagccagcatgtctctgagtctcactcaaagcccacacttgcaactcccactcgaatgcacagagcagcatgtggagattcacatcatgaacttttgcttcaagaactactgcaggaaaataccagaaaagccaagagaatccacagaccctttgaaggaactggatcactgctgcaggctccctgagatgcc

SEQ ID NO: 479266 - DNA, 1129 bp, Homo sapiens
ttagtgagaactgtttagagacttatgcaaaatgaatacctttgctatcctgattcactgcttttgaaagtcaaggagtttagtgactctatacataatacctttgatcatatgtggagaaataaggaatataatgaagttggtttgttgctcctaagttcgctggacaaagtgacaaaagaaaaggatgagctcagggattctaactcctggctctggaagcacatactgagcctcaagtcttctaagattgccctgaaggaaacagcctccccacccccagtggtgtcaacaaccagtcctccacccatgctgccttcagcctttccacctttgtctgaggagattaaccctgcattgcctgaggcaacagtgacgacctcccctgaacacattgccaggaaaaacaatgctgattctcttcaggacctaccctcaacacccctgttgcctcctagacctgtaactagactaaagtcccagcagacccctagaggagacctccaaaagtctgtgtatgctctgagtcagcgtccattatatggtactgtttctcccatagtcaggattcacgggtccaggaatcaaggggtggaagtggaagtggtaccttttacaatcacccctagtgacccactagtgaaatttttgcttccttttcctgcgacattaagttctgctggcctagggatcttagttccagaaagaggaatgctgccaccagaagacacaacaatgattccattaaactggaagttaagattgccacctggtaactttggggtcctcctacctctaagtcaacaggctaagaagggagttacagtgtttgttggggtgactgactgggactatcaagatgaaatcagtctactactccacaatagaggtaaggacggtatgtgtggaatacaggatcccttagggcatctcttagtattaccatgccctgtgattaaggtcaatgggaaactacaactcaatccagttagagccatgggcatcaggattgcaataaagcagagtcatgacagatgtgacaatgactaattgtagctgttgctggcaatgtggcaaagggattttctcattaaagacatgcatctttcctttctgccatgattgcaag

SEQ ID NO: 479267 - DNA, 1505 bp, Homo sapiens
tgaaatattcctatagaaggagaatctacacctcagccaaaagtgtgctttaaaggatgtggcttacgagctattaaactgttggaaaaatgggatattacatttgcttgtgccttcaaggttatctaagtgaccgtgatcagaatactgacagaaatatggacactaaagtcccttttgatgaggacttacatggaagggagaaatatcttattagaaactggaaggaaggccatacttgttacaaggtggcaaagaacttggctgaagtatccaccccaactgtggccaaagtgggcccatgtacagctcagtctgttgctctaaaaggcacaagccataaaccatggcagctcccatgtgttgctaaatctgaaggtgcacagagctgtggagacatggctactccacctgaatttcaaaggatgcctccaagagccttggggctcaggcagagaaatgctgcaaaagtcggaccatcacagagaatcttcagtggggcaatgcctagtggactcacagcttaggaaccatccccaagatctatagaactgtagatccactgattggtttttggtgctagcccttttgaatgctgcatgtatgctttcaagaaataacatgttctttagctatgtttctacttagaagaacaatgaaaacaaagacaaaaatacgcattctggttgatatttttcacaaataatatgtttacgttaggttgagccatgaaattttcccttcaatttctatttgtactcaatgaggaccaacttacaagcccatctatactatatttattttaattgattttctatgtcatctttttaaagacacaggtacttgaactttcaaaatcatattcaaaacttgcctgagtaggatgttatgaatgattatcctgttttacagctgaagagcctgagattcagagaaaataggtggttctttccaaattgctattcttgtgggcattagagctaaatgtgcgcttaatgttctgggtcaatttatttcaaactttaatatacataaggatcacctacaagtctgattaccatgcagatttggattcattagttctgaaatggggtctaaagctgtatttccgacatgctccctattggcaattatgctgctcgtctgaaagctgattaaaacctatcacttcaaattttcttcaggaacggttcatttaaaaggttagttttttaaggtcatacttttgctccaagaaaatgaggcagtaatggaatgcatcattttctttcttcatagagaaactgtgcagatgctcccttttaagcaggtcataattttatttggaaaataattgatctgttcagtaataaaaacagacttatggtatttcatgataaacaattactcagctacctcagcagcaacactctcagcccttcagttggactttctacatgaaaaaactattagctacttctggatgaagccaggtccattatagtgtcaaatactgtgttctaatt

SEQ ID NO: 479268 - DNA, 607 bp, Homo sapiens
ctgcatgtacagtggactgctagcacttgggagctgctagcatggctagaacaaagcaggcagaagatgagataaccttgcttgccgagttttttggcttccttctttttcctgtgctggatgctcctcctgcccttggatataagactccaggttctttggcctttggactctgggaattgcaccagtggctttccagggcttcttgggcctttggccacagactgaaggatgcactgtcagcttccctggttttgccacagaataaaagcggcactatgggcctccctcgttttgagggcttcagactcagactgagccactaccggcttctttcttccccagattgtgggactttgctggctaatcatagaaactgccaatatgacagcagtatccccatgagaacaggaaaaaacatccatttgcttcatgaccaatattatagtgatcctgtgggaactcctttttgaagttttaacaataatagctaattttatttgcactttcattttactaagcactttacatacattatttaatatttaaatagccttaggatgccatgtaaatcatccttcactggtctttttatttcttattttat

SEQ ID NO: 479269 - DNA, 595 bp, Homo sapiens
ggagtttgagctcacttcaaacagggaagtttcaagagtcatgggcagattcttcttcggtctaaagttctgctttcctgtactgcattacctgacctttttgactctgggggtaccagagaaacagcccaagatggacgacttcgatgattgtgtgacggatgaggagacagtaggcatggctgctaaattcaccactcatgcacccccagaagaatttaatgaagcattcaatgataaagaagcaagtgacccccagccagaagaagtagatggaggtctgaagtcttggagagaatcctgtcactgtgctttaagagcctatgtgaaagactattattccaacagcttctcccaaactgccaaggagtttattaaaatcatagagaatgcagaaaatgagtatcagacagcaattagtgaaaactatcaaacactgtcagataccacgttcaaggccttgtgccggcagcttccagttacctgcaccaaaatcgactggaacaagatagtcagctacaagattggcaaagatatgcagaatgcttaaaggctgaatgtaggattcttcagacatgagacttcacaacctgct

SEQ ID NO: 479270 - DNA, 704 bp, Homo sapiens
ctcctcacgtggctttttttctgattagtttaatcttgaagtaaaagatgggacagaagacaaagtatagaggaagaaaagtgggcccagaggaccggcgcttagcatacggaggacccgcaccggcaccagtctctgagttccctcagttatgggtggggccacaaagctcccaacactttctgtcttttgtgttaaattaccggggtaagtggagaggcagagtcagatccgggctgagtcaggtaggtcagtgctctggctctccacatgcggagccatcttcagcccctgtagggtatgaggggtggttctcaggctactggggtaatattccagagggcactgtaaatgcctatgctgcacagaagagtttgcacagggagtgtggattagcaggaggcagtaagcctcacctagatcccatgcacctggcaaggcagatctcactcccgcagtgcttcgctagcagcagcaagctaagttccagttccatttgatctagagtgttatttaagtctgctgtttccttattgatcatatgtctccatattatgtctttttgaaaatgggatattgatgtcttctgctattattctattgctgcattttaaagtaacttccatcttgcttgaaattcttgctttgttcatacatggttctcttgatccaagtaaacatacttatgaaagttatttttaaat

SEQ ID NO: 479271 - DNA, 1949 bp, Homo sapiens
ggacacagtactacaattggtatgaagtttcagttatgcaagatgagggctgccccactggagctctttactggtcagccacaatccaccaatgtagaagctatggtgcagacaaccagggcaactgcaactaccctgcatgcaggcatggccaggtctgacagttcccctagagctaaagtctcctatggcagcaagttgagcctagggggatggctgtatctggccatgctctgctatcgatgttccagcaccaaaccctctgggctccacatcagctggcttgctgcccctaccacttctctaagcagctctccttgccaacctgtatgtctgtggtggtcaaggagtcatcccttgattgggctccagatgcctgtggcaacggcaatttgctccctgccagatcaactcacccattccccaggagctgttgagggccaggaatgattcctggtgtctggtagacccatgcagggttctcagctttctctactttcagccaagcttctgtgtctttcctctgtccaatctcagtgccttccctttgaagatttgttaggagcataccagtggtctctgtctcttggcttaaagtctgtgttgatgttaaatgctggttgacttttcctgaattccaaaagggaggagggcataatgaggcatgtccaaccctcacttccagtcatggcctgaaccagttttttaggttaactctgaaatgccacttgactgaaaagaaggactgaaccaatggttatcttacgtatgctgatcaatgtctcatgtctccctaaaatgtataaaaccaagctgtgctgggaccaccctgcgcacatgtcatcaggatctcttgaggctatgtcatgcgcacacatccttaactttggcaaaataaaatttctaaatttactgagacctgtttcagatattcagggttcacaaacctaaatagagttgtaaacagactgtagcctactcttgtgccaatcactgacttttgggcagtcaaagatgtgttcatgctgactccaggcatacaaaatgctttcttggctctgtcccttattggactccacctatttccctgaattcagtaattttagctaagaagtactaactaagttaaaaagaacaccctattgaactaaaatacacctttctaaaatttaattggctatctttaaactcttttgtaaaagaaatttatatctataatagaaatttccatttttaaggatgtctgcctatatatagtaaaattcttaccattattttaaatttatataaaatttaaaatgttagagatattaagttaaattaagtaatgaataatcgtaaaatgtctaagtcatctgtaagttaaaataccaaaatattaattattaaacatgggtttaagactgtgtaccttgacatggtagttttatacggtaaagaaaagctaaatatatttaaatatgttaataaataataatttgaaaaagtatccttccaaaaattataaaattatatttatttacaaatactgatataaaagagtccaaaattacttctagggttttcactagaagttagggttactaaaagtttaaaaaaaaaaaaacactagatatgggagaaacaattctgtatacagagtttttaagcaaaagcaaaacatgcatctgatgaggaaagttataaaggcataaaaatgtatgttaaatatatttttttctaggttgaagttacataaagatttcaaattgaaggagaaaaaatagataaaacaagatgaatgtaaaagttggggaaaatcatgtctttaaggacattcatgaaaggatgaaaagaaccctaagaagcactcttgaataaagctttctgataactttagaatcatatcatttggactgggtaaggattcccagaactttaataaatagactggtttataaaactgctag

SEQ ID NO: 479272 - DNA, 1424 bp, Homo sapiens
gttggctttgtttacactgtgaggggaaaactgcctactcaagcctcagtaatggcggatgcccctcccccccaccaagcttgagcatcccaggttgacttcagactgctgtgctggcagcgagaatttcaagccagtggatcttagcttgctgtgctccataggggtgggattcactgaactagatcacttggttctttggcttcagccccctttccagggtagtgaacagactgtctcgctggaattccaggcaccactgaggtatgaaaaaaaactcctgctgctagctgggtgcctgcccaaatggctgcccagttttgtgcttgaaacccagggcgctggtggtgtaggcacccaagggaatctcctggatgttttctacaaccaagtcagagtgatcatattttattttttaactatagctaaaacaccacaatcagacataacttgttataagccttagtttggaagtggtttatttcacctttgctcatgttgctttgccaacatgtggggagtatgaggattacacttagagatgagatttgggtggaggcacagatccaaaccatgtaaacctttttactcaattttacacatcatttgctgtaattacactgattccttcattaaattgatattttccaatatcaccagacagtctgaaggactcaaaattattttatgttaactgagtttttcaaactaagtcatgggtgaattttatagtgtaaactgctgctattttaacctgcttaataaatgttatgtctgttaaaattttgatttttttgaaactggagctttcattatcactttgattaaaaagtttaaaactgttttttctcccaaaacctctctagtaaaaaacaatcaaaaagtcaaaccctaaatcaagaaaggtaaattttcacaggtgaatgataggggcactttataaatggaaatattaataagaatgtcctcagcattctagaattgtgtcaaaaggcaacatactgataatacctttatgttattgcaagcttcatcttttaatattagttgtaaatttaaattttcctgaatatattgttataaatactcattgagatatttcttctatgcaatctacccaatattggttaaaaacaaaaattttaattgcaaaatcactgaaaaccaatatcagtaatataagtaacttgtacatagagataaatgctatatttatcttgcttttcaaaatccatcaactgttttctctttattataattgcatttgtttatctgtcttttagtaaagtactatctgcatttagtaagttgtaacttgtaaagtatttttagtgttttacaagataatcttagtttagattgttggtgagctggttctagaaaaaataaatccagaaagcaacttatattacaaatgaaatgtc

SEQ ID NO: 479273 - DNA, 1135 bp, Homo sapiens
aagatattttctgaaataagggactgctcactaagggaggggtccatagggggttgttctagattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctgaagaggacctgggagaagcttctgctgacagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttagtgaccccagggctgaccaccagcctctcacggaggcatcttatgttaacctacctaccattgctctgtgtaacacagattctcctctgcactatgtggacattgccatcccatgcaacaacaagggaactcactcagtgggtttgatgtggtggatgctggctcgggaagttctgcgcatgcgtggcaccatttcccgtgaacacccatgggaggtcatgcctgatctctacttctacagagatcctgaagagattgaaaaagaagagcaggctgctgctgaaaaggcaatgaccagggaggaacttcagggtgaatggactgctccagctcctgagttcactgctactcagcctgaggttgcagactggtctgaaggtgtacaggtgccctctgtgcctattcagcagttccctactgaagactggagcactcagcgtgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaataaaataaaataaaattacttcttggtttatacatattaattgccatcatttagcattgttttccttttctgtttacttcac

SEQ ID NO: 479274 - DNA, 644 bp, Homo sapiens
tgtgtacccctgaatttaaaaaaaaatcatttgaccatgtagatgcaccttacatgtttctcttgtctaattgttatagctgtgacttccagtactatgtggaataacagtggtgacagtgggtatcccttttatgtgccagatcttagaggaaaggctttcattttttctctatttagtatgatactagctgtgggtctgtcctatatggctgatatgatttggctgtgtccctacccaaatctcatcttgaattttaatccccataattcccctattccccacgtgtcattgggaggaacccagtgggaagtgactggatcacgggggccatttcccgcatgctcttctcgtgatagtgagcgagttcttatgagatctgatggttttataagcctctggcatttcccctgctcacatttactctctcttctgccaccttgtaaagaagctgcctgcttctgcttcgccttctgccattattgtaagtttccagaggcctctccggccatacagaactatgtaggcacttacagctataaaattccttcttagtagttctttggctgtattgcataggttttgttctgtgaagatcattggtagcttgatggggatggcattgaatctataaattaccctgg

SEQ ID NO: 479275 - DNA, 1120 bp, Homo sapiens
agatcaattattaatttgtgcagggtctgttggtaaaagagctataatgatagctgcaggtaagttcctcaacttagcagctgaggctgtgctgcaagcaggtgcagccaggcagggaccctgtgatagagctacagactggggagtactcagatcaggcagtccccatcgcatggaggtccatggcaagagtgggctgctccatgcctatttactcaccccttccccaggagctgctcagggccaagaatgggtcctggggcttggcagctccatgaagggtttccagcttcctccttttttagcccaggatctgtgtcctccctccatccactatcaacgccttctctttgatgatctgtttggagtggaccaggtgcacctgaattccagtaatgctgtggtccttgcagactcggaacaataccaccttgatgatcttggacagtatttgagtaaagtgtttgtgatggttaatattgagtgtcaacttgacaggattgaaggatgcaaagtattgttcctggcttttggacccttggacttacactggtggttttccaaaggctctcatgtcttcagccacagactgaaggctgcaccagatagagctgaaattgtgaaaaatcagacacaaactcctatgatgcaagtggctgacctgcaaggaaatgtgtatgcacagccttgcccgttgtctactgttaaagtaagggcattgattggaaaagaatgggaccctgcaacttggaatggggacatgtggaaggaccctgatgagactgggggcattgagctcctaaattctgatgagccctttttgccagaggaaatagccaccccacttccagaggtggcagcttcccctcccccacccatgctgccatcagcctttccacctttgtctgaggaggttagccattcactgcctgaggcaacagtggtggcctcccctgagtcagtggccaggcaagacaatgctgattctcctcgggactcaccctcaatacctcgtttgcttctagacctataacaagactcaagtcccagcaggaccctacaggtgaggttcagagtgtgacccatgaggagatcttacagtgggaaccacaatcactca

SEQ ID NO: 479276 - DNA, 616 bp, Homo sapiens
tgcccaggattgcaaaggatgggcagctcacctgtgttgctcctctctgctctccacgagtcatgttgcttccttgatgaatcccagtgtatcctcctggatgacccagatgaagagctagtatttacttgccactctatctcctctgtgaacaccaaatttaacaactatctacaccaaaaaaggcaccttcgtaagaaccaaaaaccaggcccagtcccaaggcgcaaggccacttgcaccggcagcgtgcatcagcaagataacagaagcaagaagagagctggccggaagacacctaccctggccggaagacacataccccggaagatggagaaagaggctgtttgggattcaaaccaatataagaaccttacagatggcatctctgaactgaccctgggacaaaggagatctcacttccctgagggatcacaacacttaagtccctttgaatacctggaaaacattcccaacaaggatgtatctaaacaagcccacactgacaagactacaataagtacctaactcttcagtgcccagacactgaggaacatccacaagcatcaagaccatccaggaaaacacgacctcaccaaatgaaataaataataca

SEQ ID NO: 479277 - DNA, 571 bp, Homo sapiens
tgcccaggattgcaaaggatgggcagctcacctgtgttgctcctctctgctctccacgagtcatgttgcttccttgatgaatcccagtgtatcctcctggatgacccagatgaagagctagtatttacttgccactctatctcctctgtgaacaccaaatttaacaactatctacaccaaaaaaggcaccttcgtaagaaccaaaaaccaggcccagtcccaaggcgcaaggccacttgcaccggcagcgtgcatcagcaagataacagaagcaagaagagagctggccggaagacacctaccctggccggaagacacataccccggaagatggagaaagaggctgtttgggattcaaaccaatataagaaccttacagatggcatctctgaactgaccctgggacaaaggagatctcacttccctgaggggtttccaactacagaacctgagtccttaacaacatatctagatctgcctgagaaacagggtaactaaccaccctgaagacaaggacataagactggctgactttgccaccttctgattgtagaggcttagggccttgagc

SEQ ID NO: 479278 - DNA, 1239 bp, Homo sapiens
acagtgttcgtgggggtgactgacttggactatcaagatgaaatcaatctactacttcacaacagagtcatgtttcttccaagtccctgaccacccagccaaaccattggctaccgcctatgaatcagtatataatctcaaatcctgcaatttttccttcaatgtaaagtgcagtactcgcagttcttcccactgggaagatttctcttcactgctgtctttcagggatgtcctagaaagcggctatagtgctgcagctgtccactttcgggtgatgcctgaatatcacagtggtggaaaggctgatggcagcgtgggtcgtggaggggatgtcgccactaatggagatggggaaattgtttcttctggcacaaaaaggttcatcagagtttacaaactcagtgtccccagcttcatcaaggtctttccacatgtccccattccaagttgcagggtccagtttttttccaatcaatgccctcactttaacagtagacacctggtgaggctgtgcttgcacctttcattgcagtgatagtttcaggatacatacatatggcaaaatttattaaagtttatgcttcaaatatgtgcagttttctattatgcctgaagaaagctgtttaaaattttaataataaaaataacactttaaattaaatcaaaatattgcctgaaaaaatgatcttagtctatgaaccattagtttcttctaaatgtttttcaggctatgtaaaggaatagatatatgatatataatgttttgttactgagtatacaggtatcttcaagagaaacattgtttagagcggacatatcactttcatattttatttatttatttttcttttattattatactttaagttttagggtacatgtgcacaatgtgcacgttagttacatatgtatacatgtgccatgctggtgtgctgcaccaattaactcgtcatttagcattaggtatatctcctaatgctatccctccccctcccccaccccacaacagtccacagagtgtgatgttccccttcctgtgtccatgtgttctcattgttcaattcccatctatgaattatttgcctttttattcttgtaatattttgaaagacaatcataacatattaaaattctattggagtttaataaaaaatattcccaaacactttgaaattatatttagattattaatatagataatggcagtatagcaacttatgagtttatttttccttttag

SEQ ID NO: 479279 - DNA, 797 bp, Homo sapiens
tttctcaaagttggaaattataatggaaacagagtgtaaaagtttggaaaatttgcagcctggcattgtgatagagaaacaaagagcattttcagtagaggaattaaaatgggcagtggagcaaccacttgctagagatatttgcatgactaaaagggatccaagtgctaatattcaagacaatagtataaagacctcaaagacatctcagagatctttgaggcagaccctcctgtcaaaggcccaaaggaccaaggacaaaagaatggttttgtgggcaaggttcaaagccccactgccctgtgccgacttggagcactgctccatgcatccctgctgctccagttccagccatggctcagagggcctaggtataactcaagccgctgccttgcagagctcaagccataagccttggcagcttccatgtggtatttatcctgcaggtgcacagaatgaaaaagtgaaggaggcttggcaccttcaacctagatttcagagaacatgtaggaaagcctcagggccaggcagaaacctgtcatagaggcaaagcctcaacagagagaatttactagagcagtgccaaagggaaatgtggggttgaaatccttacacagatttccttgtggttttgtcatacaatcttaaggatttcttttctatgtctgtgaaaaatgctatagtaattttgatagaaattatgttgacattgtagattacttaggttgttttgctttgaatgtgtcctcaaagttcaggtgtttgaaatttaatccccaatgcaacagtgttgagag

SEQ ID NO: 479280 - DNA, 577 bp, Homo sapiens
tttaaaccattttgagtagatttttatatatgatcccagaatgattgatccaccgacagcttgcactgtgtgcctggaaaagacacagacactcaacaccacctgtaaaagcagctgggaggggactgtaccctgcaaagccacaagggcagagctgcccaaggctatggaagcccacctatggcatcagcatgacctggttggcagggattcccacagtcccaaggtggttccagaggtgccaagaactagagtcaaaaacattaaaatctacctggtgttctattgtactattcctgagctggcactcaggccagatgatgcagtccttctcactcttccctctcctttccaaagaaagaggagccttaccccatggctactgccacagcaggtccccaaggagccaagtgctctgcagtcagcttgtgatgaatactgcctggcttatgactcaacttctgggcagtggactcccctctggccctaagcaggtcttaaaatgtccaagggccatgatctggaatcagaaaacccacatgatcgcttggtgttctacctctctgtggcaaagttc

SEQ ID NO: 479281 - DNA, 537 bp, Homo sapiens
aaagtcatagggtgggatgcttcctgccctcgaacattggactccaagttcttcagttttgggactcggactggctttccttgctgctcagcttgggaccttggaattttcagtagacaaagtgataaaagaaaatgatgaactcagggatgctgtctcccgacttcagaagcagacactgagcctcaaatctgctaagattgccctgagtgagaatagagaaagagctgaaattgcggtaaaacagacacaaactattatcatgcaagtggctgacctgcaacgaaacgtgcatgcacagaatcaccaggtgtctactgttaaagtgaaggcattgattggaaaagaatgggaccctgcaacttggaaaggggacatacctataactggacaaaagtcccggcgagcccctagatgtgaggttgagagtgtgacccatgattcataaagcaagtttttagagacctacaaagagactaagactcccacacaataatagagggagtctttaacaccccactgtcaatattagacaga

SEQ ID NO: 479282 - DNA, 570 bp, Homo sapiens
ggcattgattggaatggggacatgtgggaggaccctgatgaagctggggacactgagtttgtaaactccgatgaaccttttttgtcagaagaaacagcttctccatccccagtagtggcaacatcctttcccagacccatgctgcgatcagcctttccacctttgtctgagaagataaaccctgcattgcctgaggcaacagtgatggcctcccctgaggcagttgccaggcaagataacgttgattctcctcaggacacacccccaacaaccctgtttgcttctagatctataactagacaaaagttccagcaggcccctgtagaggaaaatattcaaatgcttagagagattggtaaggtggaatggattcatcacttcagatctactcaccccagctgtgagggtccagaagatatacccttgaccaatgccttgtgaaatagatttgtgaggacagcacctgcatcttggaagagccctgtaattcttccctttatgttcttctctactcatagaagtactgtcttgatggtcttggacaagatccagacaaattatctggaggat

SEQ ID NO: 479283 - DNA, 627 bp, Homo sapiens
ggggcactgcctagtgaagctatgagaaaggggctacgggctctgagaccccagaatggtagatcccctggcagtttacaacttcagtatggaaaagccacagatgcacaacaacctgagcggatcccagagagtccttctcctgctccttctctagaagagaatcatcgtcctgggagccagacctcttcccacaccagcagcagtgtgtccagctctccctctcagatggatcatcatttggaaagaatggtaagcttctctcctttcttctccaagccaagatgtacccagaactctttcatcagaactgtttttgagcataatatcacagagaaagaaatgtccccaatatcaaatgatatttgcattttccctagaaagcatcaaggaaggagggtacctaccagaaatgcaggttggtaggtggtctgagaatgtatttgcataattaattagtgtgtatgcttttagacatttctactcaggtactattaaccaaattatagagtgacacgctgatgtcaacacttaatttagaccttttctgttatttgccactgtgtatattctctttggcaaatttatatctcagcatatctcagttggtctaggctacccttcatt

SEQ ID NO: 479284 - DNA, 670 bp, Homo sapiens
caccacttccctgggcaaggctccatgttgctcccagacttggtgccctgcatctcagctatgactaaaagtgaccaacatacagctcaggctgttgcttcagaagatgcaagccccaagcctttgtggcttccacatgatgttaagcctctgggtgcccagaagtcaagaactgaggtttgggaacctccacctagatttcagaggatgtacagaagctcctggatgtctagacagaagcttgctgcaggggcagggctctcatggagaacatgtactactagggcagtgcagaagggaaatggggggtgggatcccccacacagagtccccaccagtgcactgcccagtggaacactgagcagagagccactgtcctccagtctccagaatagtagttccactgacagcttgcaccatgtgcctggaaaagccacagacactcaacaccagcccatgaaagtagccaggagtggggctataccctctagactacttgaagaacttcctgagtgatctctctgcctctaactctttgcctttccagtctatgttatattctcttaatagtgacattcttgtaaagaggagtatcttcacattgctcacctacaaaaaagtgttttgtggtttgatacttcctgtagaataaagttcaaaacttttaata

SEQ ID NO: 479285 - DNA, 1994 bp, Homo sapiens
gcctccacctgaatctatgtcatggcaaagaacatgattttattcttttttatggctgtgcagtattccatggtgtacaggcacattaacatcagatccctgtgtatgcacagcccaggattgatttcaggatgtcatagccacttttattggctcattgtcctcactgcctccttttttcctaagctctcctgtaccttccagttctttgggtgtcctcttttcagtcttttggccggatgcttgagacttagttaccccactatatcgtgcacttccactcctgtgtgtgcattcaagttcaagtggtgggaagtcagagagcaaaaacaaaacaaaacaaaaaatcaatgtgcttggccccactttctttatgccatagctcctgtggtcagagagggagattcctgtgctcctgtttctacgctagagattacatggaatctaggacataggcaatagacaaggaaagtgaacaccctttgaacagtaggcattcacttttctgctccctgaaccaaaattaaagggggctttctatattcctctctgtaccccagtgcctattcatggtattcggaatgcacttttgaaagtcgtattaatggaaattcatataccccaaacagtttttattcctgaaaattgaggaaattattagatattacagaaaattttccaaagtttctattggggcagatactggttttaaaaaattcaaatattaataaaacaaatatagaaactttcagaattctgtaggaagctgttaaataaaaagtatacttagttacagtaaagaaaaatgctgtcctgatttcaacttttatccattcaataagcatttattgcatactaataattgtaaaaatattgttctagtcaagcattgtacactgaaatagcttttgttgatggaaatgatggccaatgtagtggctaatatggtaaccactagccacaagtggttattaagcacttgaaatgtggcaagtgaaaatgataaactagctaaagactatgatattgtacagtacagttctagacatttttgaaaacacaaatataactgctaatgaggtagtagttatctattgcacattgtattaatattttatgtttgtttatctcattcattataaccatttgatcattatatgtttatagcagaagaaactgtggtctagagaggtaaagtaactttttcaaagtcacaaagttatgaaacagcaaaatttggcttcacagccatgtacgtattatttgagggtcttttattggaaactgcactatttattgacagggatactgcagtacaatttacatacatgaaaattcactatttagagtataccattctatagttattgataaatgaattcagctgtgtaatcatcaccacaaaaataaacataaagaatatttccatcaatcaaaaaagttaattcctgcccctttgtaaatgcttacactcatgaccagcaactactgatctgttttgctatctctataattttgcccattcaagaatgcaatattaacagagatttatgttataaatagcttctttgagtctggattctttataatcatcagtgttgtagcctttgttagtagttggtttctttttatttctgtgtaatgttctgttgtgtggatatagcaccatttgtttactcgccaataagaagatatttttgttgcttatggtttctgccaattgcaaatataccttctataaacatctgtgtacagatatttgtgtgaatatcattgtaagttgtggatgaataccttgagtacgactattgggttatgtgagacagtcactctattgtgttttaatgttccaatagtgtgtgagtaaataagattctctgacatatgtgatagaagactggttaaatgggacaatcatttttgtgtaagagacaagaatcaaaaggaagcattcttcacaagctattaactgaaaaaaaatcccctcaggtcag

SEQ ID NO: 479286 - DNA, 675 bp, Homo sapiens
aaggtttaggtcaccccaccaggaaaaaaaccacaacctgctgaggtgcttgctgaaggcaacaggaatacggaatgggtagtagaagaagtgaacgtatagatgataagaaagcaaaacaggcttttgctgatgtgaagaaagtttgtgtggtctggctagatcaaatcagccacaacattcccttaagccaaagcctaaaccagagcaaagccctacctctcttcaattctatgaaggctgagagaggagtcacctccaatggttcctccaaaacttgctcttctgacttaggggaactactctccacagacctgcctgatttgattgctaagagggctgaggtggaggggaagacagtgggggtgcccccaccgacggttctccctccttggtccctgggtcctagcaccataattgccaccctgtggttgcagatgaccattaatctgaaagtacaagttgaagtggacaagtccaaacataggcaaaaagtgcccttgaagacttaaatcaaataaacctgacaatcctttatgtactactcttttccccatactgattaaagaacaatagatatttgagggaaagtaatgagataggagaatttgtaagattaatttggtcaaaatgtttgatctttcataattattttacaattaaacttgaatgatt

SEQ ID NO: 479287 - DNA, 1269 bp, Homo sapiens
acatctgcttttaaaggtttttggggaacaggtggtatttggttacatgatgttccatcgtatatatgtataccacattgtctttatccactcgttgattgatgggcatttgggctggttccatatttttgcagttgcgaattgtgctgctataaacatgcgtgtacaagtatctttttcgtataatgacttattttcctctggatgggtacccagtagtggaattgctgggtcaaatggtagttctacttttagttctttaaggaatcttcgcactgttctccataatgattttactagtttacattcccatcagcagcatagaagtgtttccttttcactgcgtccatgccaatatctatttattatttatttttttattgtggccactcttgcaggagtaaggtggtatcacattgtggttttgatttgcatttccctgataattagtgacgttgaccatttttttcacatgtttgttggccatttgtatatcttcttttgagaactgtctatgcatacccttagccctctttttgatgtgattgatttttttttcttgctaatttgtttgagttccttgtaaattctggatattagtcctttgctggacgtatagattgtgaagattttctcccactctctgagttgtctgtttattctgctgactgcttcttttgctatgcagaagctccttagtctaattaagtcccatatatttatctttgtttttgttgcatttgcttttgagttcttgaccatgaagtctttgcctgagacagtgtctaaaatggtttttctgattttatcttctataatttttataggcttaggtcttaaatttaagttcttgatcgatcttgagttggtttttgtaataaagaatcgagtattgatttcctcaccatcatacaattctttttaaattttttaaatcagaaagttgttcattttttaagcttggctttgcagattgttcactgttggcatatactcagttggtgcaaacgtaattatggtttttgcattgttggaatttgccatttgatattggaatacattcttaaataaatgtggttatgttatacatcattttaatgggcatttcttgctttattttttttgctaatgacttattacttgctgtttattttaagtttattttagactatggaaatgatgttagacaaaaaacaaattcaagcgattttcttattccagttaaaaatgggttgtaaggcagcagagacaactcgcaacatcaacaac

SEQ ID NO: 479288 - DNA, 675 bp, Homo sapiens
gggcacacttggagaaatatactttatagaaaggcagggcaggctggctctgtgcccatcaaggctccatttgcaatggcagttggtgagggaaatggaggtggactccactcctgctgtggcagtggaagggcagagtgcatgcacacactattctggctggcaggcaaggaaaccaaaacccgcctgtacacgcacatgctggcaaaaagatgtgcaggcttgctgtgggcccaggggaagctgcagtgtggggaaggagcaggaggactggtgcatggccatggaggccccagtgctggagctctccaccagtcaggcatgatctgcaacacagaagcccagcttccatgtcttccctctgtccgttctcagtgccctccttctgaagatctgttagtgcgccagttgtctcattcccttggtggcagctgtttcaactggctgcatctagtcggccatcttgcccccaatatccagttcaaatttatctaattagctatatcttgaagggagaatacattttaatgtttcaataccagaaagacattaaaatgagtattttctattttaatatcttgtttattactaatcagctacaacttatataatatttttacagtcaatttttgtaccatagcctaagaaaaggtattatttatattattttggttt

SEQ ID NO: 479289 - DNA, 807 bp, Homo sapiens
cagtgaccagggctgagaactagcaccagaccatgagcttccccattgagaaagcaagcagactcacagttttttgccatctcatggagcttgcagtggtgattcagttccttcaaagggtctgtggattctcttggctttcctggtatatttctgtgaccgttcttggagcaaaaattcacagtgtggtacccctacaagtgcagtggcatcagggttgtgggttaactctgggattttctcctcggagaaatactgggatgcctctgattgaagtagtcaggtgggggcagggtggttgtgctggagtcccaggttgggcagctctggccagtgaggaaaatcgaggactggggcctgcatggagaaaagcccagcgacttttccttgaggttggtgcttggtgctgggagtccagaccagcccctggtccctgcagactctccagagcctggagacagcaagggcaagggctgcgggacagcaaatatggcaacccacgccttccactgggacctctgacccagggacttgcagagctgctactggatcagccctggtgggagactgctggagatccaggagaagtcatttgcgagaaacttacagttttagggatccagatttggaaggaatgagcccatgagtgtacctacgaagccgttatctttttttttcaatgcactaaactgagacaatgactctggcacattaacagacttaccatggcttttccccaacattttaaatgaccaacacggagaactgtacaatcagtgtttatttgtcatactttgtcatgagaaa

SEQ ID NO: 479290 - DNA, 535 bp, Homo sapiens
ccagcagatcaaggggtactcaggtgggaccgacctcacaagatggccctgaagagttcaggcgtaacaattcccctaaagctaaaggagcaaatagagcctagggagatgggctttcctggccttacaccactacagatgctcccacacaaaaccctctgggctccacctcaactggcatgctgcccctaccacttctctaagcacctctccctgccaactcaagtgttcatggtggttgaggggtctcctactgctgaaattccagaggcccatggcaagattggattgctccttgccagttcaactcacccattcccaggggtcactgggggccagaaacaagtcctgacacaaagttttagaaataagatgatttgtctgtgggattcgctattttgcatgtttacaataatagaaaaataaatgtgattcaatagcattcattctcatgtgaatttcagttcatcatacttcaaattaatgagagccatctatgacaaacccacaacaatcatcatactgaataggcaaa

SEQ ID NO: 479291 - DNA, 548 bp, Homo sapiens
cagtaagctgcagacatcatgctccttatactcagcaggatatatactcagcatgtatctcctgagggactgaatatacaaacaggcaatggccagaccatatataacaatagaatcctgacctacaacctctacagcaataagcatgggaagccaaaccacaacctcagtagcaatcagcccagatggccaaacgacttggaaaagaaaactacatgggtgatgtgtccctctcgagagcagtccttcgttatagagaaagctctgagtgtgtttcaaaatggcaacttgaaccctcttaccctcctgccctcctcttgccagaaacgtgaggggattgtctttagatcttcatctgaggaccttcttggctttctggagcaagcttccactgattcaatttcttcttttatttgttcactatattagtctgttttcatgctgctgataaagacatacctgagactgggtaatttataaagaaaaagaggtttcatgaactcacagttccatgtggctggggaggctttacaatcatggtggaaagc

SEQ ID NO: 479292 - DNA, 1552 bp, Homo sapiens
cacactctgtgcagagactgggcggccagcctgcccttgctgtcgctgacggtgactgcgggaggccaggttgtttttcatcattcagaacattgcctgaagcaggtccaccgtgccgttagtaacgaggaacatcgagccaaggcacctgtgccgtcagacgttgcctagcgttagaagcgagctggaatgcgtgaccaacatcaccctggcaaatgtcatccgacagctgggcagcctgactcccttgctgagagggtcgatggactacaagttaaagtcactcagctggatcccaaggaagaagaagtgtcactgcaagtaatcaacacccgaaaagccttcagaagctccaccattcaagaccagaagctttttgacagaaactctctcccagtgcctgtcttagaaacatacaatacctgtgatactcctccccctctcaacaatcttaccccttacagggacgatggaacagaggcactcaaattctacacagacccttcatacttctttgatctttggaagaagaagatgctgcaggacaccagggatatcatgaaagagaagagaaagcacaggaaagaaaagaaagataatccaaatcgagggaatgtaaacccacgtaaaatcaagacacgtaaggaagagtgggagaaaattaagatggggcaagaatttgtggagtccaaagaaaagctggggccttttgggtatccacccaccttggtgtaccagaatggcagcattggctgtgttgaaaacgtggatgcaagtagctatccaccaccatcacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaagctctaaacccgggtttgctccaccacctgcccctccaccacccccgcctccaatgataggcatcccacctccaccaccgcctataggatttgggtctccagggacgcctccaccaccctcaagcccatctttcccacctcaccctgattttgctgcccctccacctcttcctccaccaccggcagctgactacccaactctcccaccacctcccttgtcccagccaacaagaggagcacctcctcctccccctcctcctcctccggggccccctcctccccctttcactggtgcagatggccagcctgctgtaccaccaccgctttctgacaccaccaagcccaagtcctccttgcctgccataagcgatgcccatagcgacctgctttcagccatctgtcaaggttttcagctgcgcagggttgaggagcagcaggaacaagagaagtgggatgtcgtgggcaatgacgtggccaccatcttgtctcgtcgcattgctgttgagtacagtgactcagaagatgactcctctgaatttgatggggacgactggtctaattaactctttctgcctg

SEQ ID NO: 479293 - DNA, 644 bp, Homo sapiens
ttaatttgcatgtcacataagcgatgcataatagtttcatttgcgcatgtcccaaatattgtccgggacatgcttttttgtctcggggagggtcgaggcataatcccaaggtgctgcggggtccccgtgagaatgaaatgctggccctggcagcctctaagcctcatgcccacagcagcagcagcatcccctccatgtgtcttccccacgcaggagaggcaccaaccgcggggatgcccttgggggaagccaaggaacagacctgcagaaatagttcagcagaggccccaggacaaagctcaggggctgagaattccacaagtcagagctttcaccgaaacttgcatgtgacttgtgaaatgcaaacattccagggagaactgggagtgacccgcaccctgtggcttctttcctggaacacttcagcacctgagtgtctcccagcccaagtacagaggtggtggccctggatgtggcccagacagaccagtgccagccccagtgccacgctctgaaccacccagcgtgccaggcagctcttgcagtctcaggctgctgtgtagcagtgacacctccagcgaagtggcaccacttattgccagctccctggacccaagccctccctggttgcctgccctggtggg

SEQ ID NO: 479294 - DNA, 801 bp, Homo sapiens
gcagcagtagcagcagcagcagcagcaacgacccacacctccgcttcgcaatgactacgtgcaggtattttacatacatgatcttctttaaggagacaatcatactgacagaagccttatggggtagagtaagagtgtctgcagtcggacccaggatgctggttggagcaatgtgggttatgatgacccagagagacaaatctagtcagaggccacctgagactccactggaaagaccaaatacaaacatgtgttccaaaggccggagacaagatcaatatttttttgcaaagctaagagttaacacacagagggagaccaaactcagacaaaaaaacaggacagggacaaatgagaaggatccaggaccatcatcctggttggactcaggcatctgcttgtataaaggcagtacagtggttaagagcatggactctggcaccggaccgcttacattcaaattctggctcatccgcttcccagctgtgtgaccttgggcaacttacttaagtgctgccttcctcagtttacccatctacaaaatggggaatactaatcacacttacctcttgggcttgttgagagaattgagtggtttaacacatgtgaaggatttagaatggtgcctggcacaccaggccaccactgtcctcattcccaagaatgtttgtacttttaactatatatgtatatttccataaataatatctagaactgtatgctttaaaattttatgcagatatcatattgctatggtttgaatgttccttccaaagctcatgttgaaacttaatccctaac

SEQ ID NO: 479295 - DNA, 724 bp, Homo sapiens
gttccttctaaaggaaattctgtgaggagggagacatgagggagtgtagaggcaatgtgagaagagtggaggaagaactggggacattggaggtcctggttcttgggcctttgggctccagaccctgggacttatgccagtggcaccccagttctcaggcccttggactgagactggtggacactcctgggcgtcgcggcaaggctcctatttatgatcagtcacagtcagaggaagaattcaatgggaaggagtgtttccatcatgattggtactggttagatagggagcagatggcctttaagcgagacatcagccatgccagacaatataacatacctgacctcctcttggcaaaactgaatcagccaagtttttctgccattggcaaaagtgtgattcagcagtttgtctccaatgccctcaaagttcctggacctctttctcttcccctcacttcagtggcatgggggcccccacccttttcgtgaggcttctttaataaggtctgagacatgcagttatttcagttgtatttctttgctgttatatgggagccctagtgatgtggtggtaaagtttgggaagaggggaagtgttctgtagtcctgtgattaggtgtcagtctttcaatgagcctatgccttttggctgtgacctccacaggtgcttttcaacaatgttcagttctgcatagtctccctgaggctctagtgtctcagtt

SEQ ID NO: 479296 - DNA, 552 bp, Homo sapiens
cctgccaagatcagcttgggcggagaagggggtccctggcagtatgatttgccccacgtgggagaactgctgcaggggcatggctgtgcaggagctggggcaggggacacttaccacgaagaagaaagaaaacaagccgcctattaaatatatcacctttggactttccagagacgtcaactttgccaaactccacaggaacccaacagccccctatggcaacactttccgaaatgcatgctctcttccaaagcaactgaagaacacagacacccccttctttcccctagacaaggctgttgtttttgtcccccaggttgctaccatgtgggaatgttgtggtgtgagaaagtatcaacaccccaaatgcagatcacacttgctttccatcagctatgaaggggccattaatcattctccaccctcgtatctttcccctgtctttgttacagacaagctgttcttacaaattctgaggagtatctctgggtggtgactaacctttggcattgtccatgtggtctgactgatgggggaatagtctcctagcat

SEQ ID NO: 479297 - DNA, 823 bp, Homo sapiens
ggcctctggagatctgaaaggtgctatattggggaggagggccttaaagtttgacagaaattcacagaatggtgcaatgtgggaaaattatacccatcactcacttgtagataaagacaaatcaaaagctgtttgcagtcctttttcggggcctttttcacttgtttctgagttgccagatctgaagcttaaagctggtcctggcccttcctggagcttcacccctgattctgactacccatgcccagccggctgtagaaggaagctgagcctgagtctggcccctcaattaggggctgatgccctaaccccgaatgtgactgcatttggagatagtgcttttgaggaggtgatggaagttaaacaaggtcataagggtggggccattacgactggtgtccttataagaaaaggaagagacaccagagctctctctccactttcctctatgcacagaggaaaggccatatgcaagggagaggcagtagagctgagtgacagttgctggtactgtgcagttgtcccttcgtgggccttgtttatagtggggcttcaaatggtcaatactgagaaaggagtcatgggcctggaaacaggaaatggctaaggtcaggcacgagatgctagaaagacagtaaggcaaagctaagtcatcggactctaggtaagcacaaatgaggagctttgaatgtgagaaacaaggtttttgggacaaatccagaatcaacgtttgccataagcagagagagtagaaagggaattgataaggttatgttggtaaatattggtggacagtttttgtttacatggattcccttttgaa

SEQ ID NO: 479298 - DNA, 1149 bp, Homo sapiens
ccatcacactgtcacctctcagcaggaaagttcgtgtgcaggggaactgccctttacaaaaccataagatctcatgagacagctcttctggtcagctatggtgagcctgctctcttcattgtgcattctccacaaaagaacctctgctgacgccagaggtctctcccctaggagtgaaaggggaccaagcaggggagatcttggtgaatattggaaagatggagccaaggagacccatgcacttccaattagacagcatgctttccatggctcgctcaacgccttgctccttctcaaagcatgctcagagagtttcagctttggcaaaggcttgagagatttcatgctcctttccccccaaaaagcaggaaataaagatccaacccttcataatccaaaccacacggggaagaggcaaagcagagccttcaccaagaattcagacgttcagtgtggtggtcagacctcactgtacagactccaaattccaaatgagctttgcctaattcctccagttctctctcaccatcttggacctgcacaaaaacgtatctcttttggcttttttgcagaccacacaattgcattgcacaacctcagcctctgacattatcccctttatgctttaaaggccagggaactgaccctaaagtttacatgggccagataagtgacttccagctaagggggtagactagaaagaaaataattaccttaaatcttattttacatgtcacaatatgaagatttatcccagacacaagcatacattcttaattataatcacagcattgatctgagcaagtataagatatatggccacaagttgctggtggttttgtattaccattttagtgcaattaacgtctaccactaaagcaccatcttacgcataagacaaaattaaaaagaagcttgaaatgttatatcctatccaggaaatgttactactgcattttcaagatgaggagttaaggttttcatttttaattactttactgagtgattcttcttaagggaacctaattgtgaagaatataaattactttgcaagtttatggtgggggactagtaatccttttgggatgcaaacagaaaagcaaacgagaatttaggaacactcaatggtaaaatttaacatttctgtcc

SEQ ID NO: 479299 - DNA, 605 bp, Homo sapiens
cagccacttctcctacaagtatcatgaccgtcaaacacaccttccttttcggtgtggaggggggatgtgggcagagtggggccacgagggtttgcccaaatccatggagagccctgtacaagccactgaattatcttgttggatgggacacctgtgccaactgtggcatgagtgtgggtgaaatactggcacatcacagaccaggggtaggagagttcagagatgaccccgcacaacccagccttcgcatgcagaacatgaggctcagagatgtttgcatagaagaactggatacacacacgcaaacacacgcacacaagcacatgcacgcatgtacacatgcacgtgtacacgcactcacatgcacacaggcccgcacatgcacaactttaagaacattgtattacttccttctggcctccacggtttcagatgaaaaccccattgtcatccaaattggtgttccctgataggagattctaggtcctatttaaagaaaccagtttaggtttagcatacagatcctgatctacttttttggactgtggtttcaatgacagtttaattttcagagccttttcagtgcttcttggtatgcttgattt

SEQ ID NO: 479300 - DNA, 699 bp, Homo sapiens
gatcacccgaaaatgccaattgtgataccggtggaggatgcttctcacaaggtggtacttgggatgcagaatcaacaaggcttgatgatggaggaaacaggagtaagggtgactgacacctggttttctgacttgggtgacagggtgggtgggggcgtggtcactgagatagaggtccctaggaagagaagcagatttggggctggcaatgacaagtgtctgaattatcttgttggatgggacacctgtgccaactgtggcatgagtgtgggtgaaatactggcacatcacagaccaggggtaggagagttcagagatgaccccgcacaacccagccttcgcatgcagaacatgaggctcagagatgtttgcatagaagaactggatacacacacgcaaacacacgcacacaagcacatgcacgcatgtacacatgcacgtgtacacgcactcacatgcacacaggcccgcacatgcacaactttaagaacattgtattacttccttctggcctccacggtttcagatgaaaaccccattgtcatccaaattggtgttccctgataggagattctaggtcctatttaaagaaaccagtttaggtttagcatacagatcctgatctacttttttggactgtggtttcaatgacagtttaattttcagagccttttcagtgcttcttggtatgcttgattt

SEQ ID NO: 479301 - DNA, 1958 bp, Homo sapiens
tgggcagaggcagatcatgtgtgggtatgaatgtcaggaagacaataggattggaagaagcaaatcatgtgtggggagcaagtaagtggtgggtagagcagatcatgtgtggttatgaatgtcaattatgcagaaaggcattggcagaggtagatcatgtgttggtgtgaatgtcaaaaagacagtaagatatgggcagaggcagatcaggaagacagaatttgtagcgaagaaccagatcttttgtgggaatgggtcacaggaagacaaagtgaagacaagtgaaaaatcgtatcagagaatggaacagagaaagtatgaaaaagatggagatagccaagtaatagatgggaagacagtaagagatgagcagagtcagatcatgtgtgagtatgaacttcagaaagacagcaaagatagaggcaaatcatgtgcggggaggaatgtcaagcagacagtaaaagatggggaaaggcagatcatatgcgaggatatatgtcaggaagactggaagagatgggcaaaattgatcatgtgcaagtacgaatgtcatgaacacagtgaagcagccactggaagattgtgtgaccaagggtgtggatggccacacgcacctcatccagaccatgagcaaggcaaggaaggtgtctctcttatccactgggaaataaaagtctttgccagtggccatgggggctgagtgcaaaaatatatttttaaaaggaatgggaagtttaatcttttaagccaagttcatgaatgaagaaattaaggatggcaccaagtgtaaggcatatgccacttgcctctggaaactggttcaatcctaaaaagtgaaatggaaaaaaacggtgctaaaatttgggtcagagatattacaggaaaatattttcaagtcgatattttctgtggccagggctcgtcctggcagtagggatctcccttgtcacaagccagacccctctgcaggaccaaattcttcttcctccacagggcccaccaggctggtagggcagattcggtggagtttgaggagagctgtttctgttcgttgccaacctcctgtttcccagaggcatcaccacaccattttccagaagctgggcaacaaaatccatgaggacactaacttggaagaggaaaagagttttcagggtctttgtttccttggtttttaaaattatttactcaagggcataaagttgattttaagatgtgcaattgggagggagagtagtttagataagaagtttgaaaggttccttgtggataccctcttctggccatcaaggtgtggatgtgcacttcttaaaattcttacacactgcatctttcagcctggggaccacacaaaaacatgagcagtgacatcacactaattatgggaaacagagcttccctcttattggccgatgggccctgaggctgtctgctgaagaatgacaggacgatcttcccctcacattttcccctggaagaaaaggaggttttggttgtgatgtataccagtatccaggaatgagcaggaaagaaggagttgctggctacttggttgattataagagagttgtgaagtagtggatttggaaaaacctggttttcatagaacagaatgcaatgaaagcctaaatccagcattgcttacatagcccctgaatgaacagagcccaattgagacaaacccctgaccacaggaagttcaaggaagagaaagtaagcaacttgggctaagataagctgtagcaaaggaggggcagtccccgattaccaaagaccatttttgcctggggcctttgcaacacacagtgttcatgccctagcatggcacctgattgttttgatagcaacttcattgcagttttaccaggttatttcttgaaatgataatatagcctgtctgttcactgtttccaggcagtgatatattttcctagttgtttggtttttaaaataaataa

SEQ ID NO: 479302 - DNA, 573 bp, Homo sapiens
tcagagccacatcatgtgtgggaagacagtaaggcatggacagagacagatcatgtgtgagtatgagtctcacaaaaccggttagagatgggcagaggcaggtcatgtgtggtatgaatgtcaggatgacagtaacagatgggcagaggcagatcaatgtggtatcaatgtcagggagcaagaagacagaatttgtagcgaagaaccagatcttttgtgggaatgggtcacaggaagacaaagtgaagacaagtgaaaaatcgtatcagagaatggaacagagaaagtatgaaaaagatggagatagccaagtaatagatgggaagacagtaagagatgagcagagtcagatcatgtgtgagtatgaacttcagaaagacagcaaagatagaggcaaatcatgtgcggggaggaatgtcaagcagacagtaaaagatggggaaaggcagatcatatgcgaggatatatgtcaggaagactggaagagatgggcaaaattgatcatgtgcaagtacgaatgtcatgaacacagtaagagatgggcagaggcagatcatgtgtgtgtatgaatgt

SEQ ID NO: 479303 - DNA, 557 bp, Homo sapiens
ggcagaaggacatctacttcggatcatgagcgatgggcctgtacaagacagatatgccgaagaaggtaaacaagtccagaaatccaggactgcaagagtcacagagaagctcccctgcccccagtggtctcagctgcctgcacgactgaagtgggtgagtctcaaggtgatatccagaggctgctggcaaaccccacatctgcctcctgctgatgctcaaaagcctgtcctgtgcagccaccagaaggaagcggcttctcctcacctccctcctccccaaatcagggcacagggtctcttggggcagaatctaagaatccaggtctactggcaaaggagtgtggcaagtgtcgcgtccaggctttatgcctctaaggacagggaggaaccgagaagggctgggatggtggcaagtaccaacaatgttcagccctttagaacacatcagtgactccgtacattaactgcagagaagcttaatctttttcgtcttacatgaatataaaaggaagttgtaagatatgtgtcctgctcccaatggactgatttctgccccc

SEQ ID NO: 479304 - DNA, 701 bp, Homo sapiens
tgagaaccagtgatcggtctaatgcccccattctttagtgggacacgcggaggcctagaaagggggcagcacattgaatggggcaaagaaaatggagccagcattgggcaggcctgtcagaaacaagtaacaggacctagaaaagcgcatggcagtaaaggcacccaccacagcccattcgaaatacagagaaatgtaatacattctaattttaaaagactagactttaatggaagcataaattcactctcagtcactcagcaaacatgtgatgtaaatactcccaacatgagttatttccagaacaccggagccggagcgatcgccgagagcaaagagcagctgcccccctttccattgcagctcctccactgccagcctaccctccagctcacagccagaggaggcaaagcattcataatgagattgacatacagtcttctgcaactctgcaggctattgtactgtaccttggtcattaatggcatggaccatgaagctaaactgcctgactttgaataccagctctaccacttgcgagcttctctttatctgtaaaatggggataatatcaactttacaaggttgttaaggaggctaaatatgatgttttagaaataagattaaactatgtatatgtatttgtgcaagtgcctagcacagtgcctaaaatacctgaatgtgagtctatattcaaaatc

SEQ ID NO: 479305 - DNA, 632 bp, Homo sapiens
ctcagcaggccccgccatgatggtgcacagtgttttgccatactgtgctgcttgtgagcaaggcaaagataacgagcatctaaaaatagccctgcagttggaggtacagcttggcttgaccccgctattagaggggtggggtctccgttaccagctccctgaggagcaattcaccttcaggtctcaaggcaaggcagggatgctgagtgctggtccatgtgagaagggcagcagctctgagaagcctcatccattcccgggtgaggcccaaagccactgggctgcaaggctggaggatgggagcctggacaggggtccctcttttgcccccagccatggatatccatccctggctttacatcccctggtggaaacccctggacagttgggtgaggagcctcttcctggtcagcaggagggtggcgccagcctgtctgaagggggccgcctccagctgatggtgaagaggccgcctggaatggagataggaagggactgaggactttgcagtgattgcagtggaagcaggaagtgcaggtcttctgtgggtcctagattctgtgagcctgctaggctcccctcattatttattttcaaaagccttcatttcttccctgttcactttttctttc

SEQ ID NO: 479306 - DNA, 641 bp, Homo sapiens
ttgaagtaagagtaggcaggaaccagtaacctttccccttcacatgcaagttagaattgcttcaatttgcccctctgtctactatgtttattctgttgggaaatttgtaaagaaaagttttatttggctcatggtcctgcagccttacaagaagcatggtgccaaccacctacttttggtgagggcttcaggctgcttgcaatcatggcagaagacaaaagggagccagaatgtgcagagatcatctggtgagaaaaccagggaaaaagaggggagagaaattgtagaaaagtatgtgaatggacatacagttgtcattgaacttcactggaagactagggtgaagagctggcctggagaaggattggttattagttggaggagaaaactgaaggctcttctttactcattgtgctacgttttatctggcttctcctatttgttgcttcccaccccacctcaccctaccccatcctttgcttatttcctgtgtacctactgtgtattgttcgcctagccatttccccaaatacctcagtcctgtttgtgaggagataacatgctgtgatggaaagatatagacttcagagtatgtaaagaatgtaaattatgtattcagagagaaccaagcttagttttgc

SEQ ID NO: 479307 - DNA, 522 bp, Homo sapiens
gtcaccagcatcaaagaccaaaggtagataaatccacgaagatgaggaaaaaccagtgcaaaaaggctgaaaattgcaaaaaccagaacacttcttctcctccaaaagatcacaactccttgccagcaagggagcaaaactggatggagaataagtttgacaaattgacagaagtaggcttcagaagccatgttcaagagattacccagtcctgctctatctgccactcagtgtcacccccgggctccctctggccgccaccttttcctacccaccaagcccagggccaggtaccaaggcaatattggcaagtagacttcactcacatgcctcccaataaacgaatctgctatcttctagcctttgtctgcactttctcctggtgggtagaagcgttcccagcaacttcaggaggtgcaaatgtcgtcacgcaaactctcattatgcatataatttcccatttctgactcccaatatccatccagtctgataacaggcctgccttcatcagccaaattaccc

SEQ ID NO: 479308 - DNA, 812 bp, Homo sapiens
gctgccacactggccggcctgcaggtgcatgatctcctgcatggtggtggtgctgagggtggatgtggcggaggtggcgctccaagctagccccagtggaccctggtgccatgctggcccctctaaacccgagtttcaggcctgcaccagtggtcccagacaccaggcaacctgtgcagacaaaagctccagttataccccacggccaggccagctgccactgatccaagttccaggcctgctctggcaacacttctaccccaatggacccgggctccatgcccaacccagtgacaagccagtccaagcagacctaagctccaagtttgcaccagtggtcccaaacaccagtctgccctctgcagacagagaccacaggcccacttcagatgcaggctggtccccacagacccaggctttagacacattccagtgccagaatggcccctgtggacctatactccaagcccagttctgccccagcatcagggaagccaccacagacccgggtctccccttgtggatccatgctccaagcctgccccagtggactccggtgccatgctggccccatagacccaggcaccagttttatccaggcctgactgtttgcaggcagacccttgcagcaggcccgtctacagtgcccacttactatgtgtgtccttaatgtcaatgtaaacaatgcttggttcagagtttttctttttctttcagcactttgaatatatcatctcactctctcctgtgtacaaggattttgctgagaaatctgctgatagtattatgtgagttcctttgtatgtcatgag

SEQ ID NO: 479309 - DNA, 670 bp, Homo sapiens
atgggcctgcctccagttctaatggggggctgcctggaggtggcatgggttgggccctcttctggaaggcttgccctaaaggggcttggtctcagctctgctatgggcacactgtgcttgacagttatgctccacctgggaacatccggtcacactgtgacagagaggcaagtccagatgctgtgggtgggaccatccaaggcttcttgaggagaggacacctgagcagagattcacaggtcacctgggagttgtgtgaagtagtgggggaggtcttcaagggcccagcgaacagcgtccatgggagcaggggacagcgggaggggaacttggagagtgggagaggcaggcgcagagtccagggatctgagggaagagagtgtttcatggaggaagatacagctgcttgtagatataaagcctcaccagagtggtccctcgtccgtgtgctgaagcctgctgcactccaagggctgtctgtgaagcagtgaagaggtaactttgatttttaggacatttattaactagagggaggaagactaactcacacaactagacagatggcttctattgatgcagaatcacaggaagagtcacagagaattagtaaatgattaaacaagttaatatttgtaaaatatttagaacagtgcttggcgtatattatata

SEQ ID NO: 479310 - DNA, 663 bp, Homo sapiens
ctgaacatttttattaatagaagacaagagtgcgagccttctgttatacgcagacagggccaccagaagggctccttggtctagcggtgacgccagcgtctgggaagatgcccgttgccgagcagacggtggtgggcactggtgccacttcgcatgcattccctccagagcctgctatgagctttcctttggaacctgggttgcttgttttacttcatggcgctgagcatttattcctggagcattttatatccaagaattcgggcttacctcttcctcctggctggcttaccaaatatatattaccaaatatattaacagtggagggggtccaggttcttggtgtgttggagaaagtattggataaaatgcacaaacagagcaaggaagggacgaagggacttattgaaagtgaaagtgcgctccacagcgtgggagtgggcctgagcatagtggctcaaaggccctgttacagagttttgcttgccaacaaacctcctggaagggagaataagaagggttgttaccagaaaaactggtcccccataatggggtctatccctgtttggtaccatgaagccaatacacaaaaccgcaagtgagcatcaaaaagcggaggctttcaaaattgacaaatgggatctaattaaactaaagagcttc

SEQ ID NO: 479311 - DNA, 2188 bp, Homo sapiens
ctatcccagatgagctcccaaattttcatggtaacctgagccagggccctcagttctgccgctgccattggaacctgtggacggtgcgggacctggaccgggaccgggacaaggaccaagaccagcgcggtgacccgagcaaagctgtcacccccgccgccgccgacccccatacccgccactgttcagcaggagggcccctcccctcgccccttcctgccctctcgccaaacgatgcgctcccaaagctctgacggcctggatggactcaagagctgctaaaatgactgccccgccccgccccgccccgccccgccccgcctcgcctcgcctcacctctctttttttttcctcttgtcatgaaactgctacctgggttaacagccaagtccctgtctacccgcagctgtgctggcatttcagctgaccaatctcgctattcatttcttgccctctggtactgcctagttgatcttcttctgcctcccttccatcctgcgggcttctccctaccagatcctgaggacctaccactaacttttcaggaattttgtgagctagatgatgttacactgggagcttgcagttggccgtggtgggagtatttatatgatggaaatcagcaaacattagaaatcagattttttgttgttgtgaagagctgtttgctaaacatctaccagtgcaccactagtcataccattccaagctcaatgaactccaagaaggataaactcaaggacatccacaccaacacatatcataatcaaattgtacaaagccaaagacagaatattgaaagcagcaaagagaaacaactcattatgcacaaaagatcctcaataaagattaacagctaatctctcatctgaaacaatggaggtcagaagactgtgggatgatgtatttaaagtgtagaaagaaaataaaaccctgccaatcaattctatattcagcaaaacaacctttcaaaaagggagaaactgagacattcccagttaaacaaaaactgaaggagttcactgttgttagaacttccctacaagaaatgccaaagggcatccttcaggctgaaatgtaattaccatatatagtaactctgtaactgcatgaaaaaaaaacaacaccgttaaatataactacatgggcaaaaataaaagtcagtattaatgtgtcttttgtttataactcttcttttttcccatatgatttaaaagacaattgattaaagtataaattataatctatgttgtatgaaaccaaaagcacaaggaaaaaaaggggaaaaaagataaattggacttcatcaaaatttaaaactttatgctttcatggacacatcaagaaagtgaaaagacaacccatagaatcacagaaaatatttggaaatctgataacagtctagaatcccaaatacatataaaattacaactcaacaacaaaaaacaacccaatcaaaatgaacaaagaaatagacatttttttccgtggagtatataaaagtgaacaataagcatatgaacagatgcttaacatcattagccaatagaagaatatgaataaaaaccataatgagatactacttctctagcatggctgtaattttttaaaaagtgaaaataaattttggaaaggatttggagaaatgagaaccctcacacattgttgacgggaatgtaaaatggtgcagctgttgttgaaaagtttattagttcctcaataaattaaacatagaatgaccatatagcaattcaactcctagatacatacttgagaaaactggtaatatatattcacacaaaaacttgtacgcaaatagcagcattattcatagcatccaaaaagtggaagcaacccaaatttcaattattcaactctaaaaatgaatgaaatacagatacatgatacaatgtggatgaaccctaaaaaattatgtagtgctgtacaatttattgaacaattcatgctttccctaccaatttgaactattaccagtatcatattttgataataacattgaaaacgtagcagtctttggcagtcaggtctttcagagattcctgtgtaatgattgatggttattatagcctattctattttaattataaatgtactaaaataatgcaacttatctctaagcagttattttaagtatttttctctggaaggcatttttgtgaaattattc

SEQ ID NO: 479312 - DNA, 1955 bp, Homo sapiens
tcctggaaattccggaattaaatgcaaactaatgagggattcgacaaggcatctatatgcttaacaagctccctgctgattcttattatcagccggctttgggacccacagctttacactatggattgaccgaggggacaatagagagggaatgggaactggctattggacatggtgccagagctgttgtggacaaggaaattgcccttgaggaagatgtggcagttagaggagtgaggcaggatggctgtgtcatcaagaaagtttctcatttgctacatgttgggtgcctgcaatggtttactctccaaggtggcaggcctccctggtatcaaccaggatacaggttactgcagagatttgttaagaatcgattaagaagacaaccttctgagatgatgacatttaaaggtgaaagtgataatggtgctggggaggtgtacctggggatcatgggctttatggtgctggaaaaagctgacatttatggagtgcttactaattgccggccagtgtactaaggattttacatgtgttggttcattttatcttcctgataacccagtgcagcaacctaataggaaacaaatttgttggttttataacatctcatgtatactatacattacttaaatgaatggttttatacgacacttagcttgtgactactttgatgcaggccagagtctggcaacatttcccaaaccatattccataaaaccatagggccccataaatggtcaaatgtatttaaatggtcaaatatatttacagaataaactgccctcttagtcgcagtgcacattaggatattaaaggtgctgaaagtcctgcagaaaaggcctgcatatacatacttcccccaaatttgcttctgttttgaggctccatgctctccaactgaattatctccctctgggattctcatcctcacctcatgtgaccagccttaccaaatgctttgactctgtcattgggccaggttctggactggctgactttcacatttccctctaggggcaaggaatacagaaagctaagatttgggccctgaagaaacattatttcatagtcttcctgagggtctcactgcttattctcaggtgtgttagcaagccagaggttccggggcctgcttgcacatgtgcccagcttagaagaaatcccataataggactcgttcattgtattagacatattttgttgtcatggtttttaaagtacagtacaacaatatttgtatggaaaaaaccatgcttatcataggatgtaatttgtgcataattttctagatggagtccagaatacatctttttcaaaggtaaacttaatgacatttgtttcataaataccatcattcttcactgtcagtcctctgtgaacactctagcctctgacattcagtgaagcaataaagaaatcaaacatgcctacctaacctttatgaaaatatttaaaattatgatttaatttttaatctcccatggcagcagtaaaataaatgatataaatctcaacaggactgtctacttcacaataacacttagggtatggcctaaacaggcaagaattcctcttaatcataaactgatgcggcacaggtctgggcaaagggagggtggtagatgttgacatttcgcatttcctggggacccagagggtagagagtggagaggcagttttgaaatgtcctgtactaacagtttgggtataaatacaatgtcctgttcttccttgccactgaatttttctttcttgtgattaaaacaaaacaaataaaaaccaagaaaactcaaaacacacaaaacaaccgccaggccaaaaagaagtgtaaagacaaggaaaagcatgtattttaaacttttaaaaggaaatgaaataatctactcagtctaaaaggatgggatttaaggtttagagtccattgtgaaatctcttacacaattagctaaggt

SEQ ID NO: 479313 - DNA, 724 bp, Homo sapiens
aacaggttattgtaaggcagtgtgtgcacgttaccaccccatggaaggtttgatggacatggacatgagccccctgaggccccagaattatctttttaattgtgaactaaaggccgacaaagatgatcactttaaggtggataatgatgaaaatgagaccagtggtagcaagtttccacggaaaaaagtaaaacttgctgctggtggtgaagaagaagatgatgataatgaagatgatgatgatgattttgatgatcagaaaactgaagaaaaagcaccagtgaagaaatctaatccccttccctccgtggcaccaggtgagagttggccaaaagagaaatttgtgcaagatttggaagacagaaatgaagtagctatttcactctctgagggtcgttgttacatgcagcgagaactagacatagaggtgcctgctgattccagcttattcttgcttttctccattcagaattcagctcttcttcccaattgccagtaagacaaatgcgagtaaatggtactctagtaaggaatttgggaggaatatggtggtggggactgatacaactgttctgttttacaaatcttcaattccccagtttaaagccccacttctcattcctgttcccttctgtacttgctgacttacagcccagagtatctccaggattctgccaaataggctggctcctgtttcctctggagcttccttataacattttct

SEQ ID NO: 479314 - DNA, 2472 bp, Homo sapiens
cggcagcagccggtaccggaagtggcggcagcagctgaggcgacgcaccgtgaggcagctgcttgactaggccacagccgccatggcgatgaattttggggaccatgccagcggcttccgccacaatgatgtgatcaggttcattaacaatgaagtcctcatggacggcagcggcccagccttttacgtggccttccgctcgcggccgtggaacgaggtagaggacagccttcaggccattgtggccgactctcaggtgccgcgcgccatcaagagggcctgtacctggagcgctttggctttgagcgtgcgagtggccacgaggcagcgggaggagctgctgcaccacgttcggcggctgcaaaggcatgcggaggagcgccaggcgacctcctgggctctaacgtcccagctgcagcagctgcgcctggagcatgaggtggcggcaacacagctgcacctcgcgcaggctgccctgcagcaggcgctgaatgagcgtgatgggctgtacgggaggctgctccagatcgagaggtttccccaggccgctccactggcccatgaaataatgtctgggccgcaagcagagcagaatggggctgcggcatgtcccctggctacagagcagcagagcgatatggtggccatggggacacatgctaatgcccagatgccaaccccgacagatgttctttatgtgccaggacctctgagtccctgggcccagggcatgcaaccccctctgccagtgccacatccattcccacacccaccaccattcccaatgaaattcccatccttgccacctctaccacctgctgtagtcacgggggcagaagcagcagcagtcccacttcagatgcctcctactgagatccacccaccttgcccgtggcctgcagtgggcttccaggaggagatggcccctctgtggtaccagagaagctacatccaggaggaagattccaaaatccttcaggggtcattccccttaggagacagcagaagccacagccagggagaaggttcagagaggtcccaaagaatgcccctccccggggacagtgggtgccacaacccgctgtcagagagtccccaggggacagccccactggggagcagcggatgccactcccaggaagaaggtacagaaggaccccaggggatggatcccctggggaacagagagagacaaaatcagaaagaaggtccaaagagggcccggaggatgcacaccctggtgtttcgcaggagccacaaatcagaaggtccagaggggccccaggggacggtcccccagggagacagcagaagctacagccaggaaggatgttcagatagggcccaggagatggccaccctggtgtttatcaggaggtgcaaaccagaaggtccaaagaggccccagtggactgtccccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacaggagctatagccaggaaggaagcccagagagggcccaggggatggccaccctggtgtttagcaggagctgcaaaccagaagaaggtccagagaggccccaggacactcccctgggggacagcagaagtcatatcaaggaagaaggcccagaggggccccagaggattgtcctccagggagacaacagaagctatagccaggaaggaagccgagagagggcccaggggatggccaccctggtgtttagcaggagctgcaaaccagaagaaggtccagagaggccccagggcactcccctgggggacagcaggagccatggtgtcagagaaagcccaaagaaatggcaacctcagaggcagaaggccaagaaaccaaaagtgaataaagtctcgggatcccagcagcaggagaagcctgcctcatttccagttccagtgaattggaaatgcccatggtgtaaagccattaatttttcatggcgtacggcctgctataaatgcaagaaagcctgtgtgccatttgagagtggaggacaaactcagtgatttcaggaaggctcccccaaggcagctgctgcaaggcaaggagggatccagggtagagctcagggatggtgggttagatctgcctccagtccaagctaaagatgtcttcaagtttccctgtaagatcccgcccagctcaccaaaatcaacctttgtcaggggttttctgatcctaactagtaataaagagtgtgcactggactgctgtgtcttctgtgtagtgtgtatctcagggcaaattttct

SEQ ID NO: 479315 - DNA, 704 bp, Homo sapiens
tatttgacttagacaacatggtctggctgctgctgatagttttgatggctgacacacttagcaaagtctgtctctggaaactggcctcggtcaaagagaactgccttttccaaggggatggcatctccttgcctcaagaaggcatcttcccaataggaccagatgttcgcccaatcaatacagactgcacccaatcagatgaggttctagacccaactctttctggcaaccactgtgggatgaattactttggagaatgtgagagtcaaggctgtttccacctgtatgctgactctgtggagcaggggtccccaaccccagagccacagactggtactggtccatggcctgttaagaacctggctgcacagcaggaggtgggcaacaggcgaatgagtgaagtttcacctgtatttacagccactctccatcccttgcattaccacctgagctccgcctcctgtcagatccgtggctgcattagattctcataggagtgtgaaccctattttgaactgtgcatgtgagggatctaggttgtgtgctccttttgagaatctaatgcttgatgatctatcactgtctcccatcaccccccgatgggatcgtctagttgcaggaaaacaagctcagctacattatggtgagttgtataattattttattacgtattataatgtaataataatagaaataaagtgcac

SEQ ID NO: 479316 - DNA, 804 bp, Homo sapiens
tcctccaacgattcctcacaatgtgctctctcatgagagagcacgtgagtgagcaagtgcaggatccagccagccactctgggcaccgacacaggagcaagctctgtgcagggcccgtggctagaccaggcatttggctgcctcctgtcactatcaccaagacagcaagaccaacccctcttcttcctcctcctcctcagcctcaatgtgaagacgatgaggatgaagacctttatgtggatccactccactcaatgaatatttcttatcactatgccaagatgagcataatagattttccaagagaagattctgactttctacccccaagacaatttgaaatgttctatgtcagaaattcaggacaaaacttcattgtctttgacagaacttcaaattgtttcctctatcatgatggctcatcacctgcttttgtgttttgagagttgaagtgttttaccatcagattgttctgcttaaattcctcttctagcctaaaattccctaaacataaaattcatgtagcataacattatgcttcgttgaacccattgtatgtttttttttttctgagtcaggtaaaagaaaaatagtgtagaaataaactttaatgatcacacttttttatagagaatcagacttaaatgctcacatatttttaaaagaggtctttcattcttacaggtgtcttcaatatattcatctgaatagctaaaggaacattaatgtttcagaatctcttctgatttactgcttaataatatttaatatgatccttgatgctgaatatgtgttttaaaatgt

SEQ ID NO: 479317 - DNA, 673 bp, Homo sapiens
tgtttgctgtgccattactgctaagccatggctggcatttgcacagtctgctcttggaatgtgggcaaaggtgtaggcaaagattcagggacacatgtgcaggcttgtcacatggtggatatattgcttcatggtaaggagtcgaggaagtatttttatgggaacctgaccttaaaacttagaccagatggacggatacagctaaacttggagaagaagaaaggggagatttcagaagaaggaatagtgcttacaaagagatttgtccagaggaagcatgatgtgctcaggaaactgaaaatgtcagcgttgttgctcagacagaaagatgaggaaatcagttccagtgggaagacacaaaatataaaatacagtccacccttgaacaacacaagtttgaacttcacaggtccactcatacatggattttcttctgcctctgctacccctgagacagcaagaccaagccctgctcttcctcctcctcctcagcctcaacaggaagatgatgaggatgaagacctttctgatgatccacttccactgaatgaatagtaaatacatgttctcttccttataattttcttaatgatattttttctctaccttattttattgaaaaaataagtatataatacatataacatacaaaacattgactatggtattcata

SEQ ID NO: 479318 - DNA, 817 bp, Homo sapiens
agctgcctgtctcctgcaggcatttgaattttcatctctgacttaaatgatcgtatgtggctctcgagtagattcaggattgcggcatgcttgaaaatgggaacagcacgtttttcctctccaaagcacaatactgaatataattttgatgctacccaaaatgtatcagttgaagaaaacaatataggtttgtggtcaaagttgaaagattataaagaaaatggggacaaatataaattttctttcaaaataccaacagactggtttatctcaggagatgccaatagtcaatctccatgcttcccagtgatgacagccaaaaatgtctccaaatattaccaaatgtctactggggatacaattgccccaggtgaatctccacaccttccctgtgagctagataccaatacatccattttagaaaggagaaaattgtcaatgttgaccaagaataaaatcaggtctgtccaatgtggaaaattacacactggtcttccaaatgtcactggcctcagtgacttaggctgcccagagacagatatcaatcaatcaaggaggaacgtggaaaaaccaagatcccctgtttaaagtcttccagttacccagctgcaacagatcaccatgagtgtgttcatacacaagatctgaggacttcagtggagtaaaatctataatttggaattggtttaacagttatcatgactagcatgctgctgattcttaatgaatgtgtgttaacgtcaagtgttaatttagagtttaaaaatcagggctccctgtttacttccatgaatgtttattgataccgacatgtgat

SEQ ID NO: 479319 - DNA, 955 bp, Homo sapiens
tgaatttaccttgcccggatccttctggatcctgaagtcacagagatgggggtccgtgcgagcagaacccagggcatgaagatccaaaagagcctgattcagttttctctccggggccatggcggctttcatggtgtccggggtcttaccccactcatcttcagctggcttcttgatgtcctggaagagagcacggctgccacgctggttttgcatcttcaggagacgctcgtagcccttgcacttttcctcagccaattcgcggaagaagtggctcacgccttccagagccacatgatcgccgtcgaaatagaagcccagagagaggtaggtgtaggaggcctgcaggtacaaattgaccaggctgttgacggctgcgtccacgtcagtggaataattctgacgaatctgggagctcatgaaggagctaaccacaaaaacggtgctggcaggtcccagaagcaggagatggccaagaagatggtcctggaggttgcaagtggagaggaaataggagggcggtcggaagctggaagaaagagtccccggaactgttccgtccaaacactgttgaagcaagagacagacccgtgggaccgccgagcagcaattcaggataattttcctatccgggcgccggaagagcaagacgtgcggttctggttcatggatcatataatggacccatccctgactctgctgaatgccaagattcctccattcagattcagacatcaaatgggtttcagggaccagcttggctatgtccttgggcagcatgacatctttaatggtcattcacctgtcaaatcttcctcaagggtcttccacattgcagaggcctctagcatccccccaggctcctaaatgaatatctagttatttattttttgtctataaatattttataactatcatactattttagtagtgctttgtaaataattttcctatc

SEQ ID NO: 479320 - DNA, 2212 bp, Homo sapiens
aatttagcatagaggcaggcacctaggagatgactatctcctgatggaaaagaagaacgattatcagtggcaaatggcagtttcagcgaagcaacaccaacagccggcttcacactcactagagaatgctgtgcctcctccttgtgatgcatctgctcccccttcaccttcaaccatgattgtaagtgtcaggcctctgagcccaagccaagccatcgcatcccctgtgacttgcacgtatacatccagatggcctaaagtaactgaagatccacaaaagaaggaaagtgcgaactcagtcccccatgtacacaaattatgcagtcgagtctcccctgtttgtggaaatatcgggtgtcagcacactcagggtgcaatagatgagcctcaatctaggaaaaccacctttgtgctcatggtatctcccctgacaggtgcacaaacacagaattgttatctactcatcataaattcactgagttgtcattatgacatggtcttctttatcaatggtaatattctttgttctgaagtctactgtgtctgatatcaatgtaacaactacgtctttattgtgattagtcttagcttggtatactgcccccacctttatgtttacgctatgttgtgtctttatatttaaagtgggtttattataggcaatatagagttgagtcttgctttcttatccagtctggtggtttttgtctcttaattggcatgttgggaccatttatattcaatgtaattattgatatggttaggtttaaatttaccatcttgtgttatgttttctattggcttcatgaatttgctcccctttccttctttttggccttcatttttgaaagacattttcactgggcatagcattctaggttagcagtatttttcatttagtacttcaaaaatgttgctccagtgtcttctcacttgcatttttttctgatgagaaatctgctgtcatcctcatttcagtccctttgtatgcaacgtgtggcctctccatctttcctgactgctcttcaggtttttttcttcctctctggttttgtaaaatgttattgtgatgtgccttagtgtagctttctctacgtttcttgtgcctggtgtgtgttcagcttcttggatgtgtgggctaaaagtttttatcaattatgggtagatttcagcagctatttattcaaatatattttttctgtccctccctcctttattttctctctttcagggccaacaattgcacatatatttggctgtgtgacattgtcctatagttctctgttgctctgttcatttttcttacatttttttctttgtacagcttatattcccatgtctttaagttcactaatcttttttcctgcaatgtctcatacactgttaatcccatccagtgcattttccatcatagatatagtagtgcccatctccagaagtttgatttgcattttttctgtatcttccatgtcttgacttgactttgagcatatgaactacagttattataacttttaatattcttctcttctaatttaagcatctttgtcaattctgggtcattttcagttgactgatttttctccttgttattgtcatgttttcttggttcttcatttgtttgctaggttttaactggatgccaagacatgatgagttttagcttgttgagtgccgaatatttttgtaatctcataatttttcctgagctttgttctgggatgcagttaagtcgcttgtagtttcatactttggggtcttgcttttaagctttgttagatgataccaaagctgtgtttagtctaggacccattactctccactagttaggtaaatctcttttcagcactttgtatattgctcagagaattgagagactttccagtctgatagttgagaataggcattattgctagtcttgtgaaagtaccaggtactgttccctctaattcttttgcatggctctttcttatccggggcagttttcttacatgcttatgttgatcagtactatgagaggctttaagtagcaatgaatcaggtgtctatttctcgagatcatcatcatattagctaacttttattaaacactttttatacagaacataatctgtagttagactggggttaatcccttctgttccttctgttgtcggacgagctgttgatgagcaggcctgtgctaagcatgctagtttatttaatatattaa

SEQ ID NO: 479321 - DNA, 448 bp, Homo sapiens
cacactgtgatgtactcgtacaatggaatactactcagcaataaaaactaacagacttacatttgcaaacaagaagaagaagaggaagaagatgaaggaggaggaggaggagtcggcggcgaaggtgaagaagaaaagaaagcctgctagaaagtttggtttagagggaaacatctccaggttgataagtgaatcagacctctttgaagaggatgtagctgccaaaagaacttgcagcctgccagtggtgtcgaaacttaccagagagtgtgggcctttgctggtctgtagaagagaccaccaaggcaggaaggtggtgggtggtggtggtgcatgggaaggctggagctgctcagaggcaactgatagtggggaaatcatggtctggaggtgcagctggagcttgtctgcactggtctctgacctccttcagtgaatatcatcaaac

SEQ ID NO: 479322 - DNA, 953 bp, Homo sapiens
atcacagacagctgctcagctgctgtttcgtattatggttaatgccatagccactcagagaagagacactggtggagaaatccatatgcaggccactttatggtctcttcttcccatgaggggtcacacaggatatacttttttcccagcaataaaaactcagcaacatgtgtgtgattatttctgctcagggaaaccctttttagattccatgcttagggcttttattgagagctggtcacataggtaccctccacctagcatgttccgaaattccaaacacacaaaaaggaagtacgtgctcagtgtgagctatgttgtttgcacaaactgtccaggcagagtgattcgcccctatgagttagggaacattgagaacactctcagaattgaagttcccagatgccagccaaaaactaaccttccgagcaggccattctaaggatagcagtctcagacctactatgttaactctttcctgcgcaggtactgccaatactactgtgttgtgttacctacattcataatgtaaaaatgtcctctcccgtttcaacttcgaatcattttattcacttgatgagggattaagagtcatgcaaacatgatggttcttgcatcattttcatcttgcacttagacgatgtatgtgaaatacagccactaaaatgaaggtgagtgagatagtgctctgaagccatttaaacattctttaaaattgtacacttaggcattgtcacaatcagtcaataagttgcgtgtatgagcgaaagacaccaccagttagtcttttcaagtaataatatctgagagttgaccatatgtttgcctatgtagttatatagacttcttactgatcaatagtgctgaattagacttgttttttccattatagtcatagtcaatggacctctgtatgaataaacagtgatgtccaaccatgaacctgatgtttt

SEQ ID NO: 479323 - DNA, 734 bp, Homo sapiens
agtgttgctctggattaggtttcgacctaagggaatgttgtggccggcacaaggagaactctgcttctcagacctcttacacctcaccagtaacgtataactagttccagccaacgaaatgggaaagaaaattattggtttggctaaatcagagaaaagccccttggagactttctggcttctctacaagcaaagcccaatttataaagaacttttcttctatacatttagctatgaagttggttgtttggaattccaggtgctctctcccaattggaatgaaatgataaaggatgttttatcccaagagcttgaccaacagttcagcaaggtagaacaggaaaagaaaaacagcaaaatcaaaagagtacaagacctagttgttcccttccaccttttgaacttgacaaacattttacagattgaggaatgggcctataggagaggccatttggaccagaaagggagacatactgaaaatataaaaacttggaggaaaaacactgtagtagtttatataacaagggcctgaactgctcagatggcaataggaattttttaaaaaggacatattcaagacaataattattaaattgagttgataaatcgtcagaatatcattctgaatattgcaccttccccatgctcaatgtgcatacttcacttgtaaagtttaacaatgtactttatcttattaaagacattgagatatgctgaagaaaaaaagttaatct

SEQ ID NO: 479324 - DNA, 1133 bp, Homo sapiens
gcaatgcccttctcactgtgctccactgcaaaatctctgctttcagttggaagaagtagaaatgtcgcaaggttttcagcttttgcccaggcgttgttctgtagaagcgctttgctggttacttgtggaagtgcttttcaacccttgtggcccagggaagccaaaagattggacatccctgaaagggtatatcctggaagtatatctttccaaagttggttcctgccggtgggttcttggtctcaccaacttcaagaatgaagccgcggactttcacggacaccccaactgctgttgggaattgggcaatgaccgctctaactacttcctgctggatagaggcaaagaaggggccctgcagttgaaacctgctgggttaaggatttttgataggaaggctacgggttgtcagtggcctcagtgctttcgggctacactcttgtttacactgacagtaaggtgactgccacctccttgggtttttgcactgtgtgcaataactccatgatttccttgtgatatttaatgggggttccttcagaggttaggaactccctttctttccatattgcagcatgggaatgtaggattagataagcatacttgctatctgtatacacatttattctttttccctttcccagttctaaggctcggggcctgctttaaggttttgaaggctgtttctgcctctggttcccattctactagatgagtatttgccttctgggtctccttgattagagtatagagtggtctggccatctcgctgtatccagggatccatagtcagcaaaagccagtgattccaaggaaccccacaactgttttaatgtcctagggtgaggataagccagtataggctgtattcattccttgctgatggccctggttcctctggctaagattaggcctagatatttgacttgttgtaggcagagctgggccttcgatttagagaccttgtacccttgattagctagaaagttcaagagatctagagtagcctgctggcatgacgcttccgaactggtagccaaaagtaaatcatccacatactgaaggaccagagtgcctggacttgagaagtggcctagaccttgcgccagtgcctgaccaaacagataaggtct

SEQ ID NO: 479325 - DNA, 884 bp, Homo sapiens
acaactcaaagagcggaggcagccggcaacatgaagtcaactgtagaagttggaaagatactggagtggggcaggaggggtggcaaagtatctgcccaaggattgtggtactctctggcaacaactccagcccatagcagctgtgcaggcagcagcagaagggatgttagccatcagaggtcccttcagggcatgtcagcattattccaggctgacaccagaagggccaaactcctctccaaccatagtcttcgatgtccagctgcttcttctctgtactgtccagagttcatatccaaactcctctctgaccgtagtttccactatccagctgcttcttttcctctcaatgttcaactgcttctctcttccatgtgctgtcctgctacgccacaccagtctgctgctctgccagtggagcttggggtttttacgggcacaggatgggagcatggtgggccaaaaggcaacattcagctttcagggttggtgtggggtaccagctggaccaagagcctttccaacttctccttcagcttctctctctggctagatgaatctttagctttatggttctggacagcagattttcctgcaggacactcctgttgtggaacttggaagattgaagtggtgagagatcaacctaagctctgtcttgataaaaagcagctgctgtccaaaaatcaatgtgaaacaggaaatgaagatgagtgtgttacagttaattctctgttagcagttgctgttcccaaatggctaagtgttaaccatctcagtggagaatcaggatgacagccttttacaccctgtcctcttggtacctgggtccttgtccgacatccaggaagaatcaggtcacacggacttggaggatagtgaat

SEQ ID NO: 479326 - DNA, 590 bp, Homo sapiens
cagggatctagttcatgagctgcagtgtccctgccaataattctgacatcttcaggtggccctgggtactagtggaagtctcattaaggagaaaaggcttatgcactctagaagagttaatttaccaaagcatacagaaccaggtcttccttttagaaaaatactggcaagcagcttctttttggaaactttcctactgcccacaccccttcattgcaaccccaataatccaccagacaggggatgatcccttcagaactaatcctgaaatgaagacatgtggggcagagcctcagccaaaatgtaacatgagtgaaagaagactgagaaagcttgttactgtggacactagtgatatttcagcaatgaagaaagtttgcaagttgctgatgaagccaggattgattttgtccaccagcgggtatctggcaatatctggagagatttttgacatccagatattttggtacaacaaggggtagggtgggaggagatgccactgccatctaaagtcattctgtcatgtctttgacggttttttgctatgttgctcttaatatttttcctttgtctttagtgttctgcatttc

SEQ ID NO: 479327 - DNA, 974 bp, Homo sapiens
tgcaaaaggctttctctagcaggtaaaggatattgataagccatggggggcacctgaaagtttttgaaaggagaagtaggacgttcagagctatgcattaggccattagtgtttctttgactatccctgtggtcgccatgttagtgaagactaagaacccagatttcagagcagaagcagaactctggggccacctagagcattcctcccatccagaagacacagcaacaaggagccatcttggaagcagagatagcagccttcaccagacaaccaaacctgccagtgccttgatcttgggcttcctgactgtaagaaataaaactgttctttatcaattactcggtgtcagccagagtgtgaacctctccagcaagtctggacaccggaacctacctcagcccctcaggaagcataaggtgaataccttctgtgaagtaagagatgggctaagcagtggagattcacataggagatccctgctctccaggaggtttctgtctcatgcaagaggtaggcatatacatcattttttaaaaatggttaactagacatacatctgttaaaaatattctatttatggaggatgcattgtatttatggcttgtggggaatcaatttcccatagtgagaaagaagtattaattaacacaaataagtatggaattgattgcaaatagccaatccttttattagtttctggttcaaaagaaactaaactgagacacagaataactatacttagaacatttgacttttttcttttcgaagaaaaatatgttatttaaatcctgataatagtaaaatatgatagtacaaaaaaggaagaaagctaaatattaacatcttgctctgtgtggagattctctagttgcaccttattgcctgtttagtctaatctgttcctaggtgtaccctaaaatagaaagaacttacaatgtaaatgtcagactggtggaccataccatcccttc

SEQ ID NO: 479328 - DNA, 467 bp, Homo sapiens
tcatcagttaaggcaggaacaggccattttcacttcttttttggaggaatgtcatcagttaaggcaggaaccggccatctggatgtaaacacggtaaaagaaatgaagaatgcctttaatgagctcatcacaagattggacatgatggagaaaagaatttctgagcctgatagtataggaatagaaacttccctaactgaaaaacaaagagaaaaaagactgaaaaagtcaagcagagtagtcaagaactgttggacaattgcaaaagaagtgaaagatctctataatgaaaactataaaacactgataaaagaaattaaacagcacaccaaaaaatggaaagatatttcatgttcatggattagaagcatcaatattattaaaatgtccatactacccaaagcgcttgaaggattcaatgcaatccctatcaaaatattaaatacattcttcacaaaaatataaaa

SEQ ID NO: 479329 - DNA, 549 bp, Homo sapiens
cccagaattcccacgtgttgtgggagagatccagggggagctggatggtggctgcagctgcatctcctcgagctcagtttgaggcagctgcagccatatcaactcgaacttggcccaatggcagggtgcagcccagcattaaactctcaaaatcgcaccttgggcctgccaccagggagtgtggggcctctcctaggcaagcatctttggcaagaagctgtgaggagtgttgtccacttgagtctcagctcagtctcacagcagcccgtggcagggtagttggtattgtcctaaatacacataggatatcccggtttccttgtccctccttgggtgggtggcagctgcaattgtgtcagtctgagctcaaggtgcgctgcatctcagcattaaactctcaaaatgacaccttgggcctaggaccagaggacacatgggaatctaaataccaaggagactaatgcatagttcttgtgtaaaattgcacagagatttttcaaaggtcattaatagtgtagtgtccataaagagtcagagtttctctgagtt

SEQ ID NO: 479330 - DNA, 650 bp, Homo sapiens
aatcagtgagccacataaggatgatctgggcatactgtgtaggtaaggtctgtttcattgacttatcaattatgttaaaggccattgggggtatgtgggccaatgcagctgtgcagctccaaaaatgtgtttacagtgtgtctagagagggaccacatgaagcactcattctgcttatggaatcaacaagctcatcagacatgtctgcccagtttaggaccagtgccatccacaatttgggatatggacccaaaacaagacctagcaatttgaatacacaacgccaaggagcctggaaatgtgtgcagcttgttaactgcacagtcaagtatggtgggatccccagatcccatagccggaattacttgatgataccccaggttccttttaagtgtacccctggttatggctgtataccttttctgagtatgatactgccaaacttattctcacagaagacgtggaaatttcctgccaggactcttagactttgtttcatgtttggattccttgactgcatccagtctgactgaacattactgtgtttatatgaagctatacccagcattttcagctacctgtgatgtttgctgaactgtttatgctgtccataaaatttcagtagcaggagtcattgaaggatggcctgg

SEQ ID NO: 479331 - DNA, 1017 bp, Homo sapiens
gaccaaaagtttaagaaagtaaaggagtgttcctcagagctgaagtacagcatggagctagatgaaaaggatgaggacaaattcttctcacaggaaaaatactggggcaggaaattccacacgccatcgaattcttataccgcacagcgtgtgaagatgaagtatggagcatggtacctcaagcctaagttgtggaaaaagctaagaagtgatgaacctttgattgaccccaagctcttacttaaaaagcctgatgaacctgacgttcttgacgatctttatggaccaattgcctttaaggatttcattctaagcaagggctatgaaatgcctggcatcattcaaaggctgtttgccaggaggggatggacttatgactctgttaagactcctattcaacgtgcaatgatattttacaagtacaaagaaatcgtagaggcatcggaagaagattaggcagttttcaatttactactcaattgggtatttcttgctctcattttaatcatcaatcataatttatgatgactggccccgtggatgcacaactttggcaacatctgtaaattcaatacctaatgtttatcaatatttcttaatgaactgctttggcttcattatttcatatattttatcaattatgtgattaatattcacatatactttttcacattgttgaagcattgtgaatattacatcatcatgtcaattatttgtaaaaatacataaaaccagaaattattattattagaattattctttaaaagagaaataggagaaattacgtgggtttctccacactgtaattacacacattggtattacttgtcacacagatataaaaagaaacaatgtttgatctatttggatttttaacaccagttggacttctgaaatcatcctgacttcaaatccataggttttagaaagagatggaattcaagagagcttggtatataattgtccctgtgtagcctaaagctatgaatggtatattccataaatactgtagtaatc

SEQ ID NO: 479332 - DNA, 550 bp, Homo sapiens
ttcctgcagtctggcttcctctatgaatatcaatgtggtcataatgttaatgctgatcatgctgatgagggcaacaccattgcgggtggaggtggagagtcaagcgagaccacaaacccactggaaggaagaaactccagacacatctgaacatctgaaggaacaaactccagacacatcatctttaagaactgtaacactcaccgcaagggatgtgcatttcctaatccctgtaatctgtgaatatgtcatatcacactgtaaaggagactttgcaaatgtgactgaagttaaggactggagaaggagagattatcttggattatccaataagtttcaacctaattatgaacctttaaaagcagagaacccctcctggctgtggtcaaaagatatgatggcaaaaggattagagacctgcaatgatactcattttgaagatggaggcaagggccatgagtgaatgaatttgtatgtctttattagcagcgtgaaaaaggactaatacagtaaattggtaccactagagtgggtcgttgctgaaaagata

SEQ ID NO: 479333 - DNA, 1376 bp, Homo sapiens
ccactcaggatttggattctgctctggtccagtcaaaggtggccaactgctcacaccatgttcaaataaggcaaatgccatgccgaaaccagtccagctatttttgtacctcacttcagttttctggtggagagatcatccaataaaattagtggaaaagacagaaaaagaaagaagaagaagaaggaggaggaggaaagaagaagaaaaagaagaagaggaagaagaagaaggagaaggaggaggaggaggaaagaagaagaagaataagaaggaggaggaggaggaggaagaaaaaataagaaggagaagagtcaccagagatctctctctcttcatgcaactaaagaggcaaggccagatacaggaggtacatgtgcagatttgttacacaggaatattgcatgatgctcaggtttggaatacagattcctatcccacagaggaacacaatactgcaaaactgaaaatgccatcaaatccattgattcaacaagtactgttacacctaagcaggaataatgaaaaggtcacatcaagccatatgagagttgaactgctggaatctaaagacagagaaaagtttaagaactcatagattttttgaatataatactaattgagtaactgtcacatggtattaaacttttctcatggattctctaaactgtttgtctttgggagaaagtgtgctttattttttgtgtcttcattatataaaacactattagacccaaattaatgcttcatgaatgtctatcaacttttaaatagtgataagaaacctctgctgtttggtttcccatagtttttgtattgtactataactgaatttagtcagatttaaacacttatgcattgcaacaaatttcaatgtgtttaaaaattgaaattgttaaatttgcagtgtatttatctgaatttgtttatatagggatgaatttaagaaattcagtaatgttggtagcaatcagatatgataagaaaatgcaactgtttaaattaatggaaaatgtggacatttcttcaaaagaatcactcaacactaacgtttattaataaggcaatgcataagttattatagaaatgaaatagtaggagacagattcttatttttcagtaacgtcttattattaggtttctgtctttcatgggatcagaaaattctaggtaattatgctccttttatctttctaaattttttttctgaaatgtgaattacttagctgttgtcatgggaatgtggctaagaggaaatgaactgcatagtaacattattgttatttgctgccactaatacgttcataaaaatagggaaacacatgaagtctctgaaggacaagcctctcactagaaatttttctatttatgctttc

SEQ ID NO: 479334 - DNA, 1744 bp, Homo sapiens
ctctctgctgagagctgaatactcattgggacaccctggctatggagaggagctgcccactgagcgtctcctctgagctgttgtgggtgacaagaaaaagagaagagagaatgagagaagagctgtggcccttcagggagcccagacctatgagctccccaaaccagggctgtgacaccttctttaggacttttcagttcctggtgtctccaagcttctgggtgccacattgtgatccccaccatcagctttggaagctgcttatagtatgcctggtcagccacagccttgcagggagccagcgcccatgcccatgcctggacctgcctgccctgctgcggctggcatgcctggctgtgtgcagtgcttggaccccacacttattcacacaccctttgccactctgtacctggcttgcccttgtcaggcatgggatccaggccagcagtgggagctgagtgcaggctgtgaggccgagtgtgtggaatgagcccagtgggccagagcagaaacttgggcaaaggctctgctggccacagaggtttctggctggtgaagcaacaccctaaggatcctgtaacacaatgaaaggtcaagggtaattaatcacaattaaagtataagtgtgaaggatagagtgagaaataccacttaaggaaagtctactttttttctttatgaaaagatattccctttctgatgcttagttttatccaagaacagggagagcacaaggttaataaaaatgtccttaaacagaagtgtttcaactattggtgtaagttatttctgtctggtgattcaagatgtgagtcaaaagaggaaatttgatagtaacagttgatcttaccttgcacaatacatgtcaccagcatctgtgttcctcttgttagggactctggggaccaagataaattatgcagaaaattgatgcatctaattctgccctaagctgtcacttcacatctgataacaatttgtacttgaagaaaattattttggaaagttagcataaccttttactctgtgcaagtgtataattttgctatcaatccataatgtacctgatactctgaggctaaaattttacatattactcattgaaatgtttactcggaactttgtgcatattaagttaaattttatttttatacacccatttgcaatgaattcaagcaaacatttataattacttgtcttgtagagatccaagtgtccctctttgccagctgttaacctgaggccagactaatataattagttttgttaattacttctagttcttcaggaataattgagattattgcatccttacttcactctagaattaaattgatggattcttctcatgtgagaacttgtgacctttaagtccacctactcaaaatttgttctggaactaattaaatatatatatttttcagtcttccttatctatagaaaaacataataatcaaaatgctccaaagcacgcttaaatgaaagatactcaagtatgttactcacagtgaggtcattagttttaaatatttctgtttttgtgtgtctgtggagaaagtttctctctaagacacgtgcacattgatttatgaaatgcacagatagtgatagatagccctaaaatacttaagttttgtcagtgtctctcagtgtcagtgcacatgtacttatgtaaataactacagtttcagtttatatttcaaatactctctcaagtcatttttaaattccatggctgtcttaa

SEQ ID NO: 479335 - DNA, 658 bp, Homo sapiens
tttttcctatactgttttcacagtgaataagtctctgtaaaacgtgtctttcctcctccttcaccttctgccatgattgtcaggcctctgcaaccatatgaaactgtgagtcaattaaacctctttcctttaaaaattacacagtctcagggctcagaagaaggcaggaaaatgtgggaaagtttggaactttctagagacttgttgaatggcttcgaccaaaagcttgatagcaatatggacaataagatccaggttgaagtggtctcagatagagatgaggaacttgttgggaactggaacacagttgactcttgttatgttttagcaaagagactggtggcattttatccctgccctagagatttgtggaactttgaacttaagagaggtgatttagggtatctagcagaagacagttctaagcagcaaagcattcaagaggtgacttggttgctgtcaaaggcattcagttttataagggaaacagagcataaaagtttggaaaatatgcagcctgacaatttgatagaaaagaaaaacccattttctgaggagtaattcaagctggctgcagaaatttgcataagtaaccaggagctgaatgttaaaccccaaaacaataggcaaaatgtctccagggtatgtcagaggtctt

SEQ ID NO: 479336 - DNA, 570 bp, Homo sapiens
tctcttgccatgaattattcaaagattaatctagctgctctactagttacctatgaagtactatggataacaaattgcttacataataccaatttatgccaaatatcttctgtttccccctctaccatcacatttcatcctgctttctgccccagagggttcctgagccctctggcttctgattgggttcaaccagttggaagtcccagcagaataccagaggaggggacaagagttgggttagggtatttattttcatggctctttctctatgaggttacctcagcggaaatttacactaggaatcatatgagcaaacataaagccagctgggccaagcaaatcaccagacaggtcaataatggccgttctctgggaatgaagctttcaaaatgctccaacccttttctgctccctccagtggctaccagaagatcctataatggatattctgagattgaaaagtgaaggagggtattgcttctagttcagttctatggacccaaatatttaatattaagtaaaatcaatggtctcttcctaaattctcaggactttattctaaataag

SEQ ID NO: 479337 - DNA, 1085 bp, Homo sapiens
agctctgtcgcccaggctggagtgcactttggtttcccaaattgctagtgagaggtgacagcgtgctggcagtcctcacagccctcgcttgctctcggtgcctcctctgcctgggctcccactttggcggcacttgaggagcccttcagcccaccactgcactgtgggagcccctttctgggctggccaaggctggagcccactccctcagcttgcaaggaggtgtggagggagaggcccgagcgggaaccggggctgcatgcggcgcttgcgggccagctggagttccgggtgggcgtgggcttggcgggccctgcactcggagcagtcagccagccctgctggccccgggcaatgagggacttagcacccgggccagcagctgcggagggtgtactgggtcccccagcagtgccagcccgccggcgctgctctcgatttctcacggagccttagctgccttcccgcaggacagggctcgggacctgcagcccgccatgcctgagcctcccacccactccatgggctcctgtgcggccccagcctccccgaggagcaccaccccctgctccacagcgcccagtcccatcgaccacccaagggctgaggaatgcgagcgcacggcgcaggactggcaggcagctccacctgcagccccggtgccggatccactgggtggagccagctgggctcctgagtctggtggggacgtggagactgtaacactcaccgcgaagatctgcagcttcactcctgaagccagcgagaccatgagcccaccgggaggaacgaacaactccagacgtgctgccttaagagctgtaacactcaccgcgagggtctgcagcttcactcctgagccagcgagaccacgaacccaccagaaggaagaaactccagacacatccgaaacatcagaaggaacaaactccagatgcgccaccttaagagctgtagcactcaccgcgagggtccacggcctcattcttgaagtcagtgagaccaagaacccaccaattccggacacactaggattataggcacgaggccaccatgcctggcctgtattttttttttttcctctg

SEQ ID NO: 479338 - DNA, 729 bp, Homo sapiens
cacggaccctctgcttcagtgcagaatgaaccaaggagactcaaacccagcagctactccgcatgcggcagaagacattcaaggagatgacagatggatgtgtcagcacaacagatttgttttggactgtaaagacaaacagcctgatgtaccatttgcgggaggctccgtggtgcagttactgcagccatatgagatatggcgagagcttttttccccacttcatgcactgaattttggaactgggggagatacaacaagacatgttttgtggagactaaagagcggagaactggggaatactaagcctaaggtcattgttttctggctaggaagaaacaaccatgaaaatatggcagaagaggtagcaggtggtatggcggccatcgtacaacttatcaacacaaggcagccacaggccaaaatcattgtatttgatctgttacctcaagtaatgaatgttttatgttctactggaaaggcaaatggcagtgcatttgtgtgttggaggaggggttagtgatttgtgctaagacccacttctgactgtgcagatattgagttcactttcattttttgccagacttctttgcactactttaagcaaaaatagtcaatctatttttctttgattgacatcccagtttgcttcagtgacagaacttactgcttagtctttgtactttaaaagaaatctataaatttaatgaactgtccaagtgaaatgtc

SEQ ID NO: 479339 - DNA, 495 bp, Homo sapiens
cagcagcagacaacatttgagttcaatatgcgtaatggaatagattcatatcctgtttgcagcctcttgccctgtgaagattcagaatttggcaaatcttttgagggagagaccagctgtgcatttagcatccttcaagactccaattttgtcattaccgtctgccaaaagttctgccaaggaccaagtgtggattcttatctttcagcaggttccagatctgcaaaaggtggttggaagatgtggctctgtgtagctgtcaaaaagtccatcagcagcagctctccacctagacctagctcaaattctcaagctcagatccatgttcagaatcaggacatattctcggagacagctgtggagcctcagtttacctccgaaagactgtcctcattctggaattgtattccctctagtcttgcttacttctacacatagtcaatgtttctatttagaatgtttttttctattaatttgtcagttatatcttcttcc

SEQ ID NO: 479340 - DNA, 1084 bp, Homo sapiens
ggacagcaccacagacgtatccgagatctgggaatgcagctcccggatctcctcttcatacagctgcctgaggaagttgatctcgtcagtcagcccgtccaggcgagactccagctctaccttgtgcatgtcagcttcatccacatccttcttgaggaagacaaatgcatttgccatcgctttacgcatattgatctcatcctcattctcgtccttgaagtcctccaccagcccatgaatgttgccaacctccgtctccaacttcagcttctcctggcccagagtctccagctgccgcctaaggttgttgatgtaactctcgaacatgttgtccatgttgctctgagccatctcctgctgctgcaggaggctccacttggtctccagcatcttgttctgctgctccaggaacggtaccttgtcgatgaaggagacaaatttgcctacgagcgtcttgatatgctccttctcctgggtgcgcacggcctggatgttggggtccacctccaggttaaggcggctcagcagactctggttgaccatgacggcggtgatgcctccgatgccgctggccccaccatagcctccgcccaggccaccccagaagctgctgctgcccactcgggagaagctggagaagctgatgcgggcaccgggcccactcgtgtagaagcggctgctgaaggcccgtgtgccagaggtggacaccttgtacgacttctgggtcaccctgatggacatggtggaggcaggagtggaggcagcagtgtagaagtgttccctaatcgccgcatccacgtcaacgtctactgttttttgattctttgattatggccatttttacaggactaagagagaaatcatgggccaagatgatctcacttggtgccaaattttgctggtttgggggaaggaatgacacaggtaaaatgaaattgctcttttttactgtttcagtgggcctgttctagtgttttgtgctcatctggggtattcaacatcttaactggattctggacatctcttggaggtattttgattaatatatttttgttaaataggtgtttctgtaaggaaatgaggg

SEQ ID NO: 479341 - DNA, 706 bp, Homo sapiens
aagaaaggaagaaactctcagccaaagttgcttagaatttagctcagcaacaggcctctgcgttggcatggatctttgccccttcaaacagggtttgcaccagagaacagggcttttacaggcaggcagaccaagaggaccctcagctgcaggtctgttggagtttgctagaggtccactccagaccctctttgcctgggtatcaccagcagaggctgcagaacagcaaatattgcagaacagcagatgttgctgcctgatacttcctctggaagctttgtctcagaggggcacctggctgtatgaggtgtcagtcggcccctactgggaggtgtctcccaggcagcagctgcagggtttgtgcgtatgcatgccagcagcagaagggcagccgccattctcacgccaaaccctctgtgctccacaaaggcagaagtcctgtccctgccaactacccatgaagctctccttgccagctcaaatgtctgtgggtgtcatgggttctcccccagttaggattccagaggtctatggcgagagtgggctactccatgcctatttaactcaccccttctccatgagttactcaggaccaggaatgagccctggtgctcagtaaccctgtgcagggttcctagcttcctcctcatttcacccctgactaagcatcttccctctgtcccctcttaatgcctttcttccgaag

SEQ ID NO: 479342 - DNA, 516 bp, Homo sapiens
catctactgatttaaaattcttatagagcatctgctatacgctatgcagagttttataaacaggaagatgtggggaagttttgagcttcctagagactcattgaatggctttgaccaaaatgctgatagcaatatgtacaataaagtccaggctgaggtggtctcagatggaaataaggaacttgttggaaactggagcaaagatgacttttgttatgctttagcaaagagaccggtgaaattttgcccctgccctagcgatctgtggaactttgaatttgaaagagatgatttagggtatctggtggaagaaatttctaagtggcaaagcattcaagaggtgacagagcataaaagtttggaaaatttgcacactggcaatgtgatggaaaagaaaaagccattttctgggaagaaattcaggctggctgcagaaatttgtataagtaacaaggagcagaatgttatttaccaagacaatgggtaaaatatctccaggacatgtcagagaccgtt

SEQ ID NO: 479343 - DNA, 677 bp, Homo sapiens
ggccaagctccatgttttcagaagatcccttttcctgcagcatgctgagaggacaggagagtggcaaaagtagaagtgaggacaccagagaggaggcagttgcagaagtccagggcactttgacattcggacagacatcaagaagaagaagaagctccagtaaaagagaagaagctacaaatcggttgaaaactggtcgtggcctctggaaccagttgacaaagataggagcaacccccttccatatccaaggatggtcctgtgagcatgaggacctgtataggagctggaagattgttggatttggacctggacttgggattgaacttccccctacctggtctccagaaccggggcagataactcagcaggcccaccttctcatgaatgctcgagagaaggaagaacagagttattttgtgagctggccatcaagagaatatgactgtagaggcacctatcgagttgaaaacgaaatatttgttatgctatcccttagccatactactccctgacataagtcttatttcatagcttctttctgcccccaaacctggctgaaaacctcttcttggagcacaggaaatggaaaagagcagtcagttcagcttgtcaaggaaggcttgtgtggcccttagccattccatctctaggagtccccttatcccctggactcc

SEQ ID NO: 479344 - DNA, 2459 bp, Homo sapiens
ccttcactgcctgtctgactccgagcatttctgggcccctcagcttcagagcacgggcagtgttcacttggagcctgtggctctctgcatatgagtagcagtggagggtcctctgtgaccttcttcttggccctcttcctggcagataagtgctctggttgtacatggaggatgaccgaaaaaaccaatggtgtgaagagctccccagccaataatcacaaccatcatgcacctcctgccatcaaggccaatggcaaagatgaccacaggacaagcagcaggccacactctgcagctgacgatgacacctcctcagaactgcagaggctggcagacgtggatgccccacagcagggaaggagtggcttccgcaggtgggtcccaccactaccctgctgcttccccttcctgtgcatggagcctgtcagggtggctaccactgccctcctcttcacggtcccaccagtcctgtccaccaagacctccaaggagcactgtcactggatagttcgcctggtggggatcatcagagaatgggccaacaagaatttccgagaggaggaacctaggcctgactcattcctcgagcgttttcgtgggcctgaactccagactgtgaccacacaggagggggatggcaaaggcgacaaggatggcgaggacaaaggcaccaagaagaaatttgaactatttgtcttggacccagctggggattggtactactgctggctatttgtcattgccatgcccgtcctttacaactggtgcctgctggtggccagagcctgcttcagtgacctacagaaaggctactacctggtgtggctggtgctggattatgtctcagatgtggtctacattgcggacctcttcatccgattgcgcacaggtttcctggagcaggggctgctggtcaaagataccaagaaactgcgagacaactacatccacaccctgcagttcaagctggatgtggcttccatcatccccactgacctgatctattttgctgtggacatccacagccctgaggtgcgcttcaaccgcctgctgcactttgcccgcatgtttgagttctttgaccggacagagacacgcaccaactaccctaacatcttccgcatcagcaaccttgtcctctacatcttggtcatcatccactggaatgcctgcatctattatgccatctccaaatccataggctttggggtcgacacctgggtttacccaaacatcactgaccctgagtatggctacctggctagggaatacatctattgcctttactggtccacactgactctcactaccattggggagacaccaccccctgtaaaggatgaggagtacctatttgtcatctttgacttcctgattggcgtcctcatctttgccaccatcgtgggaaatgtgggctccatgatctccaacatgaatgccacccgggcagagttccaggctaagatcgatgccgtgaaacactacatgcagttccgaaaggtcagcaaggggatggaagccaaggtcattaggtggtttgactacttgtggaccaataagaagacagtggatgagcgagaaattctcaagaatctgccagccaagctcagggctgagatagccatcaatgtccacttgtccacactcaagaaagtgcgcatcttccatgattgtgaggctggcctgctggtagagctggtactgaaactccgtcctcaggtcttcagtcctggggattacatttgccgcaaaggggacatcggcaaggagatgtacatcattaaggagggcaaactggcagtggtggctgatgatggtgtgactcagtatgctctgctgtcggctggaagctgctttggcgagatcagtatccttaacattaagggcagtaaaatgggcaatcgacgcacagctaatatccgcagcctgggctactcagatctcttctgcttgtccaaggatgatcttatggaagctgtgactgagtaccctgatgccaagaaagtcctagaagagaggggtcgggagatcctcatgaaggagggactgctggatgagaacgaagtggcaaccagcatggagcccacccttcttcctcccagctcccagcatcccaagcagcagactcctgggaccagcctctggatccagtggtacatgaagcgggagaaaggaaggcagcagcagtttgaccagtggaaaggcaaattagactgggacaaagctgctcaagggagatggctggagctgttttccttctgtccctgctacaagctggggagcactgagctctttcccatacgtcagcccactcgatcgtcacaatgagtctgtgaggtccccgcatccctttccccctccgtgagcacccactttaatgcatttgagatgagtccctgaatatgtttgcgttcttataaaatatagtgttgtttcgtgtatgtgtttttaatttgcat

SEQ ID NO: 479345 - DNA, 1012 bp, Homo sapiens
ctcctcaaaggacttcatgaacatttgcgtgccaatgttggctggggcccctggcaccctgaggtggagatgaaattgtctcaagctcctatttttacttctcatgaaaattcaaatctgtttcccaatttctgtgacttccttggaggctggaaggaacgttaccttcttatagaagccctgtactctggatttctgcttccacacacacaccccagaatctgtaatgaaagccaacctcttctgcaactttcaagcaaacacaccacactgatgcagccttcccagtgtagcataacaaacacagcaaaatacagtggagtccccagggtctacttttcccatctttatgtctgtgagtacacaatgtttagctcccacttagaactcacccattaccaaaaagtcatcatcaagccactcatgaatgatctgccccatgacccaaacacctttcaccaggcccactaccgacactgagggtcacatttcaacatgagatctgaaggggagaaatatccaaactacgtcagtaggggatattcacaatacatataaaaaattaatcttcctcttgaggactttccttctttgcaatctttccctggagctgaggatagccagactctaaatggataacaaataatttctcttgacatgtgctttcctttgcaacgacgtatgggaaattgaatttctcccaggaagaagtggggatggatgaaaccaggcttcaactcaatgcatctgtgtaattgctaagagagagctgcttccaccattaggtattataatagtccccagtgtctgttgtccccatctttatgtccatgagtacccaatgtttagctcccacttataaatgagaacatatgttaatttgcctaggataatggcctccagatgcatccatgttgctgcaaaaacatgattttattttttatggtggcgaggtattccatggtgtttatcagagaaatgcaaattaacaccaaaatgaaatagaatgact

SEQ ID NO: 479346 - DNA, 875 bp, Homo sapiens
cacaacaccttgcttgacaaaacagctttcatctggaaggatcataaaaatccttgagaaaccacagcctattacttgagagacaaaaaaggaaaatcccttaattttgcttaagataatggcctccatttccttccacgttgctgcaaaagacattatttcattcttttttatggaatcatacttccctttcactgccatctgcggtgaagctgccaccaaactgcagattttcgtgaaaaccctaagggggaagaccatcacccttgaggttgaaccctcagatgcgatagaaaatgtaaaggccaagatccaggataaggaaggaattcctcctgatcagcaaagactgatctttgctggcaagcaactggaagatggacgtactttgtctgactgcaacattcaaaaggagcctactcttcatcttttgctgagactttgtggtgttgctaagaaaaggaagaagtcttaccccactcccaagaagaataagcacaagagaaagaaggtgaagctggatgtcctgaaatgttataaggtggatgagaatgacaaaattagtgcccttctgacgaatgtggagctggagtgtttctgcatggaagtaaagacaaatcttgagttccttcaaagaaaattccaggcacctggatggccacgagaagtcaatgagcaactcgcatacgtccccgagctgtttttcaggaacccagaccccaccaatcggatctgctggcacggacctcagacagtttcggtttcccaagaaaacgttttcaagctgccttcatgactccttggaactcaaatgcgcagctcagaagccgcgggatgcagcggatgcgtcactagaggtacttgaaaacttcagt

SEQ ID NO: 479347 - DNA, 758 bp, Homo sapiens
gcagagctgcattggtcagatgtttgctagcagttaacttaggatgtgtgcaggaatatcaactcccagtcatctccagaagccaatagcaaccctcactctgagccttgccaaggaaaatcgtctcaagattaaagttaaagatgatgaaggcatccagcctgctggtcctaatctaattacctggtgtgaagagttatttttggcagtgagactagactgcactggcaatggtgataatggtaatgatggtgatggtggggacgctgatgatggtgatgatgatggtgatggtgatgatggcaatgatggttatggtaatgatggtaataatgatagcaatgatggtgataacagtgatgataatggtgatgatggtaataatgttgatgatggtggtgatgatgatgttggtgatgatggggatgatgatcgtgatgacggtgataatgataatgatgatggtgatggcgatgatgatgatggtgatgatagtgatggtgttggtgatgatggtggtaatgatgataaagatgatgacgatgattttatctctgttctacttatttattttaaattttaacaagcttttaatttgttacatgggtatattgtgtgatgctgaggtttgaggtacaatttatcccatcactcaggtagtaagcatagtacccaatagttagtttgtaacctttgtcacctttccttcttaccctttctagtagtcaccagcgtcaattgttgccatctttatgtcc

SEQ ID NO: 479348 - DNA, 3702 bp, Homo sapiens
tgatccagatagccctgaaaatcagcacatgatcaacatggccttagttagtcaaagcacagaagatatcaggagaaaattgcagaaacagcctgagtttgtggagaaagccgtaaggaaggcgaacgccaggccaggcgagaacgccgacttactggccacggccattaggggaattcccccgaagggagtgggaaagggaggttccgggaagaatacccagtctaatcgcccacgcttgcaacgcaaccaatgcacctactgtaaggaaataggacattggaaagataagtgtccccaactgaaggaaaagcaagggaccaaggactatcgatccgtacaggacttgcgcttggtcaaccaagctacagtgaatgtgcacccgacagttcctaacccttacacattgttaggattgctgctgccagctgaggacagctggtttacctgtctggactttaaagatgccttctttagcatcagaatagctcctgagagccagaagctgtttgcctttcagtgggaagatccggagtcaggtgtcactactcagtacacttggacccagcttccccaagggttccaggactcccctgctagctttggggaggccctggctcgagacctgcaaaagtttcctgctaaagacctgggctgcgtcttgctcctgtacgtggacaaccttctgctgggacactccacggcagttgggtgcgcaaaacggacggatgccctgcttcagcacctgaaggactgtgggtataaggtgtccaagaagaaagctcagatctgcagacagcagtaccaaagcttgctatgtgaaaatccccacataaccattgaagtctgtaacaccctaaatcccgccaccctgctcccagtatcagagagcccggtagagcataactgtgtagaggtgttggactcagtttattccagcagtcctgaccttcgggaccagccatgggcatcagtagactgggagttgtacgtggacgggagcagcttcatcaacccacaaggagaaagatgtgcaggatatgcggtggtaactttggatgctgtcattgaagccaaaccgttgccacagggcacttcagcccagaaggctgagctcattgctttaactcgggctctagagctcagtgaaggccagtacttctacatctcacacttgccagcccttgccaaagcagtagcacaacagtgcgttacttgccaacagcacaatgagaggcaaggccccagtgttccacctggcatacaagcttatggagtggctccttttgaggatcttcaggtggatttcacagaaatgccaaaatgtggaggtaacaagtatttgctggttcgtgtgtgtacttactctggatgggtggaggcttatccaacaccaactgaaaaggcctacgagcttcccatgtccacagtttttgaaatgagattaaggactgaaggctggtggggactcataaatgatacaagtaaagtattagtcagaacagaggaaaaaggggtgcccaaacacataaccttgaaatttgatgcctgtgctgtcattaatagcagtgaactcctgggcttccctgtctatgcttcccatgaaaagagaagcatagctgtaggaaattggaaagatgatgaatggcccactcagagaatcatacactattatgggcctgctacttggacgcaagacggctcatggggatactggatccccatttacatgatcaaccaaatcatacggttacaagctgtcttagaaataatcactaataaaactgtcagagccttgactattctggcccggcaagaaactcagatgagaaattctatctatcaaaatagattggcttttgactacttgctagcagctgaaggaggcatctgtgggaaatttaaccttagtaattgctgtctacacatcgattatcaagggcaagtagttgaagacatagttagagatatgacaaaactggcacatgtgcccatgcaagtgtggcatggatttgatcctggggccatgtttggaaaatggttcccagtgctaggaggatttaaaactgttataataggagttataatagtaataggaacctgcttactgctcccttgtttgctaactgtacttcttcaaatgataaaaagcttcattgctatcttagttcaccaaaatgcttcagcacaagtgtactatatgaatcactatcgacgtgtcttgcaagaagacatgggtagcgagaatgaaagtgagaactcccactattaagtgagattctcaaagaaggggaataagggaggggatcacccctcatattgtcttatgcccagtttctgcctccaaagaaagaagtaaaaactaaaaggcagaaatgaaatccacaagcagacagcccagcaccacatcctgggcctggtagttaaagatcgacccctgacctaatcggttatgttatctatggattacagacattgtatagaaaagcactgtgaaaatccctgtcctgttctgttctgttctaattactggtgcatgcagccccgagtcatgtaccccctatttgctcaatcgatcacaaccctctcatgcagacccccttagagctgtgagcccttaaaagggacaggaattgctcactcagggagctcggctgttggagacgtgagtcttgccaaagctcctggccaaataaagcccttccttctttaactcagtgtctgagaggttttgtctgcaccttgtcctgctacagggatacagaaagttgtcacactggccttccatccttgcaaaaaggcagagggtccactgagctggttaacaggttaacctaagccgtccgcagatggcaaggctaaaggagcacactgtaacacatgcccacttgggcccctgcacctgtccatctgtgtgctccctctcctgtaaggggtttgagcagcagcagtgactgaacagatgagccacacacctgtcacatgtcctgtgaatgggggtcaggaaactgtccatttccctctcatgagagagtcccactctattccttgagggagaaaatgttgatgtcatgaagcttcaataaaaccccaagatgacaaggttcagggagcttccagagagctgaacacttgtaggttcctggagggtggtgctgcaggaagggcatggaagctctgtgcctgttcccctgccatcaagaagagtccaaatctgtaaaatatttgaagagatttattctgagccaaatatgtgtgaccatggcccgtgacacagccccaggatatcaacagaacatgtgcccaaggtggttgagatacagcttggttttatatattttagggaggcatgagacttcaatcaaataaatttaagaaacacattggtttcatctggaagagcgggatagctcaaagggggagaagaccttctgcgtcataggtagatttaaattttttctgattggcaatttgttgaaagagttattatcaataaaaagaaatgtctgggttaaaataaggggctgcggagacctaagttttatcatgcagatgaaacctccaagtagcagacttcagagagaatagattgtaaatgtttcttatcagatgtaaggtctgtctgtgttgatgttaaagctggagggatagaattaggcatgtccaacccccacttcccatcatggtctgaaatagtctttc

SEQ ID NO: 479349 - DNA, 1945 bp, Homo sapiens
agttgagcgactgcagttcccactgttagatatccaccagcagcttgcatctggcatctggaaaaacttcagatactcaactccagcccatgagagcagcaatgggggccacaccctacatagccacaggtttggagctgcccaaggccttaggagcccacttcctccaggatgccctggataccgggttgggaacctgctgcattggaaagatcaaggtgttccggaccaatggccataacactctgaagcgtggtgtcagccaaagtgctttcttgggcaatgaaagtgggatatgtgatcattcacacatgatagcaggagcagcaatacagcagggtgcatgcttgtccattgggatattagacaccctcatcaaaatgttgccatggcaacattccttcattctcttggacgaccccgatctacttgaaaatgccctccattctcttggaggattccaagagaatgaaaccttaatagaaatgtttctaatgggagaaatatatgagaaaaatctagtagtacgggacatgcttagttccaatgttgtaccacagcaaggagttctagttattaggaggacaatatgaaggtttttgacacaccacatgagaggatggattggaaacaaagatgcagattctgaagttatatgctactgatttcatgattttgcaccagatgctggatttggattacaagctaattccttgttcttttcacctaagatttgaaattttcagcacacataactcatgagaaagtacaatccagcataaataccttgtgataaactttgatatattttgagtcatatcataagaaaaaatttcatagtgttcagctttcttactgcaggtatatagcttctctcattgttgctgcctctgccagtctgagtctgaacctgcgaatgattttctctctctcatattttctgcccttgtcttcggtttttgttcctggctatgtatatcccagtatggtttattctattgcttctgtagtctttcttgtctgatcaaattcctaaaaagtatttttggctctttccatctctgtctcttgtaagcagcccacacaatgcaactgataattcatgctttaggtatttgtagccaatgtcttgtgcatggatccactaagatgggtttgcgtgttaatgacaataaaattttcttcttgaatgtttcatggcccttcctcacaaatttgaatatatttaagacacatttacattgcaatatattgaagattgaagtgatccagtgccattcctcaattcacaatcacttctggggtttctgtgagaagaaacaaaatctgtatctgaagttgtcctttttgcaagttaataaagaccagaatgtacgtatctgagttgtgagtgtctttgttgttgttgttgtcgttgttattgaaaaaacagaacagcactaaggaaaactgctatagagcaagagtcaaaatgtgggaattttaaagtaatttttacagagcaaattttgggcagatacaaaacaccgattccacacatgtatatttaacttttaacttttatatttatcatgaccctctgagataaagagccagccttcaagttccaaaattcttttctcagcttgatctattctgcttatacttgtgattgcattgtgaatttcttgtagtgtgtttttcagctctatcaaatcagttaggttcttttttattgtggctattttgtcagctcctgtgtcattttattgtgattcggttttgctgttcttttgactctcgatgatctttgtttctatccatattctgaattctatttctgtcatttcagccaactgagctggttaagtacccttactggagaactaatgcagtcatttggaggacataagacactctggccatttgagttgctgcagttcttgcattgttttttttcttatgt

SEQ ID NO: 479350 - DNA, 1386 bp, Homo sapiens
ctcctcctgtcaggcacacagtgaagacatttctgagagtggcaatggccaaagttggaggtggtgtcagtgaacttaaggtcagtcttctccagagcctgccatttggtctggaccagcaaggacttgcagagggtgagcacttgcttcttggttcccaccacatagcctttcagcatgacaaagtcattggtcactttgccacagtggacaaagccacccagagagttgatgctcttgtcagacaggtcatagtcaatggaggcattgttcttgatcagtttgccgtccatgatagggtagccctggccgatcttatagatcttcttgttgatctcacctttgcccttggtcaccccgatgactttgatcatctcatcttgcccaaacacttggttgacaggtacctgctgctcgagcctcttctgggcccagtccagcttctcagccacagtgcctctgttcacctagatctccatcaggtgggctttctggtgcagaggaagcaggcgtatctgggtgtgggcaatgacgcggatgacttggcagtacttcttcatgctgctgaagtccttctacacctgctttttgccatcctctttctgccgtttcttgcagtacttggtaaagggcttcttcttagatttatgtcagttcttatagaaacgccttttgcactcactgctgatgtgctcagcaaagatggtcttgaaagtccagatgcctcgaagggtttccccatatcccacaatgcccacaaccaccatgggtggttgtctccacaatggccacagcctctaccacctccttcgtactcaccttggatcctggcctattgacttcccctcacgataagagtacttgtagcattggttttagttctccttaaatgtttattatatattgccactgaagacatttttagccgtggattttccctgtgcaaaatattttcactgaaaattgtatttgtttactaattatatttgtttgggttactctatttttttcaataaattttgctaatttttgattttcaagagttgtggtccattttatgtattaaatttattgacatagaatttttaaaatattcacttatgctttaaatttcagaatgtatgttcttggcatttgcctaaactaagttaactgtaggtttgtgcatttgtttgtaggttctctattttgtcctgttgctctgtgtgtctgtttttatgccagtaccatactcttttggttactatagctctatagtataatttgaagtcaggttttctaatttgtttacacagaggtgctcattgtagtctctgaggatcttttgtttttctgtgggatcagttgtaatatcacctttgccatttctgcttgtgcttatttgta

SEQ ID NO: 479351 - DNA, 626 bp, Homo sapiens
cgcctgtcttcactgctctctgttcttggatagagctgcaagtataaaagtaattaggtgctgcatgacacaagctgcacctcatcatctgttttgtagccatctgtactcctttgtttcattatcatcttgtgggacaaggaagacagggagcagggcagtgcagaagggaattgttgggcgagagcaccacacagagtcccacactggggcactgcctagtggagctgtaagaagagagccaccatcctccagaccccagaatagtggattcaccaacaggttgcaccgtgcacctggaaaagccacagacactcaacgccaacccatgaaagcagccaggagcggggctgtaccctgcaaagccataggggtagagcttcccaaggctgttggagcccacctcttgcatcagcatgacctggatgtgagacttggggtccgaagtgatcattttggaactttatggtttaaggactgccctgctggatttcggaattgcacggggcctgtagcccctttgttttggccaatttctctcatttggaatgagtgtgtttacccaatgcctgtaccctcattgtatctaggaagtaactaacttgctcttgattttacaggagcat

SEQ ID NO: 479352 - DNA, 1524 bp, Homo sapiens
agtgggtgcagcacaccagcatggcacatgtatacaaaaacctcaccaagaaaaaacagacacacagacacatcaacatactcttcaattactcacacagctatttggaggatgtcaatatgcttgaaattctacaacatctggcactgaagccaacaggaaatgaggatgaacgagaaaaaacacattttggatcattgagtggagtaactgtgcactggggaaaggggaatgatcagacttttcagggactagtggatactggctctgagctgacattgattccaggggactcaaaacgtcattgtggtcctccagttaaagtaggggcttatggaggtcagccatttgttcataaaattgggcatgcacagcagcattccatcatcagatggaagcggtatatatgtgatcaagctcgagcagttctggaaggcacaacagtgcacctggttgttcactttgctcggaaggagaaatggccagttgtgcgatcatatactgattcatgggctatagacaatgattggctggatagtcagggacttggaagaagcataattggaaaattggtgacaaagaaatttggggaagaggctaagaaaggagttacagtgttggttggagtgactgacccagactatcaaaatgaaatcagtctactactccgcaatggaagtaaggaagaattgtgtccaggaaactttgcatttagtcaaaattgttacgaagttcacctagaagtttccttctccctgtggtcttttcctaattccactggcatcccttcccaaggagccctgcaagacaaagtcaggaatggcttccctggggaacgagagtgccaacagggctcttcctgctgcttcctctacccttgtatttcacttggctctctaaattcatctcagctccaggaactaaaaataaaaagccatattaaggatataatgaatgaaggaatgaatggtactaagtaaaacagaagagttacttaggggcagggttattcagagtttgtagatcatggtaaggcttttttcagttttattccaagtgcatttgaaaatcattgaaaggtttaaccaggaatgtaacatgattagatttacatggttacataaaaagatcaccctggttactgtgtctagaatgaattactgtgaactggtggtaatagggggaatagaaatggaagaccaattaaaggctatcatggcaacccatataagagataagaatggcctgtgctaaagtgtgacactggacacggagaaaagtatatggattcaaatctatttagaaggtagaattactaggattttctgatgagttagaagtatgtacgtgtgtgtatatatgtgtgtgaactatgaggaaaataatagaaacacagatgccttcatattttctggcttgagggagtaattgaagggtgctgttgcattctgagattagtaagacttggagaggaactaatttggaggaaatcaagagtttaattttaacatccaatttaaaata

SEQ ID NO: 479353 - DNA, 690 bp, Homo sapiens
tggacacaggatgcaggactgcccatgtagactcatgttccaggcttatcccaatggccccagggccccaggccagcccccatggctctgggcatcaggccaaccagcagcagtaacttcaagctccataccagtactgcagacccaggctttacacctgcctcagcaccaggccagccagaggcttcaggttgatccccatggccccaggtgccagtgggcctgcttcagcaaaccaaaagtccaggccaacttcaatagaccctggagccagtcttgtcccaagcacttaggatccaggtatacccaggaagacccaggttttaggccccatggactcaggctccaggtcaatctcaatgcccggctgatccttgcagactcaggtttaaggcctactcaagtgccaggtcagcccatgcctgacaggtttaaagacagccctcatgaatacaggcttcaggccctcccctgcaaaccagtaccaccacagtggatccaggctccagacccaatcctgtggaatacgcaccaggcccaccaagctgctgccctaggcaccaggtcaacctgcctgaactccagcagcaagcccatccatggaccaggccagatggcagccccagaatttccagacagtctgactaattaagggctttcccatgcaaagccagtctgcaaagatagaat

SEQ ID NO: 479354 - DNA, 1032 bp, Homo sapiens
atcaatgaataaataaaattctagtatcatgttggtatcttttgacttacatgattcctttgcttcagttccctctgctgcaggtctgctggagttttttggaggtccatgcgagacctgtttgcccgggtatcatcagtggaatctgcagatcagcaaacattgctgcctgttccttcctctggaagctttgtcccagaggggcacccgccaaatgccatctggagctctcctgtatgaggtgtctgtagacacctgctggcaggtaactcccagtcaggaggcatggggagcctgcaggcaagaacgtttaagtctgctgaagctgcgcccacagccaccccttcccccaggtgctctgtcccagggagatgggagttttatctataagcccctgaatggggctgcattttttcttttagagaagctctgcccagagaggaggaatctagagaggcagtctagctacagtggctatgccgagagctgtggttccatttcattgccaagcccaccagagcaggtcttctacaacactgtgctgtatgggaaaatggtacttcactcttcaccagctgacttgtccagggcagtccataagggaaatggggggtgggtgcccccaaacagagtccacactggggcagtgcctattggagctatgggaagagagccaccatcctccagatcccagaatggtagatccaccaacagcttacacaatgcacctggaaaaaccacagacactcaatgccagcccatgaaagcagccacaaagtcaaagggacagaacttcccaagaccatgggaacccaactcttgcatcagtatgacccagatgttagacttggggtcaaagaagattcgctatttcctgacttcctcctcactgatcaaagatgaatagacatgacagtgcttcttgtaatgcattcaaattttatctgttaatactcttaatatgtaaaaaaatcaaaggttttttgtcttcttcctataaatgaatgacatgtctttaattattaattaatt

SEQ ID NO: 479355 - DNA, 602 bp, Homo sapiens
gtcttctttttaataggcttttattcgaagcctgacccatgcagttctttgcgttgtattcccacattattacgcgtaaacccttttgctttggtgccaggattcatgggtttaggaatcaaggggtggaagtggaagtggcaccactcaccattatccctagtgacccactagcaaaatttttgcttcctattcccacgacatttcattctgcaggcctggaggtcttagttccagagggaagaacactgccaccaggagacataatgattccacagataaccagggtatgtgagggagagagggaagagcatactctttccctcttcagtccttgcacccctctcatcccattgaccttggcaggcactgccatgggtaccaaagcagcttgcaccaatgaagcaaggggtccaagggggcaggaattatccactcttgcccgtgtacaccctatctcccctgctgtcagtagccttgaattccctagacttcatttatgtcatggatactaacgtggcctttatccatgaaacaggaagcttgggtttggcttaattggcaggaatcagccacactcacctgtgctgtgctttttaact

SEQ ID NO: 479356 - DNA, 602 bp, Homo sapiens
gtttaggcttaccgatggtttgaaggtttgaatcccaggtttcacacgggataagaagaggccaggctcatcccgctgcaagtggcatgaacttctgtggctccaccccagtgcacattcccagtgcgcaggctggttggaattatgccagggatcccctcccacctggctgtctcattagcaacttggagggctcagcagacagaaagatgtgggaagaactacctagagacttgttgaatggctttgaccaaaatgctgatactgagatgcacaatacaatccaggctgaggtggtttcagatggagatgaggaacttgttgggaactggagtaaatgtcactcttgctacgcaaagatactggtggcattttgcccctggtctagtgacctgtggaactttgaacttgagagagatgacttggggtatctggtggaacacatttctatgcagcagagcattcaagaggtgagagagcataaacgtttaaaaaatttgcagcttgatgatgcagtagaaaagaaaaaccaattttctgggaggaaattcaagccagctgcagaaatttgcttaagtaactaggaaccaaatgctaatcac

SEQ ID NO: 479357 - DNA, 705 bp, Homo sapiens
cccaagcaaactgcagcagacctgcagaagagggacctgaccattagaaggaaaactaacaaacagaaagcaatagcatcaacatcaaaaaaaaaaaaaggacaaacaagcaaaaactccatcagagggtcaccaacagcaaagatcaaaggtagataaatccatgaagataaggaaaaaccagcacaaaaaggttgaaaatgccgaaaaccagaatgcctcttcctctccaaaggatcacaactccttgccagcaagggaacaaaactggatggagaaggagtttgacaaattgacagaagtaggcttcagaaggtgggtaataacaaactcctctgagctaaaggagcatgttctaacccaatacaaggaagctaagaaccttgacaaaaggttagaggaattgctaaccagaataaccagtttagagaagaacataaatgacctgatggagctgaaaaacacagcacaagaacttcgtgaagcatacacaagtatcaatagccgaatggatcaagcagaagaaaggatatcagagagtgaagatcaacttaatgaaataaacgtgctgtattcaggagacccatcgcacatgcaaagacacacgtaggctcaaaataaaggaacgggggaaaatttaccaagcaaatggaaagcaaaaaaaaaaaaaaaaaaaaaaaagcaggggttgcaatcttagtctcc

SEQ ID NO: 479358 - DNA, 584 bp, Homo sapiens
gaggaaagggtgggagtgaggcttcaggccagtatggtttcagtcagtttgtctcatttcataccattcctgtcagttatttattatttattgatatggacatcatgcacaaacaattgtaaagtctctggatcctactatttttacttggagaggagttacttttcttcttgcaggaggacagaatatggtcaaatcacttggatcctattgaagttggtctgtttacattttgtcctttctcttagatgtatccctttcagggtcttaccagcaggcttttgtcatttaccagggtgtttcttccttttgactgagcagaatggcaaaagaattatgtttcagacaacgaaggtaaagaccatgaagaacaatggacagttatccaatccctgtatcatcactgaatgttgagtggccaataaattgttattggtcttttgattaggagaattgttatctgagtcatatcagcacgtgataatagatcatgagatcctagattcggggcctgatgacctgactgaataagactgttgagatcctagtttgggggtaagcatattttgcatgtgtgaaggatg

SEQ ID NO: 479359 - DNA, 637 bp, Homo sapiens
tttttcctggatatgggacaagaacttgggaccagacagacaaatggcaggactaaaagagctggctgtaacccccaccccaacaccactggccacattgtgggtgacgagaaggaaagaagtagagaagagctgcagttctttggggattgcaaacctaggagctccctgagccagggctgtgaaaccttctttagggctctgcatttccgggcatcatctccaagcttccaggtgccaccgcattccctggttcctgaggcagaagctacttgtgatacacttggtctagctacagccttgcagggagccggagcctgtgccagtgcctggagctgcccaccccaccacagccagcgtgcctggccgtgcgcggtggccggaccccacttttgcttcttcacacacccctcaccactctgcgcttggcccaaccttggcaggcatgggatccgggtgtttaattgaaatattttggatctattaataaatgtgtaaacttgcttcccttttttattatttgatatattcaactttaagctaaagggatattctaacctatttctaaatacaatctaaatttaccatgcttttcaaaattcctatcagtgttacgtgcagatcttggcaatatttc

SEQ ID NO: 479360 - DNA, 545 bp, Homo sapiens
ctcatgaaaatatgggccccttattgtcagactgggcccctttactgtttttaaccctcacatttctgctgtgggcatgggagtgtggttcccagtccagtggagttatattcccaggaggattatggctgcctcttctgagtcatacatgtcgccatggaagtgggggaaagctcgcagtcacaggcttcaccctactcccacagagcccacagtcccaaaggcctgtctcactcccaccatgccccatcaacagcactaagtctatttccaggcagccagtggccagggctgagaacttgccccagaccataagcctcccagttgagaaagcaaacagactcagagtttttcggcatctcagggagcctgcaagggttatccaggtccttcaaagtgtctgtggattctctcagctttcctggaataagatgaatattttggctctaactactggtattcatcattgtactggaggtgccagccacggcaattaggcaggaaatgaattgaaagcatccatatcagaaaggaaaagatttagc

SEQ ID NO: 479361 - DNA, 815 bp, Homo sapiens
tgtgtttatacattgatcagtggatgaacattctctacaagaatccttatgagttgggtgtatctcctgaagatataagaaaccactataatccttgggtttggctgttttacacaaacacatgtttcttagaaactgttatttcctttaactctttttatttatttttatctggttgggttcatttgaaagccttatcttcaagctctaaaattatttcctctccttggtctaatctattgttaaaactttccactgcattttatagttccctaaatgtgtctttcatttctatacgttttgattgttttttcttcaaaatatctatctctagaaaatgtcttatttatattctggatttaaaaaattctttaggttgcttttcatgtttctattgtatctccctgagtagcttaattatcaacattttgaattctttatctggattgccttagctattctgtagtcttataattacatcattgtgcacatgtaccctaaaacttaaagtataataataataaaattaaaataaaataaaataataataataattacatctcagtctttagtgagcctgttaccctggactgtgaacttcttatgagcttctaatcccccctcttagttgatgcaggatggttagactgggctggagttgggcatttctcttctcctaggtcacttagcctctgataaaaccaaccctttaagggttgctctgtgtatttcaaaatgtttcctttaccctctccctactctgatattcactgcgagaatctcagggcacttttggagataaaacttgtaaaagc

SEQ ID NO: 479362 - DNA, 803 bp, Homo sapiens
tgactggtagataagggaaagtgtttggcattttgccccaccctagagatatgtggaactttgaacttgagagtgatgatttagggtatgtggcaggggaaatttgtaagcagcaaagcattcaagaggtgaaagagtgtaaaagtttggaaaatttgcagcctgataatgcaatggaaaagaaaaacccattttctagggataaattcaagccagctgcagaaatttgcagaagttacaaggaaccaaatattaatcaccaagacaatgggaaaatatctccaaggaatgtcagaaaccttcatggcagccccacccatcacaggcctgaaggcctagagagaaaaatggtttcgtgggccaggaccagagccccccctgatgtatccagcctcaagactaggtgccctgcatcccagctgcttcagctccagccatggctaaaagaggccaagggaagtaggctcccttctggcccagggcaggaccagaaatgctgcccaggaaccaaggcctggaattgggaatcccaggagccaacctgatgctctatccccactgtggccaagctggtacccaagctgcaagacaatgtccccttttactctttcgtattcctgggtgagaatcagagctggctgccactgaggaataaggacaaagtgtcacattgttcataaacgctttgaacaatgtgatactttgtcctgattcattatcttaagagaaacaatcagaaacaggaagacaaatactgcatatcttcactgataaatgggctctaaataatgtgtatacataga

SEQ ID NO: 479363 - DNA, 541 bp, Homo sapiens
agcagcagccgtgttagtctcagccctatggcaggatgtggatctttggaagctgggctctcagaatggtaccaactgtatttccccttaggccatctatgggggatagctcctgggagtctggaggtatatagggagaagctagcaattggcaaggccttgggaaacttggtacctaaactctcaggtggggagagactaacctgcatattggttggacagattaaagttgcaacaagagaagagatgtcagtctcagtagctatggagcatagaaaccaaaccaaaaacaagccacagggctggttctgccgatatttcttatataagagatgtgaaaatgcacaaatgaaagggcaaaatcttatacactgtctgagatgcttcagtttactagtatatgaaaagggaattaatgagttttatgttaaatgcttaaggacaaaacgataaatttcaattctgcatttcagaattgaagaaaaccccaagtgtatatggtttaacctcttatgtgagggtttgaattagttccttttac

SEQ ID NO: 479364 - DNA, 1057 bp, Homo sapiens
cagcaaagcaatgttgaggggttgctgtgggcctgggggaagctgcagtgtgaggagggagtgggtgggcttgtgcatggctgcaggggccaccctgctggagttttctaccagtcaggcatggtctgccagcacaagagctagacatgggcagttctttctgccaactctagtgtccctggtgattgaggagccacctcctgctgggactccagaggcccatggcaagagcaagttgctcctttccagttcaactcacccccttcacaggagccactggggtcaggaacaagtcctggtgcagggtagccctgtgcagggttgccagcttcctttcccttcagcccagctgctgtgtctttcctccttccatccttggtgtcttccctctgaagatcagttaggagtattccagtcatctcagcccctcagtggcagctcttccacctgactgcgtctagtttgccatgttgcactctctccttttgtctatttttaaaaattgaattattagatattttttcctacagagttattagagctccttatatattctggttattaatcccttgtcagatgggtagtttgtaaatatttttttctattctattgcatgtctcttcactttcttgattgtttcctttgttgtgcagaaaattttgaatttaatgtgatttcatttgttcatttttgctttagttgcctgttcttgtggggtattgctcaagagctctttgtaaagaccaatgacttggagtgtttctccaatgttttcttgcagtagtttcatggcttgaggtcttagaattaagttttcaattcactttaatttgatttttatgtattgaggtatcattgattgataaataaaaattgtatatgtttaaggtatgcaacataatgctttgatatatgcattgtgaaataattaccacaatcgagctaattaacatatccatcatcttgcatagttaccttttttggtgagaatatttaagatgtaatttcttagcaaatttcaaatatataatacattattaactaatgtcaccatgct

SEQ ID NO: 479365 - DNA, 737 bp, Homo sapiens
cggtgacccagccaggaggaagagagacttgttgaatggctttgaccaaagcctggtagtgatatggaccataaggtccaggctgaggtggtctcagatggagataaggaacttgttgggaactggagcaaaggtgactcttgttatgttttaacaatgagactggtggcattttgcccctgccctagagatttgtggaactttgaacttgagagagatgatttagggtatctggtggaagaaatttctaagcagcaaagcattgaagaggtgacttgggtgctgctaaaattatttagcttgaaaagggaaacagagcatcaaagtttggaaattttgcagcctgatgatacattagaacagaaaaacccatttcctgaggagaaattcaagccagctgcagaaatttgcataagtaatgaggtgccgaatattaatccccaagacaatggggaaaatgtctccagagcatgtcagaggtcctcatggcagcccctcccatcacaggcctggaggcctaggaggaaatgatatgtctttatcagcagtatgaaaacggactaatacagtgagtttttttggggggacctaggttatatttttgtgaatatattaatatatgatccaaaattgtatgggacttctaaaatagtctgtgctatcaattgtaattatgattattatgttgttattgtaaaccacagaaataaccaaatttccttgtataaatctactaa

SEQ ID NO: 479366 - DNA, 812 bp, Homo sapiens
cagttctttggtggaatccttaggctctcggatacagccgacaccatgggtttcagagacctgaaaagccccgccggcctccaggtgctcaacgattacctggcggacaagagctacatcgaggggtatgtgccatcacaagcagatgtggcagtatttgaagccgtgtccagcccactgcctgccgacttgtgtcatgccctacgttggtataatcacatcaagtcttacgaaaaggaaaaggccagcctgccaggagtgaagaaagctttgggcaagtatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagcgcgtcagaagcattcaagcagacggcttagtctggggctcatctaaactagttccagtgggatacggaattaagaaacttcaaatacagtgtgtagttgaagatgataaagtcggaacagatatgctggaggagcagatcactgcttttgaggactacgtgcagtccatggatgtggctgctttcaacaagatctaaaatccatcctggatcatggcatttaaataaaagcttgaaagattaaaaaaaaaaaaaagaagtagtaaaagtgggcatccttatcttgt

SEQ ID NO: 479367 - DNA, 919 bp, Homo sapiens
cctcccgccaggtccctcccacaacacccatcttccatttctttctcctggacccctccaggctctgatggggatttctcaacctatgcctgtggcactctgctggggcccagaggaaagaatcaagagagcccttagtcctcctgctcagagctttgacctcaagtatgcaacagccttgcatttcagtctggtaattaaggaggatgagcaggatcatgctttgggcaaagcaatacaagggaatgaagcaggaatgcaaagtgagtcccggaggaagtgtagccagcagcagggtggagggaaggagtggcctggaaccaggaggggattgagtcagcaggaaacaaccaaggcagattgtgggagtaagccttcccctttgtttgtgaagaggattcacaacaaagcctggactcctactgataagctatggttcagtgtcacacaggccctgagagtacaggagctatgtgacatggctgtgcctatccacgggcacggctttcttctggatgatttgacaagggcagaactccagcccctaagaatccacatgacttcattgactttgtacttgccgcaaaatgaggggttgtattttccaaagatggtcacaataatgtcccttgtcccacaaagttcagtatctgctgaacctcttactctcctggagcccagccaccatgctgtgaagaagctcaaactagtccacatggagagaccacatggaaagatggagaagccatgtcttcaagtagttgctttttgcggccccaaagtccttggagagctggatcctaaagtccaagtgactgaggcttagaggaaccaatctggggagatcttaagttttctaaaggagccaatgaagttccatattgttcttaagaaaaattgtgcccacaagaaaagaagc

SEQ ID NO: 479368 - DNA, 571 bp, Homo sapiens
tttttgtttgtttgttttgacctcctgcacaataatgaatagaaatgatgacaggggcctaatctctcatggccatgtgacaataacccggctcgtagctgaactaaagaaaaagtcttacaacaggaggaggccattttcacgtcatgtaaaactagaaagtggtaatgtttgtatggaatgtggtaaatggacgtggccaaagtgtcaaaccatcttagaccatgaagataaggacagcataaggtatcacagaagaaacttgggcttctgtaatgggaaactttctggctcatctgatttctctctatctatactccccatctactgcaccacacaagatttggtaccaccttactgcaaagaagccctggattggttttgggaggcaagatgtaaaggcactaaattattgagtggagcattagaaaagcataaaaaagaattcataagaattctccagtgcaaaaggacagacctctatcgaactcgttgttagatcagactagtgacaaaagaaactttttcatagctctgagtatacatttattaacttctagcttaattttaa

SEQ ID NO: 479369 - DNA, 654 bp, Homo sapiens
taaaacctaatcacccttaccccgctcaatgccaatatcccatcccacagcatgctttgaaaggactaaagcctgttatcactcacctcataattctcgtaaaaacacacgtgctctccctgctgatcgtgtccgattaatctcccaaacctcaatcccttacaaaacaacaactcctttccttcctaggcatggaaaagtagaatggactaaaagtctttcaaaaacacacctcaccaagctcagccaccaacttaaaaaggactggacaatacttttaccactttgccttctcagaagtcagacctgtcctcagaatgctacaagagatgcatttaccatgaagccactaaagcttaaacttcagggcccctcaattgcagaggcctcttccatgccccttgcagaacatgagcaatgtgcactgatttttgaaggaattgaaaagacaaacaacaactgtaaccctgtagttttggatgcaaaactgtcctagctttaaggtgtcttgcatatcctcggtccagatgctttcaataactagccaagagataaagaatgagttcctttgtgggaagtttgaaaataaatatgtctgcatcttcactttgtaatctctggaaaaggatgctcatgggtatttaaagaagctgg

SEQ ID NO: 479370 - DNA, 726 bp, Homo sapiens
cccgggtgcttaaacttctcaaaatgactagatattatcctattgaaggtgtgcctcgaaagctgttgagccacggcttcagtcagcacgggagaaaactgcgagccagcattaccccctggactattctaatcatcctcactggatgccacagaggcaagagggtggttttcctgaagcagctgggtagtggtttgttacctgtgactggacctctggtcttcaatcgagttcctctacgaagaacacaccagaaatttgtcattgccacctcaaccaaaattcatatcagcaatgtaaaaatccctaaacatcttactggcatttacttcaagaagcagcagctgcagaagcccagacaccaggcaagtgagatctttgacacagaaaaagagaaatatgagataacagagcagtgcaagatcaatcagaaagctgtggactcacaaagtttaccaaaaatcaaagctattcctcagctccagggctacctgcgatctgtatttgccccgatgaatggaatttatcctcacaacatctttcatctattgtattctgccgtgatttccttttgcttggagctcccataacagacagaacattcatttattattcctttcacttattgacactgtatcctattctaggtactgatctaactatgtggataaagggcatcaaagacttgacaacatgatttttaccctctcgatgtttaaaattaca

SEQ ID NO: 479371 - DNA, 1494 bp, Homo sapiens
gttcatctcccccttataaggacaaagctgaccctattggctctggcttcatcatggctatctgttcccatcatggccactctggactttatgtgttctgtggcttctcagctgggctgctgctgctgggttccagtgttgaagatggccacactaaaaaactcctgggggctacaatttacattgtagtttatgcaaatggaatccctggaattttggagcgcacagccccagtgatctatggcaatggtcctccaaaagcatgctttattcaaaacaacacatactcatattggatgactctcttgatcctgaacctacaagtggaaactgtactcaggttatgtgcagaccaatataagcatctacttgaattttgtgaaaaccagagatcactaggcaaggaactaagggagatctctggcaaccaaggcctcactctaataggccatgagaaattgaattcagccaacaaccacttgacccacttgactgagcttggaagcagatccatccccagttgaactttaagataatcacaacctcagaaaacaccttgattgcagcctgttctgctgataggaagcactagagaaagattagatggcagtgttgccagaaaggggtcctgatccagaccccaagagagagttcttggactttgtgcaagaaagaatttgagagaataggtataattagcatagcacttgccacataataggaatacaatagcatataattgaataaatattcactggaattagcaacgaggatgccaatggtaaccttgaggaaatgacttcagtgaaatattgagagggtgtgacagaccaggtctccattagcaaccagagcagtcagccttcaccaatatcttagtgtaactctaatgaatgtacaagttaaacattaaagaactggagaaactggtgccttactacaaagcctagaatgtacaaacaggtccattaagaccatgtctgggctttctcagaccttagagtttaattaaaataatggagacattcttgcataccttgtaccaggacccactttagattaagtaatttttgcaaggctctgaagtagttgtctagaccgtggaccctagttaagattaggtagagtgaaacactttggctttcggcttgtaggtgcactgaatgtatataagcactagaaaaaacttgtaactttgagttggtatgatgagttggtctgatgagttactccaaccttctccctgtaactggttgcagaaataaattcttttatgaatatatataagcactagaaaaaacttgtaactttgagttggtatgatgagttggtctgatgagttactccaaccttctccctgtaactggttgcagaaataaattcttttatgaatatatataagcactaggaaaaacttgtaactttgagttggtatgatgagttggtttgatgagttactctgaccttctccctgtaactggctgtagaaataaa

SEQ ID NO: 479372 - DNA, 1084 bp, Homo sapiens
tttttttttctctctccctccctcacaccgtagcggcgcgcgagcgggccgggcggcttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaaaaattcagaaggagctagctgaaataacccttgatcctcctcctaattgcagtgctgggcctaaaggagataacatttgtgaatggagatcaactatacttggtccactgggttctgtatatgaaggtggtgtgttttttctggatatcacattttcatcagattatccatttaagccaccaaaggttactttccgcaccagaatcgatcactgcaacatcaacagtcagggagtcatctgtctggacatccttaaagacaactggagtcccgctttgactgtttcaaaggttttgctgtctatttgttcccttttaatggactgcaaccctgtggatcctctggttggaagcatagccactcagtatttgaccaacagagcagaacacgacaggatagccagacagaggaccaagagatacgcaacgtaattcacataatttgtatgcagtgtgaaggagcagaaggcatcttctcactgtgctgcaaatctttatagtctttacaatacggacttctgtgtatatgttatactgattctactctgcttttatcctttggagcctgggagactccccaaaaagactaactttgttagggctgtgagggaaaaaaacgctgtggcatgttgatcgttgtgggaaaaatcaacaataacaataatgcaacaatattaatagttatcatttctgtgtattctagggcaagttacctagcctctctgaacctgagtttcttcatcaatacaaagaagttaacagtacctacctgatggcactgttgccagagtaatgaaatatataaccattgtctatggctgtgtga

SEQ ID NO: 479373 - DNA, 1574 bp, Homo sapiens
aagcccaataactttctcacacaggagatagaaaccacaccaagatggggtctcactatgtttcccacgatggtcttgaactcctgggctcaagtgatcttcctaccttagcctcccaaagtgctgggattacaggcacaaaccgccacacccagactccatcctattctttaaacaaactaggcatcctcccaacacaagtccttgagaagaaaaccttactgttttctctgcctggaacaccctttttcccaggtatccacaggccttctccctcatctcttctggaagtttgcttgaatgttaccttcacagtgaaacttcttcttaccagcccatttaaaaatgtactcccccaaactcagcccttcccatctttcttccattctttaaatttcttcatattgctattcaccatcttacatgtcatacttacttgtttaccatctctctctctcttccactaaaatataaactttatgattattcatattttgtgtattttattcactgctatatcaccagcacctagaacagtgcctggaacaaagtaattgataaataattatcaaacaaattaatgagtgaagaaagaaatgaaggaatgaattttactacaggatataagagatgttgaccttaaactatttcagacggatgcttaaaatattatctcatggtggccacccattcagtggattacagttgaatcctgttactgactaacagcatatatgccaaggtttaacagccttaattgtgtgagagttatttctatctgacttgcagaggtttaaagagatttctgttccttgctcagtaaaagtggataaaactagttagaatgcatcatatgattatattatccagggtctagttagaaatacagaaaccatactaggtacttcaactgaagaaacttaatgcaggcaactgaccacacaatcattggagggtagaacgatcaaaaagggaagattgaggcaatccatggattataactataagaaggagctgctactgctggggttgggagaataaaatacagagagggatgatcaaaactaagaagcttgaaaagtatcatataacccaataattccacttttatgtacatactcaagagaaatgaaaacgtatgtctacacaaaacttgtgcacaaatgttcatagtagaagtattcataatatccaaaaaagtagaaacaactcaaatatccattaactgatgaaaaaacaaaattggtatatccatatgatggaatactactcagccatgaaaaggaatgatgtactcatacatgttacaacacggataaaccttgaaagcatcatgcgaagtgaaagaagccagacacaaaagccaaaaattgtatggttttacttatatgaagtgtccaaaataggcaatcagtagagacataaaagcaggctagtggttgcttagggctgggggagaggtggaaaatgggaagtgactactgattggcactggatttcttttggggatggcaaaaatgttctaaaattgggttgtgttgacagttggacaactctggagtatactaaaaacc

SEQ ID NO: 479374 - DNA, 756 bp, Homo sapiens
ttacaagccagaagagactatattccctgcccctagaggtggaatctagagaggcagtaggccttgctgagctgtggtgggctccacccatctcgggctaccctgcagctttgtttacactgtgagcatagaaccgcctactcaagcctcagcaatggtggatgcccctctccctgccaagctcctgtgtcccaggtcgatctcagactgctgcactagcagtgagcaaggctctgtgggtaatgaggaaaaaaacctcctgaagtgtgatataaatggccttcaagaggcattagtgtgtaaggaccgaaaaaaaaaaaatcctttacttcaagtttattgcagagaggagcatttcatattagccaaaatgggaatagcaaagggtgaggcagaattttgcttcttaagtgggtcaatagatggactattcagctgggatggctgggatggctgggatggctgggatggctgggatggctgggatggctgggatggctgggatggctgggatggctgggatgactggggcctctccccttatagtttctcatcatccatctggctaacttgcacagtttacgaagctgcagaatatgaaagtctgaactaggttgccctttatatccatgccccaagagggagataaaggaactatttattaaacgtatacatataatatgttcccaacctgtgctaggcactatgtatgtgtgtgtactttacatgtattccatataaacatacatgtattct

SEQ ID NO: 479375 - DNA, 911 bp, Homo sapiens
ggtctagggacttttccgtggctaggatgcaagcatcatggtggaaatgtggactgctgtgggtcactcacttaccctttcctcatatatccaaaagaaataatatgtcacacataaacttgtacagaaatgtccacaacagcattatttataagagtccaaagtggaagcaatccaaatgttcatcaattgaagggcttcatgcttcattgaagaagatgacttacttaaatggttttgataagcatagagctgaggctgacttccaaataaaacttctaaaaagttctcaaggtcaatttaaaggagaatttaagctgtcttatgtcattaataacaagggtaaccattctgaagacaccgaagcacaactttcctcaattcacattgagaaggcagccatctgcaagccaagaaaagaggcctcaggaaaacccaactctgctggcaccttgaccttggacttccagtctccagaactgtgagcaaataaatttctgttgctcaagccatccagtctgtggtattttgttacagccctggcggactaacacagagactcatagaggaatgtctccaaaatagttcctcccttcacttcagggatcactgtcctgtgctacttgatatagtgtctgtaaatcatttttaaatatatgttttttccattttaaaagttgctttagacagagagtggaaaaatacattgccatacaaggaaaaaaaaggaaggaaggaagggacggcgggggggggggaaggagggaggggggaaggagggagggaaagagggaggaaggaaggaaggaagggaagggaagggaagaagggagggagggaaggaaaattctccaggacagaaattagcaagctactgtcctaccacctgttttgatctttgtgatttcatt

SEQ ID NO: 479376 - DNA, 1077 bp, Homo sapiens
cagtgaaccttcagaggactgtgtctggctcctctggtaataagagggatgggagcagaagtagtaaagggtccagaaaggcctcatttgattggcacccatgtgccattgatttcctctggttgtggcaaacacttaagtctgactctttatcaggaaggactctcagctgcaggtctgttggagtttgctggaggtccactccagaccctgtttgcctgggtatcagcagcggaggcctgcagaacaacggatattggtgaacagcagatgttgctgcctgatcgttcctctggaagttttgtctcagaggagtacccggccacattgcaggttgccactcccagctgcccgccacaattctggggtgatctcagggtttatgtttcctcctcaacaaagacagcagaggaagggaccttagcagtgattgtggcccaagggccttttacttgtcacctggggctccaccccagacagacgcaggcgatcagcagaaaacaacagcctgtagaacacattaccaaggagcagcaggcagccaagttttttataactgggctactagccgccaatttaaagctttaatcggaacacgcttacaccacacagaagtctgtttttctgcacaacataaatggaaggggacaaaacactgctgccttaatttacattgatatttttaaacatgattttggctttgagttggtaaacatgctttggaaaatgcatatccaaaaaatgaaggatgctaaaaataagagaatgtatgtaaatatacatgaaaataggtctttttaaaagttacgtccactaccacccttaccccctaccttttaggttaacttgcaactaattggctctggcagtattagactcggtccttacataatgccaccaaatgtttctctgtcttttagttactaataacactgtctgccatagggaaggcaaataacttcattctatttcatttgaattctggagagcctttttaaattttgatattttcagttccatgctgaaaacaagcactttccaagaaaaaaactattttggaggtgacttattgagggc

SEQ ID NO: 479377 - DNA, 552 bp, Homo sapiens
ggaggagccaaacaggaaaggatgataaggatgaaaagccaatgtaagtgtgtcttatcaagagaatgcatggcatcttcaggaataggggaccaagaagaggcaaaagcacaatgggatgagttaggaaaaaatgcggagccccgggagaaaactttgaggaaagcccagcctattaaaacccatcagagctggcaccctttgggaagaataccagaaaattggaacaaaaaagaggtgcagcttacctcacagcaggaaagaagcagccttttaattggattaaatctcatcaccacaaaacttatggatcctggccactgtgccaaagagacaaacttctgcctgatctacagaactctagaacatagtttcaagagatacttcaactggtttgtcaagagaaacaccagaaagaatccttgagcaagtttcttagacattgctttgccgcatttaggaggtttatgattacctctgagttacaatggtattcattcttcatgaccaaaagagaggactgacaatgtaaaaatgtatttcagctctctg

SEQ ID NO: 479378 - DNA, 551 bp, Homo sapiens
taggtaaaagggaccaaggcataggagcctctttcaatggctgccaccaccaaagacccatgctggcaggcaggaacgttaagtctgctgaagctgcgctcacagttgccccttcccccaggtgctctgtctcagggagatgggagttttatctataagcccctgactggtgctgctgcctttctttcagagatgccctgcccagagatgaagaatctagataggcagtccggctacagcagcttttcccagcttcagtgggctccgtccatttcaaacttcccggcatctttgtttacacagtgtggcaaaaactgcctactcaagcctcagtgggaattgaacaatgagatcacatggacacaggaaggggaacatcacactctggggactgttgtggggtggggggaggggggagggatagcactgggagatatacctaatgctagatgacgagttagtgggtgcagcgcaccagcgtggcacatgtatacatatgtaactaacctgcacaatgtgcatatgtaccctaaaacttaaagtataataat

SEQ ID NO: 479379 - DNA, 555 bp, Homo sapiens
cagcagcatctgcagcagggcaatctcagcaatagtgcagtttcagtagaagcaatggcacttgtagcaccaccagaagatcaacagcaatgtgggctgatgggaggcctcaaggaacttccaatcatcttggaaattgaagggaaaataaagcacttcacaaagccagagaaggaggaaaagagagagaggaggggtgccacacatttttacatgaccagatctaacaagaactcactcactatcgcgaccaagggaaacagtgctaaaccattcatgagaaactcctcccatgatccaatcacctcccaccaggacctacctccaacactggggattacaacacgacatgagatttgggtttatgggttcactggccctgccatcggggtgcttcctgggacaacagaaggctatattctccagctgagttcaggcagaagagggatccctgaggtggaagtctaacaggcattgcctgcctagctacaagcagcagggcatattttttatttgatggtgcaattcagtctccaatgaagtaggtgaagcttt

SEQ ID NO: 479380 - DNA, 605 bp, Homo sapiens
ctgtaagtccatcaaacgcttttcttttgtaaattgccaagtctaagaaaatatgtttcaaatgcctctcattctacagcttcttttggaaatggtttccattgttgttagcaggtgtttttctttgatagcagtaaagagagataaagagcacatcagagtccagcttaaagcagcagtctggctctgttttggtagaacagctgtgctctggtgggggatcccttccatccctgaatattttgatttggactctcctaaacccacaagctgcaacagctgtcatccaaaccgcaaagatggtagccaggccctctcccagggaactctgtcccatccaagtagtacagttgttaaagatgctgatgatgcgtgctcaaaagaaaatgaggaagacagtaaaaaggttgctgtgcttctggcttttgaagatgaaggggccatatgccaagtaaagtccaaagtctgatgtgttggtgaaatttagcatatacatattttaaaatatacttgactttaaaactttttgaaaatgaattgcattttatttttttcaaggtggctgaatattgatgtcagatgccaattcccctcagagagaatat

SEQ ID NO: 479381 - DNA, 592 bp, Homo sapiens
caaagaattataacaggatgttcagatgtgtctggagcttcttccttccagtgggtttgtggtctcacttgacttcaggagtgaagccccagactttctcagtgagtgttacagctcttaaaggtggcgcgtccagagttgtttgttcctccttgtgggttcgtggtctcgctgacttcaggggtgaagccgcagaccttcacaggatggtcgctggagagtctttctctgccatcttattctgcctgtcttctcttgcttcaccaactgacttcagcaggctcagaccctggataaaattcagtggcaggcagactgcagctgctgtatgccttaggatgtcttcctctatcactaagctaaagggaaaagtcaagctggaaactgcttatggccaacctgactcctattctgttcaaagtcgcccctccgctcactgagataaatgcacatctgattgcctcctttggagaggctaatcagaaacccaaagtaatgcaaccatctgtctcttatctacctatgacctggaagccccctccccctttgagtcttctcacctttgcttcgtgttatcccgtctttccagacc

SEQ ID NO: 479382 - DNA, 719 bp, Homo sapiens
gaatactacgcagccataaaaagtgatatgaacttaaaaccagaaggcaaggaggagcgagttacatcttacgtggatggcaacaggcaaaatgagaacttgtgcaaggaaactaccgtttttaaaaccatcggatctcatcagactcgttcactatcacaagaacagtgcgggaaagtcctgcccccgttcacagggtacatgcgcagttttgttatatgggcctgcagctcagatatgtctcagtcccaagaggaagcagtcccttatttctccctggaagttagcttggaccagagcctctcagagggagatgagcatccctggggggtcagcccttattgctgggctctactagagctgtcccatgcccaaatgtccctggctctgtgcctgctgcagcttcatctctgcctaatctctgaggagatccccctgccagctaaaatgtctgtggatgctgcaggaatcctctgaagctaggatcccagaggtccacagcaaaatatgatgttgactgtgggtttgaaatatatagtttctattactttaaggttgtgactttaatatgtatagtttattattgcctaatttggttcttggtgcttttaggggtggtgattatgtatgagttacttagttatagacagtcattttgtgctgctttctcagattctggttgtaatagttatgtacttggtgtataggcaaagttcact

SEQ ID NO: 479383 - DNA, 1624 bp, Homo sapiens
aagtcaccacttctctgtccagtatgccccagtgtctgttgttcctctctttgtatccggtggtgatttcccctcggtccgtggctgatctacagatgccatctgggaacaagggccatgagtctgaaaccctaggaatctacctggttcactatgctagtgtggctgagctgtcacccaagccacaagtcaaagtctttcctattttctctcctgtttcctcaagcatagaagtttattccctcagtcaccatcacccctggcttacagcaagtactgcctggctaccgctgatggtcaaacaaagcccaagagttctcctgtcagaacgtcagaatgtgaccctatttggaaatctgatcttcacagagataatcaagttaagattatggtgggccttaatccattatgacttacattacaaaaagggaaatttggacacagaagcacacacaggaaaatgccatgtgacaattaaggcagagatcagggtaacccttctacacacaaaggaacaccaaagattgccagcaaaccaccagaaactagtggagaaacatgcaaccgatgcttcctcacatcccccagaaggaaccaacctgcccacaccttaatctcatattactaacctccagaactgtaataatatttgctttatatatctaggtgcaccagttttgaatacatatttatttcaaattcttatattctcttgctgaattgatcactctacataatgacctatttttctctttttactgtttttgacttaacatccgttttatctaagtatagctactcctactcacttttggttttcatttgcatgaaatatcttcttttcatccctttatttttattctttatgtgtctttagaggtgagatgagtttattttaggtagcatatagttgcgttatgacttttttattcattcagccagtctatatcttttaagtgtagagtgtaatatatttacattcaatgttattattgatatgtgagggcttattcctgccattttactaatttctatttgtttacgtgtccttcagttgtttctctttcttttgtttttaatcattgtagtttggtggtgttccgtaatggtaacatttgagttttttctctcccttatttatgtgtttgccataccagtggattttatactcccatgtgttttaatgatggtagatatcctttcatttccaggtgtagggctccacttagcatttcttgtagggttggtttagtggttatgaattccttcagattttgctcatctggcaagaactttatttctccttcatttttgaagggtagttttgctggctgtagtattcttggctaaatgatttctttttctttcagcaacttaaatatatcatacctttctttcttagcctgtgaggcttttgctgaaaaatacactgttagtctaatgggaattccttcatatgtaactttatgcttttctcttgctgtttttagaattatctctttgtctttgacttttgacagtttgactataacgtgtcttagaaaagacctttttaggttgaatctattttgtgaatatactttgagcctcctatatctggatttctataattcttgcaagattt

SEQ ID NO: 479384 - DNA, 1173 bp, Homo sapiens
ttatacatgctccgtgaaggcagggactttgtattcattgatcatgggacacaagtcaaagctcagtagcggttttactcacttccacttccagaagcagatactgagcctcacatctgctaagattgccctgagtgagagtcttatctcctgtagagaaagcactgaagttgtggaaaagcagacacaagctcttatcatgcgagtggctgacctgcaacgaaaggtgcatgcacagccttgccaggtgcctactgttaaagtgaaggataagttgctgcatttggcccctcctacaaccaagaaagaggcccaacacctagtgggcctatttggattttggagggaacacattcctcatttgggtgtgttactccagcccatgtatcaagtgacccgaaaggctgccagttttgagtggggtctggaacaggagaaggctctgcaacaggtccaggctgctgtgcaagctgctctgccatttgggccatatgactcggcagatccaacggtgcttgagatgtcagtggcagatagggttgctgtttggagcctttggcaggcccccataggtgaatcacaatggaggcctctaggactttggagcaaggcccttccattttctgcagataactactctccttttgagagacggctcttggcctgttactgggctttgatggaaactgaaggtttgactatgggtcatcaagtcaccatgcaacctgaactgcctatcatgaactgggtgctttctgacccatctagacataaagtgggtcatgcacaacagcattccatcatcaaattgaagtggtatatatgtgatcaggctcgagcagttcctgaaggcacttcggtgaagggaaatcttcccagtggacagaacttcaagcagtgcacctggttgtgcactttgcatggaaggagaaatggccaggtgtgcgattatatactgattaatgggcatagccaatggtttggctggatggtcaggaacttggaagaagcatgattggaaaactggtgacaacgaaatctggggaagaggtatatggatggactgctctgagtggtcaaaaactgtgaagatatttgtatcccatgtgagtgctcaccaacgagtgatgtcagcagaggaggattttaataatcaagtggacaggatgaccc

SEQ ID NO: 479385 - DNA, 693 bp, Homo sapiens
actaggcgctgagaatgggaatgtcagaaagcattaagggactcatgtcccttgaaatatgtataatgattttcatcattttagagacgataaaactgagaatcagagaggttagatggctctctcaaggtcacatggctaggaggtggcagatctgggctttatctaacgcatgcctgtctggattccaagccggggccctttttgctatggagtattccctccctttgtggcaaagcttcctgctcctaacacccctgagttctagactcacagacctgtgcccttgggactttatcagtgctataaaaacaggattctgtggaaggagagacttggaaaagaaagagacacagagacaaagtatagagaaagaaaaatgggcccaggggaccggcgttcagcacatggaagacccgcgccggcaccggcctctgagttcccttagtatttgttgatcattatcgggcgtttcccggagagggggatgtggcaggacaataggataatagtggagagaaggtcagcagtgaagtaatgtttacttggatattcttgatacttgtggatgttcgttggtgtctggacattgcagagttatgtattcattgtagtcttaatagtctggggtttatatccatccttcttgggaaggctttccaggtatttgaagagacttgagcattgccatct

SEQ ID NO: 479386 - DNA, 573 bp, Homo sapiens
ctcctcaagtgccgccaaagtgggagcccaggcagaggaggcgccgagagtgagcgagggctgtgaggactgccagcacgctgtcacctctcaacagctggggaggcctcaggaaacttccagccatggtggcagctgaaggagaaatgggctcccagaacaaaaacactgaggcaggccctccatttgccagaggctcacagaataagcacctccccattgtggacattagtagtgaagacctaactgccacagccaaagcccttgcaatagcctgcaagtccctgttagctctcaaactcattgcctcctctctttgcctttacctggtggagtatatgagagatgaggacaggctagaacagcaggccccacatttagaaattagcctgccaatattttttaaaagagaccctttattgggcacctactctatgccaagtttcaagccaatcacttttacacaaattattgacctttctcagccactctgtgagaaaagtattgttattatacccatcttagtgatgagagaaccaaggcttggagaggctgagttactttcttaaggcc

SEQ ID NO: 479387 - DNA, 865 bp, Homo sapiens
ccaggaaaagaaggatccaggtgcctcccaggccctgtgagagcccgagtccttgcttggtagcatgctagagaagaaggtggacgagttggtgaaattcctgagtgtcaagtatacaacaaaacagcccatcacagaagcagaaatgctgaagggtgtcatcaaagaacacaaggatcacttccctccgatctttatgcaagcccatgaatgcatggagattgtctttggcactgacatgaaggaggtggaccccatcagccactcctgtgtgctcctcaaatcactagacctcacctacgataggaggctgagcgatgaccagggaatgcccaagaccggcctcctgattcttaccttcggtgtgatcttaatggaggccaactgtgcctctgaagagaagatctgggaagtgctgaatattatcagggtgtatgctgggtggaaggatttcatctatggggagcccaggaagctcatcaccagagatttggtgcaggaaaaatacctggagtgctgtcaggtatccaacagtgatcctccaagatacaaattcccgtggggcccaagggctcatgctgaaaccaccaagatgaaagtcctggagtttttctccagagtcagtgggagtgatgccagttcctttccactcctgtatgaggaagctttaagagatgagaaagagaaagctcaggctataattgccaccatgggtggtactactctcatggccagtgcacattcctgggccaagtccagcagcttctcttgccctgagtgaagtctcaggcagattcttcactctgtgtttgaaaagagaagtcaaggttttaagtagtgaagggctgattgcagatttttatct

SEQ ID NO: 479388 - DNA, 724 bp, Homo sapiens
tcatcagttaaggcaggaacaggccattttcatttcttttgtggtggaatgtcatcagttaaggcaggcaccggccatctggatgtgcaaaagttcatgacggcttggatgaggtgatttgagaatgagaaatatgaggggatcgaagtgtccctgccaatattttggctgctgcaaagatggcgagcataatgtttgggtatgtggctccattctgcctgaacttagttgccataatggttctataaaggagcctttaagagagggagaatctcaaaatttcatggagtcacaaataaggtttccttgtaagggacaatggtctttgagggagaaagaacacaattcaaactataacacctatccaccaactctctcaccttcctccacccctaccttttcaagggtctatttctgtgcctcaaattctgggcatgtccccaaaccactagaattcggcataagatataaagccagagagcataagaattacagaaacacttcaagtacaatgcaaggggcttttctcctctccaaatcatgtgacagtaagttgccagcctgatataatcacaacgtgcccatcaaaatcaggaaattaatatttatatgtaaatacagtataattcttagaactcattcaaacttcaccaatcatcacaacagtgtcctttatagtgaaaggacctagttcagaatcatgtgttatatttagttgttatgc

SEQ ID NO: 479389 - DNA, 686 bp, Homo sapiens
ttaacgtccagtgacttccaaaatggcagagctctgcatatgtgatctgactccactggtctttgaacatggccttggatgcatttgtaaactgaataatccttgctcattagcatttgaagaagacagagattggaacagtttggaggactcaggggatgacaggaagatgtggaaaggtttagagcttcccacaagagacttgttgaatgcttttgaccaaaatgctgatagtgatatggacaatgaagtccaggctgaggtggtctcagatgtaaatgtggagcttattgggaactggagcaaagatgagtcttactatgctttagcaaagagacttgtggcatttttcccctgccctagagatctgtggatcttcgaacttgagagagatgatttagggtatctggccgaagaaatttctaagcagcaaaactttcaagagctgaagctcgagtcccatgatcctttcttcttatgagtgtccatgctacatactgcttacatttttctcccatttattcaacagtattttcatatgcaaaatgaggataacaatagtatctacttcatagagttaaatactcaataaatatgtgctataataataaaagctctgactcccagagtgcctagtgcagagtttcacatatgatgaatactaatgaatagagtgccattgaaat

SEQ ID NO: 479390 - DNA, 533 bp, Homo sapiens
ggagacagcacacatctctagagctgtcctgcgtctacacaggagtgccctttggcatcgcggacaggatatgagagatcaaatgatgagtcaagaaggggtctctgctgagggaatcccggggtggttggcaatatgcatgtgtggtggagttgcccagatgctcaaccgttttgagccaccatctgagacaagtaatgaacatgaaacgataccacctgccaaggggatactcttaaatcacccaaacaatgcagaaattacacaatttacaagcattcaggctggccaagacccccataacagcactgtgttgcctgtgaagaagccagatggcatctggacaattacagtagactactgtaagcgaaacaaagtgatgatccctgtacatgcaattgtacacaatattgttcaactgctagggaaagtggtccttaagctaggaagtgtccatgctatcattgacttggttaacacctttttcagtattcctttatcaggagattaacaagaccagtttgccttccctt

SEQ ID NO: 479391 - DNA, 643 bp, Homo sapiens
gcctgctcaatggtagccattctgactggtgtgaagcaatgctgaattctatgtctgtcatttccaccctttcagcctggttcagaaccattgcatggggaactagcatggtcattaggagtgacagcaggattcatgctcctacgtgtgtgccaatagcagtaatgatgcagcagggtgcacatgcattggcggggatgggacagcagcagggggataaagccttggtcaatccatatttgattgtggtggataagcttttggatgtgctgcaggattcagtttgccagtattttgttgaggatttttgcattgatgttcatcaaagtaacatgacattaaaacaaggtactgcagaacattggcctgtttttgttgttgttgttgttgttgttgtcgtcgtcatcgttgttgtttccccagaagatgactgtgcagaccacacagcttgcactcacccaattggatctccctctggtgtctgctccagaagcaggcccaaccagctaggttttttccctagccttccatgcccagattgctgggctttttcatctgtcccaggccatgggctctctaaagcagaagctgtgcctggccaataggctacacccttcctggacctgtgttatggagggaggga

SEQ ID NO: 479392 - DNA, 664 bp, Homo sapiens
tgacctggatatgagacaaggagtcaaaggagatcattttgaagctttaagatttgactgccctgctggatttcagacttgcatggggcctggaataggcaagaaagatgtcaagaaagagatgctgcaactgggctttgaaggcaggggtgatgtgactctccctatctccttcaagttgtcttatctccagtgggtctggcaaggctactctgagagtagtgataggggagagaagggaagtgaccctacctatatttacaaccaccgaagtttaagtgtgagtatgattgttaagacactggcaccaagttcaatcgggggccttggaatttcaatcagttctgaccacttcatgtccaagtccttcaccttccagacccaagcagatggtcctacaaagccccaagaggccacagaaaagaataatttgagaggtcctaaagtactggatcaattatgttttcctttgttggaggacagacaagaacactgagatccagatatattttggtgagcaggtactttgtcaccattacacttacagttttccctcaaacacttagctgattctggcacaaaactcaccttggaatttggcctaaatttcataagatttattgcttcttcaaattgacccacaagttaagtgagggttattttc

SEQ ID NO: 479393 - DNA, 523 bp, Homo sapiens
caatcatgtaagatagatctgttctccctattttaattagtgtttctattatgccctcagattttccaagggagtctaagcctccaaaatattacaaaacaaaactggaaaggttttatagcaaattactaatgaaaagtagaaatggtgtctcttctgccatcttggaggaagtgcgtggtttgccttctgttcactattacccttctaattttatctctatccatgaggaaaatggtgtaaatcgatctggaaaccttgagactgtgtctgttgcacccacgctgtgtttgtgtgcatattccaagacaaccaaggcagacatttttgttgttgttgttttagcttttctttcctggacttataaggactcaaattgtctcctggcaaaagtgtcctcaaaaggagaggacttcagcagcaggaagaaagcaggcaataggagataagaaagtaagagggtagaacttagtgtttcaggctcaaatttaaagcctcacctcaccatttcttgctgtgcaca

SEQ ID NO: 479394 - DNA, 740 bp, Homo sapiens
cactgtgagagatgaaggacttcaccatcacccgtgggaaggcgcacgcagaggatccccaggagcacatccacacccaatgggtggatgatgacaagaacgttagcaagggcgtcgtaagtcctatagatgggaagtccatggagactataacaaatgtgaagatattctatggatcagaatgtaaagcaaatggaaaagtcatcagatggacagaggtgtttttcccagaaaatcctgaccagcacaattgcctcagtgatcctgcagatcacagtagattgactgagcatgttaccaaggctttttgtcttgctctctgtcctcacctgaagcttctgaaggaagatggaatgaccaaactgggactacgtgtgacacttgattcagatcaggtcggctatcaagcagggagaaatggccagccccttccctcgcagtgcatgaatgatctggacagcgccttggtgccggtgatccatggaggggcctgtcagctcagtgggaattgaacaatgagatcacatggacacagaaaggggaatatcacactctggggactgttgtggggtgggaggaggggggagggatagcattgggagatatacctattgctagatgacgagttagtgggtgcagcgcaccagcatggcacatgtatacatatgtaactaacctgcacaatgtgcacatgtaccctaaaacttaaagtataaaaaaaaaagtgtttggattggctc

SEQ ID NO: 479395 - DNA, 884 bp, Homo sapiens
agcctaacacagatatgaagttggaaatggagaggtgttttattagcctttccaggaaccctggctgtgtcacacgacccagtcaagctagtaactaccagtcctctaccagcagagatggatattcctctattctctggcagtataactcagagatgaaggacttcaccatcacccgtgggaaggcgcacgcagaggatccccaggagcacatccacacccaatgggtggatgatgacaagaacgttagcaagggcgtcgtaagtcctatagatgggaagtccatggagactataacaaatgtgaagatattctatggatcagaatgtaaagcaaatggaaaagtcatcagatggacagaggtgtttttcccagaaaatcctgaccagcacaattgcctcagtgatcctgcagatcacagtagattgactgagcatgttaccaaggctttttgtcttgctctctgtcctcacctgaagcttctgaaggaagatggaatgaccaaactgggactacgtgtgacacttgattcagatcaggtcggctatcaagcagggagaaatggccagccccttccctcgcagtgcatgaatgatctggacagcgccttggtgccggtgatccatggaggggcctgtcagctcagtgggaattgaacaatgagatcacatggacacagaaaggggaatatcacactctggggactgttgtggggtgggaggaggggggagggatagcattgggagatatacctattgctagatgacgagttagtgggtgcagcgcaccagcatggcacatgtatacatatgtaactaacctgcacaatgtgcacatgtaccctaaaacttaaagtataaaaaaaaaagtgtttggattggctc

SEQ ID NO: 479396 - DNA, 630 bp, Homo sapiens
acctctaaatgatcttctgcttcattcactctgtcttcctcctctctctcgccaattctcaaccatcagctcttctctttatatacttatttccttaaaaaagcatctgcagaggagcctctccttgtggtcaccatgaccagcgacacacgggttctgccagcctactgccaacattcacttaaagtcccagggcccttaagtcagctggtgataaatgctgccaggcctggcactcacccttcagagcagtgggctcccctctgtcccagggaaggtccacaaatgctgactaagtgcctaaacatagactggactcagagtccccaagagcctatttgctgctctaccctactatggctgagctggtacctaaggtgcaagatggagtcccctttactttaccccatgcttttctcaaatagaaggagagtttcactgcaggcaccacagcttggaatgtgctgggtcagacctgaagccagcatttctcagagctcaacacccacagcatattacctgggtattgctgttggtttgttatccagagctcaggggctctttagtcaacagctgattaatcctgccaggtctctgctgtaattgggcagcactgagttcaatgtaaag

SEQ ID NO: 479397 - DNA, 720 bp, Homo sapiens
ctacacgcatggtgcaggaccccagccgattggatggtgcctgctcatattggcgagggtagatctttactgagtccactgattcaaatgccaatctcttctggaaccaccttcacagacatatccagaaataatgctttatctggatatctcaacccagtcaagttgacacctaaaattaaccatcacaactaccatcttgatgcagacaactgcaacaatccaccagctttaggatttgccagcagtgataggcaaatgatcactaatgggcttaaaccaaatcaactgcacttaaagaggctgcagcccaagtggcttgtggaaaacgaattcaatgaacctacagctgtgtttatatcactcgatgccctcctgacccttttcaaaatagcagacctccgtaccattcaacagttcctgcctaaatcttcggtccaggagactgccccacagttccaattgagttgacctgtttttatgcttttcatacctgaaacactgttatttatggctttagataattttttcactatgattttttactttcttatccagaatttaaaatactaatactaataattaatatcctggatgacctatattgcaaggatgggatacagtaaagaaaggatgaatctttgtctcctaggagaggaaaacaagccaccttctgttggtataaatgaccatggtttcaaatgggcatagcattgagag

SEQ ID NO: 479398 - DNA, 617 bp, Homo sapiens
ccaggttctttatggtacttccaacagctggacctatagcaattgcctgcgggtatgtcttcccttggacaatagtctgtccacctttgcttccagttgtcccacctttccagacagaaccaatgttcatcttacatatgttgattgatgtttcatgtttccttaaaatgtataaaacccaactgtgctctgaccaccttcgacacatgtcgtcagatcctcctgaggttgtatcactggattcaccagaggcactggttgggcctctgcgctcctgcttgactgttctgactttgaacaggtttattcagctgctgtctgctaagccctacagaaaagcacaatggctgctgatcggccttttatggtttattggaaactggtggtccgcactgcagctctgtctatcagaaaactactagaactgataagtgaatttggcaagttcaaatgatacaacgtcaatgtataaatttctatatacttgctataaacaattggaaaataaaatttaaaagaataccattttcaatagcatcaaaaaaaaccatggaatacttagagataatttaaacacatgtgcaagacttttacagtaggcagtgtaaaacattgtc

SEQ ID NO: 479399 - DNA, 681 bp, Homo sapiens
ctcccagaaataattagacgaaatggagactctgaagtggggatgaggagttttccttctaacagtcaggcccctcttctgcaggtctgctggagtttgctggaggtccactccagaccctgtttgcctgagtatcaccagcagaggctgcggaacagcaaagattgctgcctgctccttcctctggaagcctcgcccagagggtcacccacaagatgccagccaaaactctcctgtatgaggtgtctgtcaacccctgctgggaggtgtctcccactcaggaggatgggagtcagggacccacttgaggaggcagtctgtcccttagcagaacttgaatgctgtgctgggaaatctgctgctctcttcagagccagcaggcaggaacgtttaagtccgctgaagctgcatccacagccactccttcccccaggtgctctgtcccagggagatgggagtttaaatataaagacactttaaatataaagacactttagatataaagacacatatagattaaaagtaaataaagataaactatgataacactaatcaaaacaaagtggaagacactttaaatataaagacactttagatataaagacacatatagattaaaagtaaataaagataaactatgataacactaatcaaaacaaagtggaagatactttggacctc

SEQ ID NO: 479400 - DNA, 496 bp, Homo sapiens
tgttaccaagcacactgataccccccaactcccgcataatgcagtacccaaactggctgttactgtcctggtccattaatatcatcagcttgatcgtgcctctgctgctactgaattatgaagaatcagagcctgcagggctggaagccaaatccacattccccaaagctccaccacatacttccagttggggaactgatatttggatgtctttgaaatccaagaatacctactctgctcacatctggagggaaagagaagacaccggaggattaaccaccctcaaacatctccctatacagaaaaatagctggtatttatttcctagcacttctctggcttttttcctatctccggctggcaggcttgtctcagttgcagaggcctcatcccacccaaccccttccactccctattatcccccttcgtgcccaaaagtgcagctgcagactccatgagcccatccctctgaggcaccaatctttaacatgtgtct

SEQ ID NO: 479401 - DNA, 652 bp, Homo sapiens
tcccacgagtccttctatgaataagtctcatgagatctgatgggtttatcaggggtttctgcttttgcttcctcctcattcttctcttgctgctatgtaagaagtgcctttcgcctcccgccgtgattctgaggcctccccagccatgcggaactaatgaaaaagagttgaataaaaatacagccgaaggggaaaatgccaccaattatgatgccaagaagtggttttgtaaagaagttctatggaggaatctgacaggggatctggatgtaatttccacagcctactcatccttgcaccttcaaagtctagcagaaggagttttaaattggttgctcaaaatcaacaggccaacttctaagtctactggatacatcaccaggcaagccgagctgctgtgcccctacttatttggtacaccagacaagtttgaccaaagctacaagtggagatggataggaagtggtaagaagctgtataatgtggtgatggttaaaatgaaaagagatggatataaaagacatgaagagttaagaatacccatgaaacaaatgtgcacgtgtacccctgaatgtaaaataaaataatttaaaaaaacaaaaaaagaattaagagacttgtggttaaagatggcagataatttaactcacac

SEQ ID NO: 479402 - DNA, 635 bp, Homo sapiens
tgtccctgcgatagtttgctgagagagagcagccccatgacgtgctacaagccgcaaaaagaggatctacccggatcaataagccccataaagctaagagcagagaggctggtaagaaaatgtattcttattatctctttcaatgtctcatgtatagtaggttatagaaataaaccatttgaaaaatactaccaatggagatttgctgggctgcctcttaatggtcaccttttggtcaatatggctacagaagaagctgaagcatcagagcacgcagaccattttccaaagaagctgcatcattttacatccccactagcagtgtatgaaggttctgatttctccacatcctcaccaacacttgttattgtctatctttttgatcatagccatcctattggaaatgaagtgatactccactgtggttttgatgtgcatttccctatgactattaagcattttttcatgtgtaaaaacagacattttgtctaacaatactcaaagcctttcacctgggaaattgtgcattctagactctgaagcataagttctttctttttaattttttcagatacatatttccttgagttggcacaggcatagcacatttgtctagcataggacagatgaaaaac

SEQ ID NO: 479403 - DNA, 1036 bp, Homo sapiens
ctcaggaaaaggcattggagaaacaaattgctgttgcaccatgaatgtaataaggcagttagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctgctctaggatgccacactcctcaaatgtgctagaagtgacactttcacggaggtttgctaagccagttggctggtgtaaacccacctacaaaattggaaatgaagatcctgacaattctcctttcacgtggagttatggacaaatttgaaagcataaagcttaaaatactcacttggctgctgaaatataccagtttcttgataaggcctaacataatgtgcatctgtggtaattggaaaaatgtcataaaattaagtgaaaaagtactttttatatagctttgtcttttccccttaaaaatgtgtgtacttttatcaactcatctatacagtcaattggaagattgtcattcattcta

SEQ ID NO: 479404 - DNA, 607 bp, Homo sapiens
ctacaccacatgcattatggagcagtacctgtggacttggtggcagtaggcgaagtcgatgcttccgtagatagaaaggaaggtgtggagtccagccaagttgtttcaaaaaaggacgatattggtgaagacacagttgctgtaaaaggatatgtcaccccagtggatatgagtggaaatgaggctccaggaacagtggatgtagtagtcattatatttagaagggagtccagtgtgggcttaggaataattaaagtagagggtgatgatgcagttggaattctgttccatgaagatgttattgtagagctaggcagaggcatggcaccaacagatagagtgtggtcagttgtagaaggtgacatagtctttctgctgaaggatgaaggatgagacacagtcctggggttggcagttattgtggttctggaggatgcctcagggtgtgtggaaatgtacacaatgtcatctgtgacatttatagacatagggagagaagttgggaagccagtagtgataccacccagtgtaggtgtaggaatggttcggactcatcctattttacctgaccaacgctttgtcccaggacctcttcacatttggctgt

SEQ ID NO: 479405 - DNA, 650 bp, Homo sapiens
cttcctgacaagattgtggatcttgctaatattaccataagtgatgcgtactggtcacaagatggagttttctgggcagatagcaaatctgacggtggccgggctggctttggctgtgctgcggggggaccacacgtttgatggcatggctttcagcattcactcctatgaagaaggcacagaccctgagctgctgctgctgctgctgcctcctcctcctcctcttcttcttcttcttcttcttcctcttcttcttcctcctcctcctcctcctcctcctcctcttcttcttcttcttcttcttcttcttcttcttcttcttcttcttcctcctcctcctcctcctcttcctcctcctcctcctccttcttcttctccttctccttcttcttctttttcttcttcttttaagatgagaaactgtctgcttttggtaattttccagtgccttcaagtcgttgttactttgtattgttgttatatgcaggagagttgagtttattaggagctacttagccatattgaaacagatgttgaattcccagtgtattttgtttacaatggggttttctatcatgaatcttggtggagagacaaaccaaacaacaccagttgtattcttggtgccaaactgcttacatattgaagct

SEQ ID NO: 479406 - DNA, 489 bp, Homo sapiens
agcacaggaactctacaaatataatcaaattaaaatgaggtcctattggattagggtgagccctaatccaatgattggtgcccttataagaagagagaaatttaggcataggcacacagggagaagaccacgtgacaaaagaggcagagtgatgcatctacagccaaggaatgccaaatattgccaccagcgaccaaaggtgtccactggggggtcttggaatgtatttcctatggacaaggaggtgctacataagaatgtgagagaattcataattgcttgttcatgcatttttatgatttgtgttttaaaaagattgtcagataactccaacatctgggtcatctcagtgtcagcatttgttgattgttctcattcaagtgtgattgtcttgacttttggtgtaatgagtgattttctattgtatcctggacatttggggtattgtgtcaggagaatctggttcctatttaatcctccttattagca

SEQ ID NO: 479407 - DNA, 614 bp, Homo sapiens
gctgcttcagaggatataaactgggactcctcagaggaggaagcccaccaccatgaacaacaagaaggcatccccgctacccctaactggacaagcaggccctgtaaaagaggccctgaagggattactggccaaccatcaggccagtctcaataccacaatctaccacatcctaacacgaaataagccctttaaacaaaagagtgctgataagggccccggggccaaattcaaccccacctccccagacaagacagccccacctccccagacaagacagccccacctccccagacaagacaactccacctccccagactcatcactgatcaaggcccagcagggacagttcctggtgaggactctcctcctggcttatgagagagagagagagaatgagctttctgatgtctcttcttataaggacactaatcctatcagaaaacacattaatatttctgcagtgaaatgtgtgtatcttcacattaaatagaataaataaagaccataaatagcctaatgccatttcaagacagatttgccgtcaaatccatttttaaaacttacaattttcagagccttttggattttggaatcgtagatataagcttatg

SEQ ID NO: 479408 - DNA, 1455 bp, Homo sapiens
tcatcacaacaaatccatatcctgatgccagggctgcaccccaagctgattaaatcagaatatccagcccattccaatgctcatctgatctctggagctttcatgttgtacacctctccaccctatcttaaccttgaatcccagctccactttgatcacctggtagcaatggattgtccaactacaccaagtgtcaagcctacaggctctcaggaacccatctctgagaaaggcatcagcttcccagccaactgcctgcccaatgtccggccccagacttggccccttgatgagaccttcacatttactcaccacccactcactgactcaaccagagcaacttctactattgcaagctccattcgtggccttacagagcttattctcattattccacctctatttgcaacggagcctgaaacctatccttatttgcagtttgccatttaaaaatcatcccttctggctttactttttgccctgttctttctgtgtccaaactgaaagtccgaagtgagagaaactcatgctacagaggatagtgcagattctacatatcgggtttttagggtgcacatgatgaatagtttggaaacgtttctgcaccagtttatcactggcaagacagaggcaatacgttacaaaatcagcatgaaatttgataaattaaaactcagaaacaatgtagaaaaaaaagcctcccgatctattttatactcgcaggctccttccaccaatatgctcaattattttccctgaacagatgttcccagacctttcactcacccaggagtttatttcttgtttattcctgacaaaattgctgtttagcataagatttaaaatgtgtgcatttacagcgctacatccagaatgcaccccagaaaggaattttcaccattaaatgtacaacttagtcagggttatgatgactaaaatgttgtgggaatgctgattatttaaacatgacattattaagttttaattcatctttgtaaacaattctttatttttatactgctgcagaattaataccactgttgacttgtgtttcagtctttacatatcgcattccctgtgcttttcacaggtctactgtgtttccacagttacttcccatctgagaagctggagaggaggcatttgccttgaccctccacccacctacagtcaggcaaacatgcctctgactaatagaaactgcctgaaggtgatgacttggtacatccagcagacactgaactgctggacagaatcatatttatagctttcttacaactatcttttgcttctcacacagggtagctactggatacaggaagaacatctgtcatattgggtgagggctcaccctaatgacctaattttaacttgattatatctttaaggatcctatttccaaataaggtcacattctgaaatactgtgatctaggacatcaacatatctttttgc

SEQ ID NO: 479409 - DNA, 918 bp, Homo sapiens
gcacctggaaaagccgcagacacttaatgcaagcccgtgaaagcagccacgggggctgtatcttgcagagccacagaggggagctgcccaaggctgtgggagcccacctcttgcatcagtgtggcctggattatccgtggaagctgagcatatgcctactggatgacccagccgtcctgcccctgcaagctgaggaacaaggaagccagtctgaatcccaaaacctcaaaagtagggaagctgacagtcgcctttggtctgtggccgaaggcctgagagcccctggcaaaccattgaaaagttattcagcttttggactcttggtggccttaaagatagaaggatttaaaggaaagggccctgagcgctggaggggcccagggcacttgtgggaccttggagctcactgcctaggttcacttcaagtttccgttccacacattctggcacagtgctccccagctgccctagttgtgactcaagctggcccaggtgcatctcaggctgcccttccagaagccagaagggagcatcccgcagtacacctcaagactttggagctaataagccacaagacagaaggagtctgggtctttgaaggcaaccacatacccaggaacatagtcttcagaagtctctttgttacagttgctggtgttgctgaccctaactggtagatattccttgtgttggtgttgaaatgactgagtaaacagtttgatattctgtaaaaacaattcttcaatcgaagaaaaaattatatcagtgaaaaaaacaatgtttttttggaagagatttccttgtgtttctaactttcacttgtaaattctgctgttactgcctttcatgcaatttcaggtcagcagcatgactttctaaaggaaaatatgattaagtcatactttttacaatggtcca

SEQ ID NO: 479410 - DNA, 529 bp, Homo sapiens
ttgaagacagtctctcctgtcttcctcaatgccccttttggtgatataaagttaaacccaggcgtttggatttttaaaaaagcagcctgaatgtttctggcatgcagccaggtttaagaactactgctctgctaatcagtgtttgtaacttcatgtggatgaagtctcctctgtgtgaggtttggtgggaggagagggagaggcaagaagtggaaggttcagagaactgggagccccaggaagagcagagatgtgaagaaagctgtgaaatggagaaaatggggaagctgaccattttgcacactatgcagctttgcccagggctgtcctggagagcgtccacatcagaggatttggaaaggtctgatcatgacactgtctcaatgactgtaaattctcaggtgatgctgatgttactggaccagagatcacactctgagaaagaatggactagtgttgtccttgagcaggtttatagacacagtagcatagctcttcctagaacagaccttgccatttagaacatcac

SEQ ID NO: 479411 - DNA, 729 bp, Homo sapiens
agaactctagtgatgacctcaccccctcaaccttggatggcaacactgccctgggcagtgggcctaccatctggaaccctgctggtgacctcaccccttcagccttggatggcagcactgccctttcagccctgggcagtgggcccaccatctggagccctggtggtgatctcattgcagcagctgtgggtggccacatcaccctctcagccttgggcagtggccctgtgctctaaaatcctggtgatgaccttgccccctcagccttggatggcagccctgcactctcagccctgccttggatggcaacaccccccacccccgcttctcagccctgggcagcagcaccacctctggaatcttggtagtgtctccacccactggaaccctgccattatcccgacaccctcaggactaggcagtggtcctgggatccctggtggtagacctgtcccctttggccctggggagaggtcccaccccctcaggcctgggcagtggccctgttctctagaatatagcaggtccaaatggctcagttatctgcataagacaattcagccgaatcctttgacattttataatgaagatcacctttcttccaatgcccaataccaggaagctcaccaaaagtacctttaacatttacatttcaagcaatgttcactttaaggcaatctaggctgcttctgtaatgagcctcaaaatgtttccagcctctgcccatta

SEQ ID NO: 479412 - DNA, 1401 bp, Homo sapiens
agagctgcgcgccgcggcggcggaagatggctgcggccgagttggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaataattgaagttccagattcttccattttgaaaaaggtgactcatttttctattgtcctgaccgccaaagattttaacccagagaagtatgctgccttcactaggatattgtgtagaatgtacctgaaacatgggagcccagttaaaatgatggagagttatattgcagttctcacaaaggggatatgccagagtgaagaaaacggctctttccttagtaaggattttgatgcccgaaaggcctacccggctggctccatcaaagacattgtatctcagtttggaatggaaactgttatcttacacacagcactgatgctaaagaaaagaattgtggtgtatcaccccaagatagaagcggtccaggagttcaccaggactctgcctgccctggtgtggcaccgacaggactggaccatccttcactcttacgtgcacctcaacgccgatgagctggaagccctgcagatgtgcacaggttacgtcgctggatttgtagacttggaggtgagcaacagaccagacctctatgatgtgtttgtgaatctggcagagagtgagattaccattgctccccttgcaaaagaggccatggcaatgggcaaactgcacaaagaaatgggtcagctaattgttcagtctgcagaagatccagagaaatcagagagccaggttatacaggatattgctctaaaaacaagagaaatctttaccaacctagcaccgttttcagaagtttcggctgatggagaaaagagagtccttaatttggaggcgctaaagcaaaaacgatttccaccagcaacagaaaacttcctttatcatctagcagcagccgaacaaatgctgaaaatctgactgtgtgacagaacgtatcactgatgactgatagaaagccctctttcactctgattacccactcactacatgaagtcctgaaaataacagagaaactgttatatctttttaatgatttatttgcaagtattgagatttgacctgaaaaacaatgaaacacatgaacacacttccgattttctcctcgctgattagcttcctgcctgctgtcagtgctggacgaagtgctataactactttatgtaacattacagaacagctagaggtcctgggtctgtcttcatcatactgcctcttctta

SEQ ID NO: 479413 - DNA, 613 bp, Homo sapiens
aatgaacaagacctccacagcatggaagtggacccaaggggttgccgctgctggctcgggcctcacctggtctacctgggagtgccatgtaacacactttcttcggattttttgccagaggctccaggaacagagctaattggtgggggaggggactgtgttaagatgttaagaggcaatcgtggcttactctgcacttggacaaggacaatgactcaactcaaaggtgaagactttgatgaaggggttttcgggccccaggagccagccccagtggaagagatttggccccaggaaggtgtgaacaagggagagcttcttgaggccccacacagcacaccacacaagcggtttcctttattttatattggcaaccaggccatttctttcagggccccactgcattgcactgaggggccagcagaaaagacttaccttcatggagcttgcattctctggatctagatctgtaagactttctgtgatcaagcacaatattggaaagcagttacttctgagacatgtatatattattggcacaaaaataatctcaatacttttattattaaagaatcagaaattaagcaaacagtaaaagctgaaagaggtttgt

SEQ ID NO: 479414 - DNA, 1061 bp, Homo sapiens
taagtgaagtcctgccacttcgagacatggaatcatctttctcatttggagtgatccttgctgtcctggcctccctcatcattgctactaacacactagtggctgtggctgtgctgctgttgatccacaagaatgatggtgtcagtctctgcttcaccttgaatctggctgtggctgacaccttgattggtgtggccatctctggcctactcacagaccagctctccagcccttctcggcccacacagaagaccctgtgcagcctgcggatggcatttgtcacttcctccgcagctgcctctgtcctcacggtcatgctgatcacctttgacaggtaccttgccatcaagcagcccttccgctacttgaagatcatgagtgggttcgtggccggggcctgcattgccgggctgtggttagtgtcttacctcattggcttcctcccactcggaatccccatgttccagcagactgcctacaaagggcagtgcagcttctttgctgtatttcaccctcacttcgtgctgaccctctcctgcgttggcttcttcccagccatgctcctctttgtcttcttctactgcgacatgctcaagattgcctccatgcacagccagcagattcgaaagatggaacatgcaggagccatggctggaggttatcgatccccacggactcccagcgacttcaaagctctccgtactgtgtctgttctcattgggagctttgctctatcctggacccccttccttatcactggcattgtgcaggtggcctgccaggagtgtcacctctacctagtgctggaacggtacctgtggctgctcggcgtgggcaactccctgctcaacccactcatctatgcctattggcagaaggaggtgcgactgcagctctaccacatggccctaggagtgaagaaggtgctcacctcattcctcctctttctctcggccaggaattgtggcccagagaggcccagggaaagttcctgtcacatcgtcactatctccagctcagagtttgatggctaagacggtaagggcagagaagtttcaaag

SEQ ID NO: 479415 - DNA, 914 bp, Homo sapiens
actggctgccactgccagagtgacaatgctaactcggccggccccaaacgcattcccatctggggcggctctgggccaggtggagagcgtgactgtcagacattcagtcaacaaacacatactgaacgctttcctattggtgccaggctttctgctaggtcctggcactacagagatgaagaagccttcactgctcctcattcacccctcacctctccagccacaggtttcgtggcatctttcccccttcaaggctcgccttgatgttcattttattctactaagcgaaggcagggctaatggttttgaatccagcctggttattcggtctctgatggagcaacaagggacccttttggagagggcaacactcagaacatcaaatggggctctcagccatgggctgtgggtatcacaaaactccagaggaaatgcaagcctgtttaggttgctttttgtccacacctttgaaaattcaggagataaaatcatgcaatcggccttgtgttgagacagcattttcacctcagcttcaggtctggaaggcctctctgaacccactggttctagaatttactgtagagactgtttgaaatgcaaagtacgaggcaccaccccaacctattcaataaaaccctaagtgggacagtgtcttggaatgtaaattttaaggagctgtcctgggtgattgtgatgtacattaaagtttgagaaaatttgtttgcacagctctttctgttcccccgcacccccccgccccacaacccgttccctttcaagacgggtaacttagaatgagccctttggcagtcctgagagcctaacttccaaaactaacttcaccttcaattgattgaggtgcagggaacaaagggacaactagaagcttcaaatttgcttcattctataactct

SEQ ID NO: 479416 - DNA, 875 bp, Homo sapiens
tcctttggtttgttacagacaaatcacagagaggttagaggacttgctccaaattacccagcaagtgagcagtacaaggaggcctggagcccagtgttctgcagacatgatcccatttcatcctcactgcagccccatgagcgaggcactattgttgtcttacagatccctacatcctcagcactcaagcccagaacgtcttcatgggactgacagcttctgtgaatcccgtggggaaccactgggcatcgacccaggccctgtgacagctacaaatagtcatgaaccatcttggcagggttctggaggcttccccacttcagagttccctgacatgggagaagctatttggccactacttcttccaaccaacccaatccctacccacacctatgcacacacctgtccccagcagtatctacaaagacctttgttgttgaggtccccttgccctgaagccagtcctcttgaacaggacaagatctctcctggggagctacatgcctggtatcataacaatgtatgcacatgtatctgctacccgagggttgggactcttccataacttccaaagggccttacacccagtagttgctcaacagatcctgggagaaggattgaatggagttgaaagggtgataacacgacccaggaggagagcacagctgcttgttaagcctggctggcctccccaccagaaagtgagggacttgactcttcgccagcgagttatgtgtgtcacagttggtactggctcatatagatctgtcactcctcccttatcaggccttcctgggtttccgaagttgctccaaattcttcccctgccccctgaggccttggcacctataaagggtattaaatcagggatgggt

SEQ ID NO: 479417 - DNA, 1405 bp, Homo sapiens
ccgcgcttctccaagcttcttgtgacctcacagtgcctcttagtggtcacacagcacactgcaggccgaggtaccagcctacagataaagcttaatgtgccagaggacccgcccacacttgcctgtggacatctccgcccagaaaactgggcatgacacctccctctctggggtcacagccagtcagaaagaacccccaaatgccccatcctgtatcccttccacactggagcctgtgtatggcaagagactgcaggcatgtgctatgaggactggggacacctcaggatgtagtgcagaggctgaagctgtcactgacccactgctggtgcctccctttgacttccaatgtcctctggcagcagatgtggccacagctacaatcagaaaacgatccttgctcttcaaagccagggccaccgttagaggtagagggaactccatgctccacggtgctgcctccgaggtgcacagtcaagatgggacctttgctgcccagctgtgtcagcagctggaggacagatgcctgcgggtgcgagggagagggcaggcttgtgatgtgagggagctgcgcttcaagacgaatcccctagcctacctttcgatggtttctaaaccctcctatgtagacattctgaagccacgactgcccatgatgccaccctctaggggtgactgctattaacagtttggagaatggacttccactatttttgtgcctatgtattatctttatatctgatattttaaatttaggaacattaggctatcgtaaaggcaaaagtgatgttaaatgtattagtatctgggataaatgacagctagagttattagttattactcttcctaaggttaggagaaggagcatacagaagtcacatcacgtcacttccctgagtaaagccagccatggctccctgtggtgtcgaatgaaatgcaagctcctgcctggggttcctcaggccctctgtgatcacgttcctgctcatcagttgtccagcaagtcctgtccctcacagagttctgcctggctgtcccctgagcacagccagctgttttgctgccttagggcctttgcatttctcttttcctttgctcagaatgtcttttgccagatcttgcacgtgtggctctttttgggggtattcaaatcaagatacggtgtcttggcttcctgaggtttaagtctcagctaaaacatcacctcctcaaataaacttttcctgaccaaggccccccgctgtaccctcgagtgcatccccgtttgatactctccacagtacttgtcaggatctgtagtgaccttgggtactgttaatttgcatgtctgtccaccctcatccctgccctgccctcttgatgaaggcaccatgagagcggcaaccttgtctggtttaattctaga

SEQ ID NO: 479418 - DNA, 638 bp, Homo sapiens
accagaaacctggcgggcactatggggaaaaaaactaaacaagaagaaagtggaggaagtgctagaagaggaggaaaaggaatatgtggtggaaaaatttctcgaccgtggagtgatgaggataacacatgggagccagaagagaacctggattgcctcgacctcattgctgagtttctgcagtcacagaaaacagcacatgagacagataaatcagagggaggcaagcacaaagctgattctgattctgaagataagggagaggagagcaaaccaaaggggaagaaagaagagtcagaaaagccacgaggctttgctcgaggtttggagccagagcggattattggagctacagactccagtggagaggtgctggagccaagatggccaaataggaacaactccagtctacagctcccaacatgagtgacacagaagacgagtagtttctgcatttccaactgaagtgccaggttcatctcactggggagtgtcagacagtgggtgcaggacagtgcgtgcagcgcacgaagcattactgaagcaggaagaggcattgcctcaaccaggaagcccaagaggtcagggaattccctttcctagtcaaagaaaggggtgacagatggcatctggaaaat

SEQ ID NO: 479419 - DNA, 843 bp, Homo sapiens
gtactccacacagcattgcctctgaccaagacactcactttatggctaaagaagtgcagcagtgggctcctcctcatgaaattcactggccttaccatgttccccatcatgagaatggattggtggaatggtggaatggccttttgaagtcacaattacaatgccaactagatgacaatactttccagggctggggcaaagttctccagaaggctatgtatgctctgaataagcgtccaatatatggtactgtttctcccatagccaggattcacgggtccaagaatcaagggatggaagtggaagtggcaccactcaccatcattcctagtgatctactagcaaaatttttgcttcctattcctgtgacattactttctgctggcctagaggtcttagttccagagggaggaaggctgccaccaggagacacaatgattccattaaactggaagccaagattgccacatggacactttgggctcctcctgcctttaagtcaacaggccaagaagggagttaaagtgttgactggggtgattgaccgagattatcaagatgaaaccagtctactattccacaacagaggtaaaaaagagtacgcatggaatgcaggagattcattagggtgtcttttagtgttaccattccgtgtgactaaggtcaatgggaaactacaacaagcccaatccaacagaactacaaatggcccatatccttcaggaataaaggcttgggtcactccaccaggggaaaaaaacatgacctgctgagatgcttgctgaaggaaaagggaatacagaatgggtagtagaagaagggtacatgtgcacaacgtgcagg

SEQ ID NO: 479420 - DNA, 859 bp, Homo sapiens
ccctttctaacaccgtagaagatatgcacacttccattaccagtctccaacgacaattagacttcctcgtgggagtcatccttcaaaactggagagtcctggacctcctaaccactgagaaagggggtacctgcatatacctccaggaagaatgctgtttctgtgttaatgaatctggcattgttcatatcgcaatgatcaacgacgccctttttcctttttatactaaagtaagaaataagaatgttagcccaaactgcactattttgcagacccctaccattttacaaactggtcagagtggaaaattccaccagggcctgagctgtgagaaacatcctgtcaggcaggtcccaggcctaacccctggctgcactaaattccttcattatcagcagccaaacacaccgcccccaccccattttcacaacaatcccagacctctcctgcccgggactgtaactggtccagcctatcaaactacttcattcaattctgactgaggtataaatattccattttatgaaaataatatacttatttaatccattttactttagttttatgtcattttttgctaccacaaacagtattcaataaacattttagaatatatttctttttgcacctgtgcaaaagttttacttcaatataaatatcttaaagtaaaattattttattgaaggacatacatttgtgttttatcccatggaacttgaacaggaaaaaagatcttcaaaatatggcctcccaggaatgtgagtttagtacaccatagtatagtagatcatactgattgttaccaataaacataaaggcaattggaaaaatttaagattttctacctagtacaaggatg

SEQ ID NO: 479421 - DNA, 1122 bp, Homo sapiens
cccgcggctggctcggagggtcccacacccacagagcctcgctcattgctagcacagcagtctgagatcgaactgcaaggtggcagcgaggctgggggaggggcgcccaccattgccgaggcttgagtaggtaaacaaagcagccgggaagctcaaactgggtggagcccactgtagctcaaggaggcccaactgcctctgtagactccacctatggggcagggaatagctgctcgaaaggcagcagaaacttctgcagacttaaacgtccctgcctgacagctttgaagagagtagtggttctcccagccggagtttgagatctgagagcaaacagactgcctcctcaagtgggtccctgacccctgagtagcttaactgggaggcaccacccagtaggggcagactgacacctcacatggccgggtacacctctgagacgaagcttccagaggaacgatcaggcagcaacatttgctgttcggcaacattcactgttctgcaacattcgctgttctgcagcctctgctgctgataaccaggaaaacagggtctagagtggacctctagcaaactccaacagacctgcagctgagggtcctgactgttagaaggaaaactgaaaaacagaaaggacatccacaccaaaaccccaactgtacgttaccataatcaaagaccaaaggtagataaaaccacaaagatggggaaaaaacagagcagaaaagctgaaaattctaaaaatcagagtacctctccgcctccaaagaaatgcagctcctcgacagcaacggaacaaagctggagggagaatgactttgacaagtggagagaagaaggcttcagaagatcaaacttctctgagctaaaggaggaagttcaaacccatcacaaagaagctaaaaaccttgaaaaaaagattaaacgaatggctaactacaataaccagaaatacagagaacgccacaaagataatcctcgagaagagcaactccaagaacatacttgtcagattcacgaaagtcgaaatgaaggaacaaatgttaagggcagccagagacaaaggtcaggttacccacaaagggaagcccatcagactaacagctgatctcttggcagaaa

SEQ ID NO: 479422 - DNA, 692 bp, Homo sapiens
tatttgtgggtacataccatcagctggggctgatgtgacacaagcacccctgttgccaccaccaccatgactgtgctgactcagacctcaagccagcacagcactgggtgtcacgcaaagcctgctataaccactccctggctactggctgtgttctttcaaggccctggggttctacagtcagtgggtggcaaagccagccaggcagacataattctgggtttgagtccagtctctgccatcttccagctttatgatgtttcctttcctccagggaagcagggtcgcccaggccttgggacagcactgagttcaatgcctcacaattgctgtgttctttctccccgaccccaggaagctctctgcaccatgcagctgctgctggggggtaggggagggtgggcatcggtgattcagggctgttttttctatctcttcagtgcgtccttcagcaatatgaagttaacaccagatggttgttaagttggtgtccttgcagcagggatgattagtggagccttttattttgccattttgtgccgccttcttttctgttgttagatatgtatttataaaaattgtatgaacagctgtatgccttagcaaatatgtatctctaacaaattaattatttataatcttttacgtgtaaattagtaaagattaaaccaagttctaaggaaactatcaac

SEQ ID NO: 479423 - DNA, 969 bp, Homo sapiens
tggagcctcactcactgctagcacagcagtctgagatcgaactgcaaggtggcagcaaggctgggtgaggggtgcccaccgttgctgaggcttgagtaggtaaacaaagcagccgggaagctcaaactgggtggagcccactgcaactcaaggaggcctgcctacctctatagactccacctctagaggaagagcatagctgaacaaaaggcagcagaaacctctgcagactgcagacttaaatgtccctgtctgacagctttgaagagagtagtggttctcccagcatggagtttgagatctgagaatggacagactgcctcctcaaatgggtccctgacccctgagcagcctaactgggaggcacccccaagtaggggcagactgacacctcacagggccgggtacccctctgagatgaagcttccagaggaacgatcaggcagcagcatttgctgttcagcaatattcgctgctctgcagcctctgctgctgatacctaggcaaacagggtctggagtggacctccagcaaactccaacagacctgcagctgggggtcctgactgttagaaggaaaactaacaaacagaaaggacatccacaccaaaaccccacctcaacggaacaaagctggatgcagaatgacttggatgagttgagagaagaaggcttcagacgatcaaacttcttcaagctaaaggcggaagttcgaacccaatgcaaagaaactaaaaaccttgaaaaaacattagacaaatggctaactagaaaaaccagtgtagagaagtccttaaatgacctgatggagctgaaaaccatggtacaaggactacgtgacaaatgcacaaacttcagtaacggatttgatcagctggaagaaagggtatcagtgattgaagaacaaatgaatgaaatgaagcaagaaaagaagtatagagaaaaaaagggtaacaagaaatgaacaata

SEQ ID NO: 479424 - DNA, 641 bp, Homo sapiens
ccgtctactcaagtctcagcaatggcggatggccttcttcccaccaagctcgagtgtcccaggtcgacttcagactgctgtgctggcagcaagaatttcaagccagtggatcttggtttgctgggctctgtgtgggtgggacccacagagtcagaccacttggctccctggtttcagccccctttgcaggggagtgaactattctctgtcgctggtgttccaagcgccactggggctctggggggcatattctttcattccatatattctggaggcagcatccctgatgtgctggattttgtgtttcctagggtgttgggtgctgcacgggcttgggaacctgtgatgtggctgcactactgggtccagtgggtaccacaacacagtggccctctgagtagatattctgaattctatgtttttcatttcagctctttcagcctagttaagagccattgctggggagctagcgtggtcatttggagatgagaagacactggatttttgaatttccagagtttttgcactggttctttctcatctatgtgggttgatgtccctttaatgtttgaatttgctctcctttggaaagggcttttggcttttatattctttgatgcccttgagggtttggctgtggt

SEQ ID NO: 479425 - DNA, 611 bp, Homo sapiens
aaactgcagtatcatgagggagtgggcagtgcagaggggaaacatggggttggagctccccgctagagtccccactggggcactgcctagtggagctgtgagaagagggacactgtcctccagatctcagaatggtagatccaccaacagcttattccatgcacctggaaaagccacaagcactcaatgtcagcccttgaaagaagccagtgagggtgttccaccctgcaaagccacaggggcagagctgcccaaggccttgagagccaaccctttgcatcagcctgcgctggatgcctgctgtaaccacttcctagctacacagcctatgttcactcaaggccctggggccatacaattattatgtggcaaggccatctttgactgtgtcttttcattcaaggtgggaagctcccccaggcttcgggttgggccagaggtgctacaaaggagccaggaactagggttaaaaatcttagaggtctaccttggaagccaggggtcttttttggagctgggagctttccagcctggggttgagggaggggtgatgccagtactcccttagcagcccaagctggtgtctcaggtacaagtgcacaatgtgcagg

SEQ ID NO: 479426 - DNA, 705 bp, Homo sapiens
cagggcggcggcagcagcaaccgcggcggtaggcggcttggtgggcgagcaggagggaactatggtggcggcggcacaggaggcagcagcagtggcgggaagcggagccgcgatcgggggctgaaccgagtctggaggcaccaaaaggggcagcgccgagtcggagggggcgaagataggtgccagtaagaactaggaggatgaaggccattcaaactcctacccatgacactctgaagcaacgacggcacggcgggaagaagggaagatggcgatcaaggagttttggctttgtgctttttaaagaatcggagagtgcagataaggtcatggatcaaaaagaacataaattgaatgggaaggtgattgatcctaaaagggccaaagtcatgaaaacaaaagagccatctaaaaaaatttttgttggagacctttctccagatacacctgaagagaaaataagggagtactatgatggtttcagtgaggtggaatccatagagctccccatggacaacaagaccaataagaggcttggattgagctttattatctttaaggaagaagaaccagtgaagaagataatgaaaaggaaatactacaatgttggtcttggtaaatgtgaattaaaagtagccatgtcaaaggaataatatcagcaacagcaatagtggggatctagaggaggatttgcaggaagagctc

SEQ ID NO: 479427 - DNA, 511 bp, Homo sapiens
aatacacttcctcctcctgactccagtgggctgctccttgaggtttaaaatttactgtgttgtgaagactgagatgtggcagctgctgcagagtgctagcaaatgcaaggatgcctgtttccctgtggatgttcaccacagcggcagaggcaaggcagcttggcaagtagagcctaatgggatagctgtccctggctgtggtccactacagacactccagcaccaaaccctctgggatccatatctgctggcttgctgtgccaccatgttgcttgtctcctgggtgttctaccctggagagatgcaggccatcaattgctcatggcaatcagcccaggatggagactctgtactgtgggcccaagccaggggttctttttctggttatgagcactggagtgtgtatgggacccataggagatggactgtcctcctctccttgggccgattgcagcttattagagatgtggataaggcatttaagttcttggcaccttcgttagtctgaggg

SEQ ID NO: 479428 - DNA, 669 bp, Homo sapiens
ccaacagatagcctcagcagaggaggattttaataatcaagtggataggatgacccattctttggctatcactcagcctctttccccagccaaccatgtcatcgccaaatgggaccatgagaaaagtggccatgggggcaggcgtggaggttatacatgggttcagaaacacgggcttccactcaccaaggctgatctggctacagtcaattttccgggagcagaaaccaactccaagccctcgatatggcaccattccctgggaatagacatttactccagatattggtttgcctatcctgattgcaatgcttctgctaagactaccatccgtggactcacagaatgccttatccaccgttatgatattccatacagcattgcctctcaccaaggcactcactttatggctaaagaagtacagcagtgggctcatgctcatgaattcactggtcttaccatattccccatcaccctgaagcagctggattggcctgacatttttaagtatgacccagctgagctctgcacaatgatgtcagcagttgtgaagggccgcgcagtttgattctctggccagtaggtggcatttgaatgtgagaagtaatttcagtaatggcagtgggatttttacttgggccttgctgattgtagaagtactgaaatgtt

SEQ ID NO: 479429 - DNA, 465 bp, Homo sapiens
gaatcaccacaccgtcttccacaatggttgaactagtttacagtcccaccaacaattcttgcttccacctttcagttcgatctcagactgctgtgctagcaacgagtgaggctccatgggcatgggaccctccgagacaagtgtgggatataatctcctggtaccatctgtcacggcttctcttggctaggaaagggaattccccgaccccttgcacttcctgggtgaggcgatatcccgccctgctctgtgggcttcacccactgtccgacaagccccagcctctcttctgcatgtctgctgcagtttgctggaggttcactccagaaactgtttgcctgggtaacaccagtggaggctacagaatagcaaagattgttgcctgctccatcctctggaatcttcatcccagaggggcaccagcctaatgccaaccagagctctcctgtatgaggtgtctgttga

SEQ ID NO: 479430 - DNA, 1724 bp, Homo sapiens
tctgctaaaatttaagtaaaatctttggggtttgtttaaacagctattttgaattctctgtctgaaagatcacctctctctctctctctctctctctctctctctctctctctccaggattggtccctgaagagtctctgtggccaccactgccccaggaccatgacaagttctgtctggctactgccaatgttcactcaaggccctagtgctcttcagtcagcttttgttgaaagctgccaagccttgaactttctcttcagggcagatttggggcctggaatgggagcctcaagtctctacctgcttccctatcctactgtagctgagctggtatccaagttgcaagacaaagtcctctttactgtcccttcccctcctctcaagcagaaggaaggattacctcctggagctgcatactgcactgcctggagctgcgggattggtgtggcaagcactgtcttggtcaccctggctagtgttttactaggtcacatgccctgcaagtgcgctggcactaagcccagcacagcaccaggacttgcccaggaattccagtccttatggtctaggctgcctttcacatatgttgaggaccatagagcactgtagcctgtcacggtggggctttcctgaactgaggttccaaatgctgggatgagtgatgctcctctagctagagatgttataaatggttcctccgtgtgttctagctttgttatgtctcatgttgctttccactgttacaggacaacactgagtttgaatgcagagtcccacaatcattgtgttctctctccctcaaatgcacattctctctctatcccctgtggctgctgccaggatatggaggaggagcagtgttgtcaattcaaaactgtattttctaccctcttcagtgcctttttaaggaatatgaagctaaaaacaggtattgcatttattcatctgatttttggttctcatgaagttgcttttctatgtggatacttgttcaattttgtgttcctgatgggaagctgatcggtggatccttctattcagccatctagctctgcctctttcatctgaattattctattcttaaatgggtaaattagaggtttggggagagcgagtttagatttaactagaattatgtgctttattttttgctccttccaaaatgcctgtcatttttcaaaagtatagtattatcaatgattagtatctattataaaataatcataattattgacagagaaaatcacattttcattcttcctagactttagcttaaaatacctacaaatacacaacacaaactcatatcagcaaactgtggatgttcttttccctggcttgtaaacaaagtgaaaattaagatgggtagacaacatgtaattaagatttatttacaaagtggtagccttaccttttgagaggtattttcctggttataaaggtagctcgatttctaaactgaacatgcatcatcaatgttaacaaaattagctcttaaaaacctcacatattttggaaataactcttttctttctttatttcttaattgtgtttcaatggattttctatatatttgaatttgagaaactgtcagtaagctgttatctgctgctcatttcctacttcttttctctgcagcttttatatgaaagctttgggaaggagcaagatcttatttttaagacaatttagtgttagtatttcacagttgttattcaaaa

SEQ ID NO: 479431 - DNA, 736 bp, Homo sapiens
ctctcagctctgagagtggacctgaaagcatgcagtagtctttgaagggaggccctgcccagtgaggagggatggattggggtcctacttaaagaagcaatctagtcacaatttggaacagcagctgtgctgcattgtggggggactcctcatgaggaccacctggactccctggagccggcaggctagaactgcctagttgactgaaccacaaaaatggcagcttcccctcctgggggcttcatccctggaagagatcagagttctgtttgtataatcctggctggagttgctgaaattcccacagggaggtcgcccctgagcagactgcctggacccactggattcagcaggctagaatggctgattcaacctaaccacaggaatggcagccgcccttctcaccagaaattcatttgtttcaagaacatatttgagaaaggaccatttcttcaatacatgtttctgggaaacttagatgtccacatgcagaagaaagaaaatagtctcccgtctcttgccatatatgaaaatcaaatcacaatggataaaagacttaaatgtaaaaccaggaactataaaactagaagaaaacactggggcaattccccagtatgtcagtctgggcaaagatgttttgagtaagacccaaaaagcacaggcaatcaaattataaatggacaattggtaccacatcaaggtattaagcttctgcacagcaatggaaacaatcaac

SEQ ID NO: 479432 - DNA, 532 bp, Homo sapiens
acctacagactgcctgtcaattgaagaagatcaattggttcattacattgatgacactatgctgactggacctagtgaagaggaagtagcaacaacactagacttattggttgattacattggactacttttaccagggaaggagcagaattttgttcttactggaataatcacaaacagatttgccttccctacactcaatgctactgccaaaactaccatccatgggcttactgaatgccttgtctccacaatcatggtatttcacacagcattgcttctgatcaaggaactcacttcacagcaaaagaagtgcagcaacgggccaggccactcttccgtagtgctgctgcagtttgctggagttccactccagaccctagttgcctcggtttttttcctacctggtggtatcaccagtgaaggttgtgaaatagcaaagatggcagcctgctccttcctctggaagttccatcccaggaggttactgccctattgccagcctgaacatgcctataggagtggttgaaaa

SEQ ID NO: 479433 - DNA, 2549 bp, Homo sapiens
agatcagttggttattcatctttttaacaacatcctaaaactccgagcactgggccagtggggctttgggctcagcagctatgaaggagggacccccaataccccctaagccaggctctatgacatcgataaagacctcgctctttaaggagctagacaagatcctgcaggagtacaccacacagcagagcaacaagctgcaaaggggcaagtcaaaggtgccactcaccatcaacaacgctgtgtcctggtgctccgagcgcatcaagtacaagaagaacgaggtcttcattgatgttatagagtctgccaacctgctggtcaatgccaaaggcagcattttgctgagtgagatctttggcaccatcaagctcaaggtgtttctgtcgggaatgccagagctgcggctgggcctcaatgactccatgctcttcgagctcactggctgccacaaaaacaaattgaaacagtcagtggccaatagtgtggagatgtctgtacccatacccaacgatgccgactccccgcacctgaagaccagcgtgtgcagcgccaagtatgtgctggagaaaaacatcgttatttgaagtattaagtccttccgagggggcaaggagtacctgatcagttttgtatcttatgtttaagtctttaatccaatttgagttggtttttgtatagtatgagataatagtccaacttcattattctgcatgtggatattcagttttcccataactgtttattgaagagactgtttttccccattgtgcattcttggcatttttgtagaaaatcaattgactgtaatgatgtggatttatttctctgttttcaattctgttattttggcctatgtttgtttttatgcttgtaccatactgttttgattaccatacctttgatatatatatatatatatatatatatatatatatgtttgtgtatatatatgtttatatatatatgtttgtgtatatatatgtttatatatatgtttgtgtatatatatatgtttgtacatatatatatgtttgtgtatgtgtatgtgtgtgtatatatatatatatatatatgtatatatatatatatatatctgtttgttttttgagacagacatatatattgcagttattgctttctagtttttttcattatagtcagaaaatatacctggaatgacattgatcttattaaatttgttaaggcttgttttgtgacctaacatgtgatctatctggagaatgttccctgtgtactggagaaaaatgtgtattcttctgctgttgggtagaaagttccatatatgtctattagtttcatttgttttgtaatgtttttcaagccagatgtttcttcatttattttctgtctgaatgctgtatctgatattgtgaatggggtattgaagtcctctactattattgtattgtcaatgtctgtcttcagatctgttgatatttgctttatatatttaggttctcagatgttgggtgtgtatatatttataattgttttatcttcttgctgaattgacccttttatcattacatagttgaccttctttgtctctagagttttaaacataaaatatattttgtctgatataagtatgaccacttctgctttcttttggtgaccatttgcatgaaatatttgttccaccccttcacttctcagcttatgtgtgcccttaaatctaaagtgactctcattgacagcatattactagatcctgtttttttaaaatctattcattagcaagcaatggatttctataataaagaaaaaaatctattcagccatactctgcctttgattgaatctgcttttttatattttgtatccattaaaaatttttatcttttaagttttatataaaggctaaaagtaaattatgcaccaccattacattgttgcattaatctatatatctctattttatgctttcacatcactatttagcatgtgtttctttcagtttgaagagttcccataaatatttctttgtaaggcagatctagtggcaatgaactccctcagtttttgtttgtctgggaaaaggtttcccttctttatttttaaaggataattctgcaggatatagtattctttgatggcagttttttttttttctttcaggactttgaatatatgttcctactctttactggattgcaagatttctgttgagaaatccactgatagtcttacaaggatcccttacatgcaaagattcacttttttcttgttgctttcaaaattatttcttcatccttgtttgttttagtctattctcaggctgttaataaagacatacccaagactgggtaatttatatagaggtttaattgacatacagttccacgtggctggggagcctcacaatcatggcagaaggcaaaggaggagcaaagtcatgtcttacatggcggcaggcaagagggtatgtgcaggggaactcccctttacaaaaccatcagatctcctgagacttattcactatcacaagaacagcatgggaaacacccacccccgtgattgaatta

SEQ ID NO: 479434 - DNA, 629 bp, Homo sapiens
gtctcaaaggactggtatgtggattaaaagagggtgatttgtgaggaaagcttgaaaaaaggaaaggtgtttatggcatctgacaggaactcaataacagcattccacacctatggttactcccactgagagcctagagcctcagccattccaggactgtttaatcttctttcccttccaggttctctatgggcagacggcgaaggtcttggatcaggtgctccaaagcttcctccctgagaaccctgactccagcgaggaagtcccaggaagcacctgtgagacctgcacacccacctcagagggtcccagggctgggaaagccctcctctcaggggctcagctcatctgcgacaagacagagcccctgctccctggagggcaagctgggaccagagaagccaagcacccacatcagtcacctttccaagtgtcctcgagaaaagagagactgtcccgtgtggcccaggcttttccaggcacgcaccggcccccagaggaagccatggtgccgcctgggaaggagcgagcaccagaggttacccagggcacttcctggcgttgccccggcacaacttagatgaacaaagacgaaactaaaacctgaagacccagacacaggaggagag

SEQ ID NO: 479435 - DNA, 1213 bp, Homo sapiens
gcctaagtgctttctgttgtctggcataagatcaggcagcatccaggtgattccactgttaccctgtccctgggggcacagtggcactttcgccttttcattgatgcccaacaacgcagatataaaaattggaacagatggcccctctgctgcaggtctgctggagtttgctggaggtccactccagaccctgtttgcctgggtgtcaccagtggaggctgcagaacagcaaagattgctgcctgttccttcttctggaagctttgtcccagaggggcacctgccagataccagccggagctctcctggcagtgaggaggggaaatgtggggtggatcccccacacagagtctccactggggcactacctagtggagctgtgagaagacagccaccatcctccagaccccagaatggtagatccactgacagcttgcaccatgctcttggaaaagctgcaggcactcaatgccagtccatgaaagcagctgagggagcttttcctgaggcctcttcagccatgcttcctgtacagcctgtggaaccatgagccaattaaagctcttttttaaaataaattatccaatctcaggtagttccttatagcaatgcgagtatggactaatacaaatgcctttctatttattcaggtcttcatcattttctttcattagcattggtaatttttagcctacagaactatacatgttttcttgcatgtataattaaatattttctttgagtgattgtacattatattgtgttttaaattttgatttccacgtggtcattattactatataaaaatgcgaatgatttttgtgtgttgatgttgggtcctgtgaccttgatgagttcccatattagttctaataagttttttgtatatctcttgatatttcctatgtagatcatcatttcacatgtaaatagggacaattttacttcttccttcacaatctgttttctttgtttcctcttttgccttattgtgatggctagaaataagagtgataagtgccaggctaaatcttcacatacaatgtttgatggaagttgggaaagggagcatttttgtcttttttctgattttaggggggaaagttttcagttttcatcattgtgtataatgttagttgtgggcacataccagaatatctgggacatatttaaagcagtgtgtagagggaaatttatagcactaaatgcccac

SEQ ID NO: 479436 - DNA, 764 bp, Homo sapiens
ctgcagcacatcagcgaccgcgagatgcccaaagatttagcattggagtcaaacccttctgaccatccaagggcaagcacaattttcctgcgcaaatctcaaacggatgtgagagaaaagaggaagagcaaccatttaaaccatgtatctccagggcagcttactaaaaatgctgcacagctaacagctgaatgtgcaatagtaactttggtttacttagaaaagcttttaacttatgctgaaaccaacatttgtcccactaactggaaaaggattggtctgcgagccattcttgcctccaaggtttggaaccatcaggctgtatggaatatggactactgccagatcttcaaggacattacaggtgaggacatgaatgaaatggaaaggcattttttgatgcttcttcagtttaatcttaatgttcctgccagtgtttatgccaaatactactttgatcttcgctccttagcagatgacaataacctgaattttctatttgctcctcttagcaaaaaaagagcacagaacctagaggctatttctagattgtgtgaagacaaagacttgtggagagccctatgagaaggtctttcagcactgatgacttcattggtattcagcactctaaagccatcctctcttaaagggagaaatgaggggttataacgtcacaggacctttatctacaaagactggagaaatatcacctttcctgctcaaaacccagcaaaattagtgttttcattaaaaggatagatctc

SEQ ID NO: 479437 - DNA, 1084 bp, Homo sapiens
gatgagagtgttactgacagtgaatccatatccatatgactgtcaggcagggacatctaagtctgcagaagctgtctgctgccttttgtacagatatgccctgcccccagaggtggaatctagagaggcagtaggccttgctgagctgtggtgggctccacccagtttgagcttccctgccactttgtttacaccactgctgcgctagcaccaagcaaggctccgtgggtgtgggacctgccgagccaggcatggggagggaatctccaaatctgctggttgcgaagacccctgggaaaagtgcagtatttgtgcaggagtgtaccattcctccaggcctttggcctcagattgagagttacgccatcagctcccttggttctcaggccttcagacttggactgaggtctctgacttgctgcgtgacttctggcatcacttttttcatctttgaaacagccatggatacctgcacctgctccagtggaggtatcagggcagtgaagcgcactctgtgtgggaccttggttgtagttttatttactgtgctggttttctcaagtgctggttgtgctggcagtaaaattgtcatgtcgatagactcaggacctctggggctgtatcctgtctcaggcagtctccatcctattgctattatctggctaagccagtggtcttatcttgtgaggtcctgtggaagtgggcccgcagactgatactgcgtggctccctggattcagcccccttcctaaggtttttagaccaaagaaagccaaacaccattttatatttaacaatgcttcctgtattatttttataccagataagctaaatttcaccttcatattagtgtgttattaatgttaagcttaattttaataaaaccttgtagacatatttattcaatttttaatgtctgaccataaggatagttctgacttgatgaggtgtgctcacaatgaagtttcctctaaaagttatttttctactttcttctgttagcaaagcagttgccactacagattgaatgcatttgggccatccgcgggttactgggttaaagattttttattagaaaggctac

SEQ ID NO: 479438 - DNA, 555 bp, Homo sapiens
tgatatttaattctttatgatgctgatttcagcatggctggggagatctcaggaaacttacagtcatggcggaaggggaagcaaacacatccctcttcacagggcggcaggaagaggtatgagagccaagtgaagggggaagccccattaaaaccatcagacctcaagagaagtcactcattagcacaagaacagcatgatcagcatgggaaactcttggagggcctctacttcttggaggtggaggcggtccacgtctaccactttcaaatgacggggcttcctagcagctcagcaccagtggtggctgccgggtccgaggaccgaaccgcgaagctgctagcactactgtgcaacctcaattcacatttcaatggacattctgagaaatctctgagtaaattaaattatgaaaacatttgctttagaattactcttgttggttactcatgggccatatcacattgaactttcaacaagtttacatatagcactagcagttttctgtgagttctctaacaaatggattttcaattagcatttcattgtcagttt

SEQ ID NO: 479439 - DNA, 957 bp, Homo sapiens
atcctcaatatctattgctatgcaatgttctacctgggccgctgcacgtcacgggggatcaaccccctagagactccacgaggcccctggtcacccaagggcgcctttcagctggaaggagaaaaatgccccttctctttggaggcgaaatttcagccagatgcagaaagttgcaaggagctgattgctaattaccaagtaaatggggaaaattgtctccaggaagtaggagtccctgagaatcagactactgtgcatgctgctgctcctctgggtctagctgcccaatggggctgccacactccagaggtctatttaagggtccctggcagaggggaccatcatccaaggctccggttgcatgaccatttggagtctgatggcctgaacgcaagaagagaaaaactgggttatttgaaaacgtatcaaaatgaaacaaaggggcgtcataatacactagcagttcttaaacagttgttcctgtatcaacaggatcagcatcagtgtaacctaggaattgttaaaaatgcaaattctcagacccgatttcatatctattgaatcagaaactcaaagagtgaagcctaacaaactgtgttttaataagcccttctattgattctgatacatgctaatatttgagaaccactgtacccatgactgatagtcaatcccctaaatatctcttatgcatgctacttctaccccatatctcttaaacccagtacttatgtatttggcttatgtttctccaattgtagttcatttcactagattcacttcattgcctcatgttagcaaatgcttcttggattctaacaatgttctcttctctaatatacttggtgaccctcacagctttggctttgtattaactgctaatttcataaacatgaattaaatatttattttaaatgttttattattctgcagataaagcagatttcatcattttct

SEQ ID NO: 479440 - DNA, 617 bp, Homo sapiens
taagaaaaagactgaattatacatggacatgtgcctcattgagtgccatcttagagaatgctgcctaacgcaaaatctttcttctacaatttactcttccccagttgaccatgtcccaagagaaacacgccaccatgctgatgctcactttgaatacgtgactgccaaattattagattctggaaatcatgctgtctttcccttagttcattcagtctctcagtctctggacttcagggtctatatagcagggaagaaatgtaatcctgtgggaaaacaggaattagggaaggataagaaagaagagttggtgaacagcaagcagatggtcactcaggcaatcatgatggctgagggctctggcatctcgttttccaggttcagtgatctggaaagtcaaatgggacttttgaggaacaaaggagagatacgagagtttgtggttggtaatttaggcaggtaccactggcctttctggcaagaaaaacatcagttaggtacttttttatactggctatatcatctgtaaactcctgcattattttattatgattcttagtttccttggattgggttttactgttcttctaaatcttgatgaccttcattcctatcca

SEQ ID NO: 479441 - DNA, 657 bp, Homo sapiens
aagccatagaggcagagctgcccaaagccatgggaattcacctcttgcatcagcatgacctggatgtgagacatggagccaaaggaaatcattttggagctttaagatttgactgccctgctggattttggacttgcttggggcctgtagccccttcatttttgccaatttatcacattcggaatgggtatatttacccaacgcctatacctccattgtatctaggaatccccactggggcactgcctagtggagctgtgagaagaaagccaccatccttcagaccccagaatggtagatccactgacagcttgcactgtacacctggaaaagctgcaggaactcaactgtggaagcagctggggatgttctgtgttaacttcactatagtttgtattctgttgttcctatatggaatattccacaactgccaagtagatcaagctgactaatggtactgttcaggtcaactatatccctgctgattttctgcctgcttgatctgtgatttattcatagagattctggatgttagacctttgttggatgcatagtttgcaaatattttctcccattctgtaaatatattactgaagtagtgtgaatttgaaaagcatttgggttactatttgtaagtactctttaagtttaagccaa

SEQ ID NO: 479442 - DNA, 605 bp, Homo sapiens
ccgggaaaaaattgtcttccacgaaaatggtccctggtgccgaaaagctgcaggaggtctgggaagtgtggggcgctacgaattttaagtgctcaagccatgctagccaactctgtgccccaggttctgcagtatgtttccaagtgtgtgtgtgtagaaacgcttctggcaatagggggtcagattctattgggcctggtagagatcaagagaagagatacacttttgtgtctttgaaaaactgcctacaagagcacaagaaagaagttgaatctgaactggtgtcttcagaaaaaaatgagaaaaacaattcttttctagaacactctgcaccctactcaccaacagactcccctcatgcttcattggccgtgccaacctctacattaattaccgtcaaaaagattacctgcatcattggccaaataccatttacccgagggcgtaattatctgatctggcaaagctattacatcagcacaaaaggatcttatttctcctttgcttattaagcttactgtggctgtatataaaattattttttttaattatactttaagttttagggtacatgtgcacaacgtgcaggaagttgttgtttggga

SEQ ID NO: 479443 - DNA, 739 bp, Homo sapiens
tcaatctttgagggaggaggcaccaggagctgcattgctaccatatcccaaagccagagtcagtgtagcatgggctcctctggccaccaaacaacatgcagggacctacttagagcacaaaatacttatttggtgcagctcagctcaagtggcctctggcagtctctggtcctattgccagaggacgatgagcagttgctaagaaactacttccctagttctttagggacccttttttatattgctgatttgaccccatgcactggggaaacaatggacacacttatagaaatgcaaaatgctctgcaaagcctcagcaatagaatcgaacaatcaaaagaaagaacttcagtgctcgaagacaaggttgtcaaattaacccaatccaacaaagacaaagaaaaaagaataagaaaatacgaacaaagccttcaagaagtctgggattatgttaaacaaccaaacctaagaataattggcacacttgtggaagaagagatatcatcgatacgttttcaacctatttgcacagacatcaacatatgacttttttcttcagtctattgatattttaaatcgtagttatttgttatattaatatataattatattcccaggaggtgcctaacaccagtctgtcacttcataattcgcactgactaaccacttggtttaagtgggaattgtcgtatttcctcgtttactaaggtaacatttcccctttgtaattaatgtacaa

SEQ ID NO: 479444 - DNA, 632 bp, Homo sapiens
tgggtggttttggaaaaggcaataaacaaggatggcatgtcagagaccttcacagcagcccctcccatcacaggaccggaggcctacgaaggaaaaatggtttcatgggaaagatggtttcctgggctgggtccagggccctcctgctgtgtgcagcctagggacttgattacctgtgtcctatccactccagccatggctaaaaggggtcaaggtatagctcgggccatggcttcagagggtgcaagcccaaaccttggcagcttccatgtggtgttgaatctggcagtgtggcagggaaatgtggagttggagcccccacacagagtccccacagggatgctgcctagtggagctgtgagaagagggccaccatcctccagaccccagaatggtagatccacctacagcttgcactgtacacctagaaaagctgcaaacactcaaaaccagctcatgaaagcagccaggagaagagctgtaccctgcaaagccacaggggtgggactgctcaaggccatgggatcccacctcttccatcagtgcaccttggatgtgagacatggagtcaaaggagattatttcagaactctaagatttgactgctttgctggatttcagacttgagtggg

SEQ ID NO: 479445 - DNA, 666 bp, Homo sapiens
actctccttaggagctttcacatagcaaaagattttattttaatgaaattcaacttattaatattcaccttcatggatgatacttttggggttgtatctataagctcattgccaaacccaaagtcacctaggttttaccttattttgtcttctaaaagattcatagttttgcattttacagttagggctatgatccactttgagttaatttttgtgaaaggagattttcttggctgccacttccctcacaggcccaaagtgccaagacttggggaacagaaagatgtcaaaagagatgcctctcaggaacacaggacctcagaacttactgcccattactgcctcaagtcattgctccctgcatttcagtgcagtgctccttggttgtctcagttgtggctcaagaggatccaggtacaactcaggttaccactctggaagggagtaaataatgttaatatggctcattattgaaaacattaacttcaatgacaatcaagttgttgtcttctagtactgtctatttcaaagttactgtttttttgtagctaataagcatctcttaataagatattctcagaaatgcaaatatcccatttcttatcatgttttcccattttaacatccatagatgtttactgcctgcaacaattagtactgtaatgt

SEQ ID NO: 479446 - DNA, 839 bp, Homo sapiens
ggctgctttctcccttttggaatgggagcatttacccactgcctgtacctctattgtatcttggaagtggtgtcagccaaaacacattgtactgcattgacaataacttcaatctttgtttgcatatgcaagccgcagaagcagcggcagcatggtgggcccatgctccttcactttggcagggtgctagccggtgctgagatgcctggctccaagcaggcattcaccacagtggcagaagtaacacggctgtgggaccaggggatccctgctgtcgatggttgtgatgatgatgatatttgcacagggacaggccgcccagagagtctacacagctttgggctggtactggggcttgtctgcacagagtcctataatgtgaaccgtctatgtgtctctcagctgtggatatcaacacctgttccggtggaggtggtgggtggggttggtggtgtgcaatggactctgtgacggctcttagctttggcagcttaatgctctacttttgtgctgtgttttaggcttaagattataaattttatatttataatttctcattttctcatatgttcattttaggttagaaattaactctaaacactccttttgttgtatccttcagattttggtaagttttatgttaattggtatttagttcaaaggtgtttttgtttttcatgagacttctttgattcatgggttatctagaagtctgtaccttaaaacttaaataccttgagattttccaaacatattttggttattaatttctaattttatattacaataaagtaaaagcattcttttccgatttctactcatttacatttcttaagtct

SEQ ID NO: 479447 - DNA, 1085 bp, Homo sapiens
ttcgcgcctgccagtgcagaagcggcttgccagttccagagcttgtgatttgcctgttgtatgaacatcatagagtgtgctctcacaaacctagatggcatagcctactacaattgtattgctacaattgcctacagtattcagtatggcaaacatagtaaagagggagaagaagaggatgaggatgaagatctttctaaatataaattagatgaagatgaggatgaagatgatgctgatctctcaaaatataatattgacgtcagtgaagaaggcgatagtaataaaaagaaatctaatagaaaaagtcactcaatatctcaatcttcacattcactatcttcatcatgttcattctccctttcaaattcaaggtctaggtccaggttcccttcaagaagttctagttcacagtcaagatcttgtttcagttccagagaacatttaagatcctctgggttgaaatcaagatccagttccaggtcccacaggggctcactaaacaaccctgagcccagggccaacccttacagaacacattactttacccaagcaccacaggtcatcttctggatcattccattctggttcccattcaagttcaaaaaagaaataaggcattaaaatgtatatcttaatgaaatctaatacagtgcatgaagcacatttttaaggaagttggtgtttttgatgtgtaattttaatgacattattacctgatggcctatggtggcattaccacatttcattagctctattccatgccactatgatcttaagcaaaatgcttaagattgtctaacatctatgagttttaccatagtgatgttatcactaggagcaactggggtggttcagaatctcatggcctctggttgtataactcctaaaccataatttctaatcttgtggctaatttgccacttctcttgtctacctgtaagcttgcctcctcttacctaatttgttatttaaatgattatttttacattgttaagggttataccatttacattgtcttctgtgtttttaattttaacaagtcttagtagcaatacctaggcaaaatagatttcaagacaaaa

SEQ ID NO: 479448 - DNA, 580 bp, Homo sapiens
atctcacagcacagcgctcgagctctgctaagaaacagactgcctcctcaagtgggtccctgaactccatgcctcctgatagggagacacctcccagcatgtgtcaaaagacaccttatacaggagagctccagctggcatctggcaggtgctcctctgagacaaagcttccagaggaaggaataggcagcaatatttgctgttctgtagcctccgctggtgatagccaggcaataggcatcaacatcaacaaaaaggacatccacacaaaaaccccatgtgaacttcaccaacatcaaagaccaaaggtagataaatccacgaagatgaggaaaaacctaaaggccaaaaatttcaaaaaacagaatgcctcttctcttccaaaggttcacaactcctcaccagcaagggaacaaaactggatgaagaatgagtttgatgaattgacagaagttggctacagaaagtgggtaataacaaactcctccaagctaaaggagcatgttctaacgcaatgtgaaaaagctaagaaccttgaaaacaggttataggaattgttaactagaaaaaacagcttagc

SEQ ID NO: 479449 - DNA, 629 bp, Homo sapiens
attttccaggtaccatctgtcacccctttccttggctaggaaagtgaattccctgaccccttgcgcttcctgggtgaggcgatgcctcaccttgctgcggctcatgcttggtgcactgcacccactgttctgcacccactgtcctgcacccactatcagacaaaccccagtgagatgaacccagtacctcagttggaaatgcagaaatcatctgtcttctgcatcactcacgctgggagctgtagactggagctttctgactatggtgggtcctcctccactagagattggatcacaaatcttattcgtaggaccctggatggcatgcccaattatcggagggatgggatcatgtcagtgaagttgtccacaggtctactgggttcaggaggtggctgtgatagaaaggggcaggctggtcccaggccacctatggaatattcaggtagggcaataatggttgcattctgggccttccacaaggaagagcaggcccctctcagaacgaacatctaggcaaacaactttgagggagaaagacagtcttcaaactctgagattctttcctctgcttggtctattctgctattgacattgattcttgtgattgcattgtggtattcttacag

SEQ ID NO: 479450 - DNA, 795 bp, Homo sapiens
ttggctctctgtctccctgggttcagcatgtgtaggttcaaccaatcactgatcaaaagtgttttgaaaaattatgtgcgtctgtacacagcagctgctgcggggtgctagcgggtggttgggtgcttgcttccatgcaggcattcgccacagtggtggaggcaatgcatctcatgggtgggagtatggaggggtccctgctaatgactgtgcagtcccgctggtggtggccttcgctcaggggctcggtgttggcaggcccaggctggtgcatgaccatggaggccaccttactggagctcttcactggataagcacagtccaccagcacagaagctattatgtgattcctcagggcacccaaaactgccccacaagcagttgtggccagccagcgacccctgtagaggccagcagaccaagtagtgctcaggtcagattggccacatctgatggaaataaagacacaagacaaagagatagaagaaaagacagctgggcctgggggaccactaccaccaagacacggagaccagtagtggccccgaatgcctgactgcactgctatttattgtatacaaggccaaaggggcagggtaaggagtgtgagtcatctccaatgattggtaaggtcacttctgttggttatttagaagcgtgtcatttaacgtctgcatatttttaattaccagtttttcttctaatattgatttcaaatttcatttcattgtccttgaagaacactgtttgtttctttttcaacttttatattagaatcgggggtatatgagcagg

SEQ ID NO: 479451 - DNA, 1815 bp, Homo sapiens
ttctctctttcacacgccctatcatggcttggccttcctggactgcccaccacagctctggggcaatctcggggtttatgttcccttcccaacttaaaggcagcagaggaagggacttcagcagtggttgtggccgagggtctttcacttatttcctggaactagaccccagagagatgtgcagcaatgatcagcaacaaggtcaagaccaccgctgtagcagtggcagtgggggctgtcagttgcatctgggagccttgccccaggaaattcagagccacgaccagtatatttgttcagccataggatttactttcgttaatattactactactgtcttccccatgtcactgaaatcatactatttgataaagctgcacaatgggctcagttcccagcaatcttctctacttgatattgtgggaaaaattctggaggaaccctatttgttgtattgctgatccaacaagaccacctggctagatctgagtaaatcagaacaatgcctgccttactgccatttctacgtgagccactgtctttgctagtttagtgttgctataaatgaacacctgaagctgggtaatttaaaaagcaaatagacttattcagctcagttctgctgcctggaaagttcaaaattgggcatcagctcttatgtgagctcttaattctcttataatatatactctcttaaatacattctcttataattgtcttataatatattctcaatatatatagagagaatactatatattttctgtatatttaagtactgcatgtttaaatattttatattatatatatatataccgagaaagaatatattataagagaatttcacatttctaaaggtatgatagagggaagattttcaggttatttagtttgccacattgctggaaatggaatcatattcttataatagtattaattgacataaaaattctacatatttttggtgttcaacatgatgttttaaaatatgtacattttgtgaaatagctatattaaactaattaacatatgcattatctcacatatttatcatttctgcggggtgagaaaacttaaaatctactctattagcaatttttaagtctacaatacattgttattaactacagtcatggtgtacaagagatgccttgaacctgtttctcctgactaactgaaacttgatatccttaacgataggcttgttatttaaaggataagaaaaatgaagtatcaataggttaatgaacataaacaaaatcatgtggctaatgatgaagctagatttattctgagtccagggtctaccttactaattactttactatactgcctcatggtgaccaatttcagtttgcattttggaccctcctaaacagtgcttttcattcctgttattaatattattcttattcctattaaatttctagtattatgttcagaacaaagaaacccctgggtctgaaatcacgtggtcaccttttcagtaataggaagtgtgcaaaatgaatgtccctggaaaattacttatggctctttgaattctaatgttttgctattctattctatttaattgcattgtagcatatataaagatgtattttgtgagaacaccaacataaaaaaggtggggatggagctgtatgtgagtaaagtttttgcatgctattgaacttaagttagtagtatttcaaactagactgttataaatttaggatgctaaaggtaatctccaggttaagcacgaagaaaatatcagaaaaaacacacaaagaaaatgagaagggaatcagaattattcactatgaaaaagtc

SEQ ID NO: 479452 - DNA, 585 bp, Homo sapiens
tttcatttcacggacagcatggctcgcagatggaatgctatgaagacaaccatacacaagaagaagaaggagaaggagaaggagaaggagaagaagaagaagaagaagaagaagaagaagaagaagaagaagaagaagaagaaggaagaagaagaagaagaaggaagaagaagaagaagaagaagaagaagaagaagaagaagaagaggaagaagaaagaaagttctttggcagtcggctcccttctgatccaaggcaggtccaaaaatgctgtccaagagccaaatcctggaattagggacctcaagagcccacttggtgccataccaaactctggccgagctggcacctatacgcaagacaaaacaggaccctcagctgtaggtctgttggagtttgctggagttccactccagatcctgtttgcctgggtatcagcagtggtggctggagaacagcagatattggtgaactgcagatgctgctgcctgatcattcctttggaagttttgtctcagaggagtacccggccgtgtgaggtgtcagtccacccctactggaaggtgcctcccagttaggctactc

SEQ ID NO: 479453 - DNA, 1381 bp, Homo sapiens
agaagatagactcgaagaaagccagtctttgagctgtaagattctttcctttgcttcgtctattctgctattaatacttgtgattgtattatgaacgcttttggtgtgttttttcactctatcagggtttatcacaatggcagaggcaatgtggttcagcaggtctgggatcccctgctggtgactgtgtgcacagacgccctcttggtggtgttggcacaaggaggagctctggcagatgcaggttcatgtacactctgtgcactgcagaaggagtctttccttgtagccaccacagctgtgaatttgctgggttaccctgaaagccagtatgtctcacagcccaaggcccatggtgtacaacctatgtatcactaccgggtggttggaggggcaaacttacctagaggttgggtccggcgagtccatactctggctctccttgtgtgctcaaaagcagcagcccccatggggatcagaaagtggttctctggccccaggggtaatgttccagaaaggagtgcagctgcttctgctgtacagaaaagcctgtaaagggagctgggggtagcagacagaatgctttcaacttttcccgattcagtgttatcttggctgtaggtttgtcatagatggcttttactacattaaggtatgtccctcgtatgccaattttgctgagagttttaatcataaacgaatgacggattttgtcaaatgcttttttgcgtctattgagatgatcatgtgatttttgattttaattctgtttatgtggctggtctatcaattttatcttttcaaagaacgagctttttgtttcatttatcttttgtattttttgttgttgttatttgtttgtttgtttccgttgcatttagctctgctctgatcttggttatttcctttcctctgctgagtttgggtttggtcatgtaacataatcccagacatcttggaggatttgttcatattttttttattcttttttctttgtccttggtggattgggttaattcaaagaccttgtcttcaagctctgaatttctttcttctacttgttcaattctactgctgagactttccatagcatttcacatttttaaaagtgtgtccagagtttcctgaatttttgattgtttattctttaaggtatctatatccttgaatatttctcccttcagttcttgtatcagtttttggatttccttgcactgggttttgcctttctgtggtccctccctgattagcttaataactaacttcctgaatacattttcaggtgaatcaggtatttcttcttggtttcgatccattactggtgaactagtgtgattttgattggggggggtgttgaagagtgttgttttgttatattacc

SEQ ID NO: 479454 - DNA, 2261 bp, Homo sapiens
tgaatgtggagggtgaaatgagggtgaagatggaaaaactgcctgtcaaataaaaccacaaagatggggagaaaccagagcagaaagacagaaaatttcaaaaaccagaactcctcttctcctacaaaggaacacaactcctcactagcaagggaacaaaactggaaggagaatgagtttaacgagctgacagaagtaggattcagaaagtcggttataacaaacttccctgagctaaaggagcatgttctaacccatcggaaggaagctaaaaaccttgaaaaaagagaaaaaagtgtgaaaagaaatgaacaaagcctccaagaactatggaactatgtgaaaagaccaaatctacatttggctggtgtacctgaaagtgatggggagaatggaatcaagttagaaaatattcttcaggatattatccaggagaacttccccaacctagcaaggaaggccaacattcaaattcaggaatacagaatttttaatttatatttattataattgtgaaaattatataggctaatccagtaaacacttagtttacaacttaacacataagaaatgtgtcaataaatataaaatatcattgttattataattgcaagcacaaggagtttagacacagaagacatgagtttaccaacacaggtctaccttttgcgagctgtcatgacattggccagggaacttaacattcttgggccttagttttcatctgtggaaaatttcagacacttatttaatggaagtttcaataaacagggaaataattttaaaaatactgacagatatgaattaccttttcatatgtctgataaaatagaactaaaatagacagaaaaattaataacatgttttcactgttagtttaaagtaaacattgttggaaatctcggtattccagaaacctattaagcatgtaaggaaaatcttttctaagcagtagtgcaccttgtggtaaaaatggacataaaatacagtgtttattaacttatctttatataaatagacatgagttaaaatttttgctctgtcatttactagctgtgtgaccctgaacgacttagttaacctagctaagcaataattttctcatttgtcaaatgaggcttaatactagtatctatttcatagggttgttaagaggattagaggacatgataatttatccaaaaccacttaatacagttcctgtataaaaacaactcagtaaatggaaacttatcatgatcggtgtttgttgccgaagtgactcattaataaagactgaaggtataaataatagaaaatctcctcaagccagtaggttgtactgtagtttatctctgttggatagatgacattttattaattacttggtagctactgtccttgttttacactctaactttaacatggaacagcatttggcttttcactcttatcttcaacatctaagacattttatatagatcttatattcaatgtgtgtgattaattttttaatacatacaatcatacaatcctatggaaaacttctcaaatgatgtttgaaatgctcaattagacaattatgagtgttaaaatatctgttttaacttatggtaaaatctgtccctttttaaaactcaccgttggtccgagttaaccctctcagaccattttaaattgagattatcccttgggtgcaaatccaaaatttctaataccttttatataagatcacctttcacatatttggagagggatctcatgtctcacagtgaatttttctctttcagggtaaacatgcaaaattatttaaaacatttttcatatagcttaattgtattaccactctcagtacactttcctcaatgcattttaatttttctaattattaaaataaaatgtgatgccctgttagaaaaccaagactctgggtatcattggagatctgattagtaatattgcctccttaatgttaagtaccatacttctgttaatgaaactaataatatcatacaattttttttggctttcacatcatatttttttctcacacagatctcattgttaactaaaagttctgactcattattacacaagctgttggaaagacttccttattctatccatggacatattttctgtgttcaagtacagaagtattttatttaataatgttatattaatcttatatttttctttctgtcaatatttttgaatgctggtaataaccatatattttgtttcatgtgccactaggagtaatgctagcaaaatgatatact

SEQ ID NO: 479455 - DNA, 741 bp, Homo sapiens
agtttgaagccctgaaatggaacgctagacctgagacatgacagtgggagtcaagggatagagtacagaacccccgcattggctccctgactgatagagtgatggccattatgttgggaaaggccaaatggaagccgttagagctgcctctacctaggaaagtaatacatcaaagacaatatcacattcctggtgggaatgctgaggttagtgccgccatcaaggatttgaaagacatagaggtattgattcccatcacatcccaattcaactctcccacttggcctgtgcagaagacagatggatattggagaatgacagtgaattatcataagcttaaccaagtggtgactccaattgcagctgctgtaccagatgtggtttcattgctagagcaaattaacgcatctcctggtacctggtatgcagccattgacttggcaaatgctttttctccatttctgtccataagtcccaccagaaacattttgccttcagctggcaaggccagcaatatacctttactgtcctacctcagggatatattaactctccagctttgtgtcataatcttattaggagagaccttggacacttttcgcttccacaagatatcacactggtccattacattgatgacaatatgctgattggatccagtgagccaaaattagcaaacactctggacttattggtgagacatttgtgtgccagaggatgggaaataaatctgactaaaat

SEQ ID NO: 479456 - DNA, 880 bp, Homo sapiens
ggttggttggtgcagcaaaccaccatggcgcatgtatacctacgtaacaaacatgcgtgtcctgcacatctactgatgtcctttgttcccttctttgtggccatgtgtattcgatgtttagctcctccagccttgaaagaagacagctgcttcatgaacacccacttcagaacagagcggtccaggggagcaccaagggatgcctgggtgtgggtcattgagccaaagaggacagggatgcctgatatccctggcttgactgcaggatggcctcctaaaggatgcaggttccctggaaaagaaaaagaaaacatatataaggcagcattctgctgcaaggataacctacacttggcagatgctacctacctcatggtaactacagctgttcccatgcaggaccccggttgggactacactacccagagggggatacaggccagaaacaatatgctcctatgcctagcagaggccaaaccccaatccagtaatggatttgaactgaagtggtcctcttctccagctgtctctgagatctgacatcatcataaaaaaaaaaaacgaaaccaaggcaagtctaatggtgtcagtatatttgccagttatagcattgctgtatcaaatagtaggttctgtgttaaattctttgagagatctccaagctgattttcatgtggctgaactaatttatatccccaccagtagtgtgtaaatgtttcctttttctctggaaaattacaaacatctttttaaaaaaaaatttaataatagcctttctgactggtatgtgatggtatcttattgtgatgcttatttgcatttctctgatgattagtgatactgagtgtttttattttatgtatttgttggacacatgcac

SEQ ID NO: 479457 - DNA, 771 bp, Homo sapiens
ttttccaggtccttgactatgtggatagacttccataatgtatatgctgtccaaggtgagcaggggcagaactgctgtggctgtcgtggcagtggcaaaagggttgttggttgcctctggaagcacctccccaggaaaacacaggaccttagcagtggaaatgctcagtctaggagaagtagcaatcagaaagataaccaggagcatgcaatatcatggagctcaagagaagaaaattatcaaaatttggctttcattcaagaatgaatacattaattttccatatgtcgtttctgagaccacactccacaaagtctcagaaattaaaggcactagatataataaagatcccagtattctgatatatatttcaaaggttccaaagagcaataatgagatccggcacattctgggtactatggcagtagaaaagacaatttttggaggagaatatgcaaatatacacacctttgagtggcataaggagaagagcactgtcaagagtttgaaatacttcagagtgaaaaattagttatcagaaaataaagttcacagaatttgccaaaaagaaacatattctttcaggtttggattaatctttttttgtttaaaaaaaaatttgaagtgggtggagtaaattggaagtgagaaagagaagtcaatgtgtacagaaaactttgccaaaaacttaactgtgaagaggagagaaagacaggacagaacagcttttatataaagttgattttgttttttattttatgttttcccttt

SEQ ID NO: 479458 - DNA, 647 bp, Homo sapiens
ctgacatcaatgtgacatctttttatagagccactagagacgacccatatagtaggtcatggctggcccctctcactggcttcagcttatcatccagtcctacaatgaaagtgtgtcattacagattattgcgaatgctgctgagatgagatttgaagactactcagtggttggactgagacaaagagccaaagcacttcccaaagccaaacttgcaccaaaggtcatggtcactgttggttctgcgcctaatctgacccactacagctttctgaatcctggtgaaaccattaaatctgagaagtatactcagcaaatcagagaaaattatgaacacctctatgaacacaaactagtaaatctagagaaaatagtaaaatacttggaaacataccactgccaaagattaaataaaaaggaaattaaaaccctgaacagactaataatgagttccaagaatgaattactaataaaaaaaatatgaaaccaaaaagccccagaccacatggattcacatttgaattctgccaaatgtacaaagaagagatgggacaaattctacagaaattattccagaaatttaagcagaggaatgggtccttaacttaatgtctaaattgagcattattctgataccaaaacctgat

SEQ ID NO: 479459 - DNA, 483 bp, Homo sapiens
gttactagaagctgggaaaggtgtttgacttcacatagaggaatgttatgctgctcctaagccaaaccctaaccgctgctgaaaaacaggcagttctgcagacagcagagaatttcagacatgagcaatatgtctcctatagcagaccaaaaaggaaaagtgaaaataaggaaggtgacaaaataggggaacaatcatttccgacaggaagagacagagtacttcttcacaaccctgactccacagagaaagagagggaacacaagagaaaaacagaggctctaatggctgctttgagggcttgcaaagtacaggatccccaaggtgcattcactaattgctaccagtgtggcaagtcagggcactttaagaaagattgctcaggcagcaagaagaagccacctcgaccctctccaacctgtggcagggactactggaggtcagactgcctacaaagatagaggtcaccaggttcagagataa

SEQ ID NO: 479460 - DNA, 808 bp, Homo sapiens
tcaaagagctccttgctaaatttccttaggtgaaaccaatgaaaatgaaagaaggaaaaggtgttaacagcaggcagaagtatttacaagcaggtacacaattctacttccctttttctccatggagatttcagaggatgtatggaaatgcctggatgtccaggcagaagtctgctgcaagggcagagccctcatggagaacctctactagggcagtgcagaggggaaatgtgggattggagcccgtgcacagagtcctcaatggggcactgcccaacggagctatgagaatagggccaccattctccagaccccagaataatagatccaccaaaagcttgtactgtgtacctggaaaagcgaaaggcactcaatgccagccattgagagcaggcatgggagctgagacttgcaaagccacaagggcagagctgcccaagtccttaggagcccaccccttgaatcagtgtgccctggatttgggacatggatgttgttacctggctattatgcagacttcattgtgtggttactttagtgtgtcagtgtcctatgcatttaactgtgttttggctgtggctggcttgttttcttctgtctattcgtaaaatctcatttaaatgttggcctttttcatctgtgtatcatcattgtcaaactcccctcctttagctcaatacggcttatattttctatgcttgtattcattttttacatgtaaaaatgttttaattctccaatgcaataataagttccttgaagataaaggttattttagatgtcttcatattccctcaaagaactcatt

SEQ ID NO: 479461 - DNA, 622 bp, Homo sapiens
accacttaagaacttattcaggatggagagtgtgaactacctcagctcccctgctaggtcagcaggaaagctattcacctcacagcctcactcctgttctagtgtttcagctattcagataagacaggaacctcttttcttgtataaaaatgttgatgttccaagcagggaggaatcatcactctgcctttcatgtggcctgaatctgaagtgtgttcctcctgtggggctgcactcaccatggattgttccagaaaagctgtctcttcttacacactgttacacctccctaattccactgagtgtgctcaccaaaggccccaatgagagagtcagggatggcttccctaggcttgagctggagaatgagagtgccaataaggctctttctgctgcagcttctacttttatattttatgcagttctctaaattcattctacctctaggttaatactgttctgtgggaatttgattctgtcatcatggtgctatctggttattttgcacagtagttgataaagtttcttcatagtgtcactggtctttatattttggtgtgtttttgcagtggttggtactggtttttcctttccatatttaatgcttctttcaagaggtctt

SEQ ID NO: 479462 - DNA, 449 bp, Homo sapiens
acttctaactgccattaggattgggacaatgaccgctcttaactgcttaatacagacagtgggtgttcttttggggaaaataggagtcatatcttctctcagaagcctgtgtggaaggcttggtggaggatttttaaaactttccattggctggaagctggtagatgaagtttgccatcctccaattgcagccatcctgaggactgaagagtatatcactaagagaagcccaaccaagttgttcctggggtccctcatcattgctccttcactggcagactgtgcctgtccattggagagctccagcagggtggcctccacagataccagcccatctgtaccctccaaacacaggagccacccctatgccatgaatatatgggcctcatctcagagactgagatttagagcatgcagtacaggagtcttgagctgagcctttaccctct

SEQ ID NO: 479463 - DNA, 603 bp, Homo sapiens
ctagtttctgaattctggagggatgagatatcatgagaactcaccaaatatcacgaggacagtaccaaggggacagtattaaatcattcatgagaaatctgctccaggattccatcagcttctaccaggcctcacctccaacattagctattatgttactatgtttcaacattagcttccttgctatccagattcttaattgtatgtctgtcatttcagtcattcctgactggataaaagccattgctggggagctactggacgaatttggagggaacaccctgtgggacaaaaggaacccgatgagaggccctgagcaccagatcctaccacttgaggaaagcctccttcagcagaggcacagtttaagtgctaagctcaccaaggaatgtcttcagttatcttccagccgtcaaacagccctggtgcatgtgaagggccttggaaaagaggaagtctttccctacttatccaccaaaataagcacagctgtggcttctcccatgggagtgtgacttgggtgcaaatataaacagactttctggaacacatcaggatgactgcatcttcaaagaagaagcaccttcctgtttcaggtttgca

SEQ ID NO: 479464 - DNA, 725 bp, Homo sapiens
ttaagaacccaggccataaggaaaataactgaacaaagacttgaaatattcccaacacaaagagatgatagttgttcaaaatgatggatatcctaaaagcccagatttaatcattgcatatcctatgaacatatcaaaatatcacagtttgcaagtttatctagcttcaatctttgatgctgctgatgtttggatggagtttttgtggggactttttgttgatgctgttgttgctttctgtttgtttgtttttcttttaacaggcccctcttctttagggctgctacagtttgctgggggtccactccagattcaatttgcctggatccctcctgcccctggaggcctgctcccgcttcaccttccaccccgagtaaaggcttcccgagggcctcaccaagaaggcttgttcagcctgcagaactgtgagccaaataaacctttctttcttataaattatccaatcttaggtattcctttgcagcaatgcaaaatggactaatataaagtctaattttctgaaaatagcattcatatgtccatctacttgtagacatgagcctagggatatcatttttgtggaaataaaacaagaaatatacacaataacttagatagctctcctaatagtcaagacctctggcttgctgtttggtatattttgggcattgtatccaggcagcgccctcaatcactgactttgtgtccatgcttctgggaccaac

SEQ ID NO: 479465 - DNA, 1956 bp, Homo sapiens
agtgcccagaagtactcacctcggcttggctcctgcaacaactcagctgcacttccccttgcctgaggggtggatcctagttatcaagaatttgaaagtctaaaatacgaaaaaaaggggggcagttcattatgaatctatatgacctacccgccctcatcctcattcactgtgacagcatcatcatcaccgacagtagtacaggcctttgcatttctgtctcaggggttaactctatattgcttgagaaaatggtgatagtatatcctgaggcagttgccaagcaaaacaatactgactttcctcagaacccacccccaccatccctctttgcttatagacctatagctagactcaagtcccagcaggcctttaaagatgaggtaaagagtgtaacccatgaggggatgtgctactctatgaaagaaatacttgagttttctaagaataagtgtgaggggaacacatgtgggaacaaatatcatggagggagaaatggtttcaccaggagacacaacaataattttattgaactggaaattgagactgccaccctgccactttgggcttttcatgcttctgagccaacaggctaacaaggttacgttgttggctgatattactgttccagactaatgaggggaaattgaataaatactttataatagaggccatggtgattgtgctagttgttatactaagcacttttgttcttaatgaagaaaatagtctcataaaaatatatgtaaattttgtgcttattttatcactgccctgagctacagaacttttgcaccttcctttgcaaatgtctttatggttatgacttcataataataaaatacatggttactattccctgtctatggattggacttcacaagccccctttgcacttcacatacctgaaatgcactaaagtgaaatgtctgcctcagagggaacaccatcaaaacgcacagataattaaaataaaatacttctgtaaacggcttcagagtatcaagtctgccaaattgccctaacagtgccttttcatgtagtcagtatgtaataagtatagtactttatagaaaagtaaatgcaaaattactttcaaaaatagtaaactaaacataatatttatttttctccaattatcttttcaaatgacttcgcagatttgaagatagcaccattttcctgtagtgacaacttgaggttttaatttagaaagttagtaatcatttcaaaggtatacacacatacatatatgatcacctttactttgtagtttttcattcttttccttcagttcattgtgtgccatttttgcaccctctgcccacttcccaaattgtatttaacacacttttgggtggttggtcatgttcggtaaatgtttactaaccaagtaaaagaagaaagaaaaaaagcagagggaaagagagacaaaaattccatttccaatataaatttataaaatcattattagcagtctataataactacatatggagttattatgtattaaaaaactgatataattatggaaaatcactactatccttactattatatacaacttagggaaagttttactatactgcattaatatttttaaaggaagaccaaaaagttgaagttacaatagaattactatgacttatttttgttgtaccatatgttaatgaatttcacttaaaatgttatgtgaattcatgtgtaattacaaaatttaagatacatattaacaataaatcactgttcattattacatttaatttttttaattaaaataattttagaattataggatgttgcaaaatgctcccaaaatgtacaacatgtactttatctagattattcaaatgttaaaatttttcttggtttgctttatctttctcattctctatgtacatacatcttcacacctgcaaacacccatttattctgaatcatttgcaagtaaatttt

SEQ ID NO: 479466 - DNA, 681 bp, Homo sapiens
gaaatgcgtagtatttgatctggaatgcaccaatcctcacggcacactccttcatggcttttcttggctaggggagggagatgttgcccaggtcatcagaaaccttccataaaacacatacacaatttgaaaataaagtttgaactcttcttaaaagtgttcagagtacaggatggaaacaaatcccccaggaagccccccaaaagccagaatattggattcatgattgaactcttcatgctcaaggagaagctgaaacttgggggttttctgctcaattctaatgaactggagggaggaagaaaaaatgtgaaagtgtatgggcaagttttaagaggaaaagagagggagaagaggcaggacctgtccaaacacccatgggaagagactgtgatgcaaagaaaaaaagaagcaaaagtctggctgaaatcaaccccaaaggagcttaaagctcagtggaaagggaatcttttgcctttgagccactgcaccaccacaccacctgcagccataccccacaatccactctgagtttggcaaggatagaggactagtgagtccctagtgagttgtaggtcacctgaatatttaaccttaattgtggaaaccctttagggatcggggagcacggcctgccaagaccacccataggacaaaggaaatatggatatggcagcagcc

SEQ ID NO: 479467 - DNA, 720 bp, Homo sapiens
gcagcagtccatggtcagattatggaccactgaaggtctcttcacttccccttttcccgcagtagggaatctcttaaggctcctgttaatcttggacaagctggtcactcactttcttctccctctgttcatcagcctgcagaccatatctgcaggagctggcctgtgggctgagtctatgagcactagcctggtggctgagtctgtgatatccagctgggaggatttaaacatactgtgggtcatctcttatactgtaaatctaacaactcttagcagggaaagcctgagagaatacgaatgttctccagttggagactcttctggtgaggcagtcatcagatccctgactgtaactggtccataccactggcttgttcccactgtccatcttataagtgtactgccagaataaactgcctgaacattaggtgttgcctaagatccatcattgacacgattggaccatagggaaaaaaaattgcctgtggggaagctggccaaatgggccaacccaagacccctgaacacaatagaggcttttccacttttaaaaatataagtacttagtgttatgcattttcctttcagtacagcttttaatatgttttattttcatttattttcagtaatagcatatttaaaattttcctttgcgacttattcttgatccataaattatttcaaaatgtgttgtttagttacatggataagttcttt

SEQ ID NO: 479468 - DNA, 2765 bp, Homo sapiens
tctgctcgaggtgcagcagtcttcccgctccaccaggtcctttatgttactctataaactggttattctagcctcttctgcaggtctgctgcagcttgctggagttccaatccagacgttgttcacctgggtatcaccagtggaggctgcagaacagcaaagattgctgcctgctcctttctctggaagattcgtcccacaggggcaccagcctgatgccagccagacctcttctttcgattatcccaggtcaacttcagactgctacactggcagcgagaatttcaagccagtggttcttagattgctgggctccgtgggagtgggacctgcttggcgagacctcttggctctctggcttcagcccccttgccagaggaataaacagttctgtctttctggggttccaggcaccactgggaaaatccttccccattatgaccaggacaacatcacatatgtcctacaacagcaataagaggaatagcttaagattacatttatgtttttcagcacacagtgttctcaggtttcccagtttgtgcactttatctaaatgtcggttagatttgtcttcatttccatatgctttgttctgtcaatcatctatgttctgtgtttctaaaaatatacctcagtggatgtaattttccatgttgtactagacacacacatgcacgcaacttatctctcagtgtatacatgtagacatataacatagatgccattgaaaaaaacacttttgtgataatatggaaatctgagaaatcaactttcaaaataggaaatatcatacctaaaatcagcttgtggcacttttatagctctattattcttggccatgtatgtattaaaattcaaggcaccccacttcactgaggctccaaatcaaaattatataatgtctcttaatacctgtgtttatttatgacatccttgaaaatgaaaacagaattatgtacaaacacagctcttttcattttccctatatttaactgtctgaatgccaagcctacatcaccaaatataagttctctcttaaactacaagcttaaattttcaaatggctgttaaatattatgtttctcattaagattctaagtaagatttagtttgaaaaagtatttcccaataatgatacataaataatttgtaaaattttagtaaaattttcagagcaagaaatacttgaaagccagtaatgtattttaaaatgcttatttcagaaagataaagacagtgcaaaagtgaattgccgagaccacacagctgaatgcctttccttatttttcatcagcactctagttcagaatattgaattattaatccttatattccttatacatatatttatttacactcacatttatatttactctggcttattcagtcatttaatgaagtaatgtagtgtaagcatttgctatattttatgaactctgttacactctagaaattcagtattaaatgctctctttctacccttcaggaacctgcaaaattgtgaggtagatcccataagtaaaccaataattgcaaatcaaattattaagaaccaaataaagtaaaaaagattattgtgaaagcatagttcccaaatgattaagtcattccgggtgttgtaaaaaaggtatactatgaaaattaatatctgaaaggagacttgaagaaaaaaaaatagatatgatcaaatagttttaggagtcgtgggaaggatgagctaagggaggagaagaggaaactaataatctaagcagagaaaacagcatattaaaattcacagaggcatgagagaacacagcatgtccaaaaatggccttagataattgtggatgtaaaaaaaatgtagcagtgagagtatgttaagagataaggttaaaaatgtacacagtgccagtatgtatcttacatgacagcctgcgcttagggacattaaagtgggcattgctgttttagttatggatgaggctctaaggcaataagtgacagaaaacctacctaaattttcaagcaagtagctcagtgagctaagctcaacttacaaaaaaggtggtcagaaattggattttcaacccttcattgatagccaactcttaagtgtaaaagtaatttaaagtggaacattgagaaagacagaaattagaagtaatgaggtgcatcactgcctatggaaaagggttaaaggagctatttttttcttaccacaagaccagtgaaaaggatttcaagaggacagcttagagagctcattgtcagtcttctggaacttaaagggcacattcaacgggtgtatgactcatgcatgagaaatcagagagcaaaagaattgactaacatcatccatggaagttagggaataatagttggaatttgaattcattataaccaaatgcatgtgcagcagtataaatgttgctgtatccccaaaactattatcgtaaaacttaatccacaaggtgatgatattaggagatagggcttttgaaatgtgattaggacataagggtagagtcctcacaaacaggatcagagcctttttaaaagaggctgggatacctaatgctagatgacgagttagtgggtgcagcgcaccagcatggcacatgtatacatatgtaactaacctgcacaatgtgcacatgtaccctaaaacttaaagtataataaaaaaaaaagaaaagtaaaaaaataaaaaataaaaaaaaataaaaaaataaaatgaaaaaaaaaaagaggctgggaaaatattccttttttgttcattc

SEQ ID NO: 479469 - DNA, 1132 bp, Homo sapiens
ttctgccccagcatgtattacttatatgcttttttgtctaaaaatcactttgtagaaatcaaaggctgtgatgcatttagggatttcatatacattttggtagtggatgacaccagagagtatgaggaagatctagagtgccagaggaatgaaagtattgatattatgttcaggcaaaaaaggggcacggagtgggaaggtggtcttccccggggttgggctgctaagtggctgggctctcctcccagtgccctcagcggaattccccttggcatccacgttgttctgccattgatggcctgccggcatctgttggtgtgttctgctggtgtgttcctctccacgtccagctgctggtgtgtgtgtgtccgcttaaggtctctggcttatatgggcacaggatggggggtgtggtgagcccaaaggcaactttttgtttgtgaaaacagaaaagctggtcctcacttaggaccgtgggcacaggcctgagggtggagcctttgtcagggacctcacccttctctacccagcatttccctgcccccatcctgtatcagtagtatcctagtgccctttaaaacaaatagttcattttgcttgctagcattttttcatttttaatgtatctgttaaaggtttttgctttgtggttaccatgaggcttataaaaacatcttaaagttataacgaagtacaccaatgactcatatacttgctcttttgatatagttctataaaactcattagcttttttcatacattcttattatttaaaaaatttctcctctgatggtcaaatttaaaataatctatcttcctttgagtttttgtactttttaatttaattgatcatttctgctgttgctacttttcattgcatattttatgaattgtattttaaaataattttaatatttctcacacatttctgattttttttattttattgaacttaactaagctttttaaagacaggtgttttgaattctttatcagacaatttatgcatcttcatttctttggaattagtcactgacaccttattttgtctgcttggtggcgtcatattcttccagttgttcttgattcttgtggtcatgaatcaatgtctgcacattgaagaggtaggtac

SEQ ID NO: 479470 - DNA, 4117 bp, Homo sapiens
caattgtccctggagcagcaattatggaaaatgcccaagagggggcaggttgctgttgctcgatccagtcctgcccggaggctggctacatgcatagccccaccatatgtcatggtcttgctgccacagatttagctgcttggaaatgtccaaaggaggtccacctattccattatattgatgacattatgttaacctctaattctcttgcagatttagaggtgactgcacccctcttacgacaacatttggcaacatgtgatgggctgtcaatgaatccaaggtccaaaggcctggattgtctgccaaattcttgggagttaactggtcagaagccccctccccctctccctctctctccccttttccaacttgggacccttcgtgggcagtgcctaaatatggaagaaacttcaggtttctcgccacggccagtgaaactaaaagtctttcagtggctgtttcctagtagttcattggaaattaagggcaattgactggtgccactacccgggtttcactgaagttttaagttgctaaggataaaatttttagttaacatgtaattccgtatccaaaatatgccataagggttatgttattagtaaataaaaataataataattttgtataattcagaagttatctaaaagttagttcaaaatacacatttacaaaggttatttatgaaacaatgtagtaaggaacgattaagtaggggaaaaatgaggaaaaagtttaaataataaaatattctttaaaacctgatagagaattggagatatttggctaattaacattttcatagttaaaactcttagtcttgattaaagtaaaataaaaagtattgtaaaaatacatcggcagtttggaaattctttttttaatatagctaagcatgaagcttgatttagtgtaaagccgaatttcacatacatgcttgcattgcttcacagtgtttactgttttgcatggatagtgctgaagtacttattggtcatgtgcgtaaagtgaatttcttaattgcacagggtgtatgctgatattagtgaatttaaggatattaaattgtgtagcaggaatgaattattcattatgtgggttttttcagggccccaggtaacactgtaacctgtaggtaaattgagtaggaaaatttaggattggtttcctgcatatttgtttttgtctctagttttcatttgtttgctgtttattctcctgtggctttgcttgtgtgtgcatatatataaaaccataattttttttagttcttagtggaaggcttttctttagttatgtgtttctatgcatttccagcaagtcatcattcgttcaatttatctcgaattcctaagctacctttgtcgggcctgcaggaattaatggagcacaccagctttttatccttaaactaagcttttggattttaagcttcctattactttaactgtgttgagtgtactctttcaaacagaatttgagtcatatttctgtctctctgcctaatttctccaaaatttgtaaagtatatgtgaatattctcaattcgcagcaacgtgtttgtatacagtcaagcagggttgccagggccactcaaggagagagaacccagaaacctggcatgcctgcaaaagggtaagaatttcttaccagtcagtctctggcctctttctctctgtgcaaactggttaatctcttctgtgaagttttaaattaattgatttaataataacaggagcttaaatcaaatattttgtcagaaaagtgaaaaatgtaatgccttttatttagttcatgtgacttaagtaatctctggaaaataaagatggttttaaaaattattggtaaaatgcaggtgtcattaaaatgtaaataggtgaaccaaactgtgtaggtcagatgcaaggtttgctgaatgttttaagttaacaaactgcttttggggttttaaaaactatttgacttgcagtctacacagtaggtaaggcctggggacatatggaactaaccacacccttaactaagaaggcaaaccttggctgcagttagcacacaattaaaccaacttaccaaattttatcttaaagctaaaaattgctagcagttaccatcataacttgtaattaaaactactgaaaatagatttacatgcaaggtatgtaaaaacagtaaaatgtgttttctaataaaaggttataagaaggaatggaaatataaatttttgcctagggttaaagaattcttttaaattagataggaaaaagctgaaggttcaaagaagtggtggaaaaattgtgaaaattaatcttgcagaagaggtgtccgtgtgaacacgttaattaaattcaaaaaggttattaaaggtttttacttctttaaaatttctgaagtcatcattttggcaaaataaataatttatggtaatctggaaatccaaaatcaaacttttgtttaaaaattgtctttcctaatgcctggctttttggatggatcagagggtatctgaaaacatccagaaaggaggtaaacaggattatttaacatgtttaggtacatgagaatgccaaaatgatgttcaatatttttaggttatatttttgtgaataatactaatatatgttccaaaattgtatgggatttctaaaattctaatgtctaagtatatgctatcaattatgattatggctattatgttatgttattgtaaaccatagaaataaccaaattttattttcagtgctatgcacctaatttgaaaaaacaactggtatgcaagaggatataagtataattttaattaagcatggatggactcatggagaaccaggatggtcaccttgtccttcctgagtccttgaagttttattattaaaaggtctgcatttcatgactcattatggaaaacataaaatgatccaaattaaatacattggtatagtaacttacaaattgtttaaaatagtttataaccaatgcttaatcccatattcctgggaaaacaattaaagcttcaggtacctttggtcacctgatgggtcatttatacattttataaagggatttcattcaatttttattttctgtgcatgttatctggttgtataaaagctttcctatgcaagagggctgatgttataacaataaattattatgctcacagtgtgttttcaccaggtaaagaaacttttttatgctttaaatcttctggaaacatgagagaaagactgcctttgtcatccacactacaataaaacttcaaaaaccttgggctttggattcatggtctcacaaatgagaagtatccctccacacttttggaactgtgcacccattggaaaccttgagataaagctaaccagggaaatttctcccaagaagaaaatggcacctttgatgtgaataacttttcctaagttcacagatgattaaaacttttactatcaaaaaactcttatctttgaatttttttcttgtttatacttccataaaaaatagaagtggaaaaggggtctgttgtgtgcacttggggggtatacttttaattgtaaagtggtttgcagccagccttacacatggataaacttatactttgataaataaaaaatgaaggcccaatgtatgtaacaaaaactttaatggtacatgtgttgcctcaaaatcagtcaaaaacaaagcattgtttcactcctcttaacccacatcatgggttaaaaagaacattgccagaacactgccagaacaccttcacttttttaaaagggcatcatttgtaggtcctttttccatggtttaaagtaaagaagcattgttaaaaaatgtatccctcatgataggttctgtatgtatccctcatgataaattctactgtaaaggctacagttacacaacagactttaaagtctcttgtaaaagttagggtaaataatagaattggatatacagaaaagtacctgtgcagctgctggcacttgtagcctatggaaatatacatcaaattaaaattataggaattcagtggtaggtgactaatagagtctgcttagttaggtgagcaaactctttatctagctcattctttaatctgtttaattttagaaggtttggtttatgagga

SEQ ID NO: 479471 - DNA, 2016 bp, Homo sapiens
tatctacaaccatctgatctttgacaaacctgacaaaaacatgaaatggggaaacaattccctatttattaagcctattttctacaacacaccacttggcacttgtaaattgcatggcagccctgctatgaggagtagtggggtctctgccaatggcttgccttttgccctggtggcagcagccagtggcagcacccagccatgggcaaaagacttgaaaggctcagaagacaggaagatgtgggaaggtttggaacttcctagagacttgatgaaaggctttgaccaagatgctgatagtgatatggacaacaaagtccaggccgaggaggtctcagatggagatgaggagcttactgggaacatgagtaaagctccagctatggctgaaaggagccaatgtacagttaagggagttgctgcagagagtgcaagccccaagtcttggcagctttcacttgatgttgggcctgttgttgaacagaagtcaagatttaagggcagtgcaaaagacaaatatggggtagagcccccacatagagtccccactggggtactgcctagtgaagctgtgagaagaaggtcaccgtcttccagactccagaatggcagatccaccaagagcttgcactatgcacctggaaaagcttcagatgccatatagaatgtgaattcatgttcatgaagacgatgcaggaggaacttaaattctagtgtggaaagaaaccccaaaaatgtgcaagaaaaaacaaaaaaaaaacctgttaatttgaaataaagatagtgaataaaacaaacaaacagaacagagttaagcataataggaagaataatcttccttgaatgaaatagttggataaatgtatctgagtggttgacataaagctgagaactaaatagcaatatttaaaatttaaggtgtttccattaatacaaaggtgaacattaaatctaaatatatttttacatttgaagaactagccaaatttgaaaattatctatagaattgcttcaaaattgctgacctaatatcacatttggaggaaaaaagcgtcaaaatggcatgactttatcatgtactggcttatcagtgtgaagattattggaaagatactattccaacaatatttttgcaaactctgtaacccatagcaaatacactaaatgtgcacagcctgataaaaattagcacattagctcatcgtgttccagtaaagatttgggattttattttatgcactagaatcttgtgtgtgaaatattctgaggttgaaaatgtacttagtaaaaacttgtcacttataatgtacttgctagcatgtttttaaatctaaaaattctacacttgaaagtaaaaataatagcagcttcattaattccaggtgactagtttacaaattattacatccatttattcactggactttaaattcaagtaagcattgaatcaactctaattttatattcaataattaatacatatattgatatttgtggtatattttaaatgtgaaaataatttataacattagcctgtaagaagctagtttttatttctaaaccaaatgactatgttgaatagaaatgtacactggacttttcaagtgatggtccaactttggaaatttctttaaaaatcaagaatggctactaataaattgcttggtaaaaattctgtatataattacattgaacaaaataataatttattatgctatgcaagatctcattattcctgttattttgtggaaatagatggagaaagggagaagagatcagaaatcctgagaaatacagataaatgtattttctctgattaatcaatgaagattctaataaatcatgatggctatcattcatgcagagccaaccacaatcatacaattaatgacagttggcatttaaatattttttatatttcaagtaatagaaaaaacagtcttgatgtattgtctaacttaatttatttttacaataattataagtaataggcaatactgtcaccacaattttaca

SEQ ID NO: 479472 - DNA, 994 bp, Homo sapiens
cagccatatttacccaatacccggaatgtcagagaccttcacagcagcccctcccatcacacacctggaagtttaggagaaataaacggtatcctgggtcaggcccagggccctcttgctgtgtgcagcctaaggacttggtgttttgtgtcccagttgctccaactttggtgaaaaaggtccaagatgtccagtcagaagtttgctgcaggagtggagcccccatggagaacttctgctcaggcagtacagaaaggaaatgtggtgctagacccccacacaggactccagaatagtagatccaccaataacttgctccgtgcacctggaaaagccacagacactcaatgccagtccatgaaagcagacagaaggggagctgtaccctgcaaagccgcaacagcggagcttcccaatgccatgggagcccacatctggcatcaatgtgacatggatgtgagacatagagtcaaaagatattattttagagctttaagatttgactgccctgctcaattttggacttgtatggggcctgtagcccctttgttttggccagtttgtctcatttggaatgggtgtatttacccaatgcctttactcccattgtatgtagaatgtaactaacttgcttttgatttttatcagctcatacatggaaagaaattgccttttctcagatgagatgttgcactgtgaacttttgagttaatgcagaaatgagttaaaactttggggaattgttggaaaggcatggttgattttgaaatgtttatagtattttccaagtttgctggatttttaaaattgattctctgtctgaagattctatgtattattgaaagtggggtactaaaatcaattactactattttattgctatcactttttttcattcagatgtcaatattttttctatatatttaggtgtcctgatttggggtgtatgtatttacaattgctatatctccttccttttattattatatgataa

SEQ ID NO: 479473 - DNA, 691 bp, Homo sapiens
tgaattgtagcatgaattatatttatataagatttattgtgcaaactgcattttatatttttattaaaaactcagacgacaaaaaagatacatctgaaaagggcatgaaacctgtaaggcgagtaagcaagcttacaaaagcagaacaaaggcagtttatcagtgacaggttttataactcaggcatgtcttgtgacctttgccatactgcacagctggaaaacaggaacttacaaaatccttacaagcttgcagaaatagttatgagaggagaaaaaaggaataacggagtggggaaagaatttcaaagggaacctctgagagacttgctgaatggctttgacaaaaatgctgatagtgatatgaacaataaggtccaggctgaggaggtatcaaatggagaagaacttggagaatctgatgactatgtgtcctggggacggctatcttgtgcagtacctttcaggggttctctttacttcctgaatttaaatattggcctctctaattataaacctgttgtgctagagaagctgaaatgtccccagtccactggccacaacactctgatgggtgattccagccaagccacttcatcagggcagtgacagcgggatccattctcccttgcacatgccagtagccgtggcagtgagaaataaagagttcagtgcacatatttacagtgcca

SEQ ID NO: 479474 - DNA, 614 bp, Homo sapiens
aaaagtcaattaatggaagcagcccagatattcttcaatagtttcgcactggcaactgtatcagctcagggacatgcttctggcagaggcagagctggtgagttccatgcctgctaatgctctgatgacaatggtgatggagcagggcaagtggatgagctatgatgctggctcgcagaaggtacctaggggctgcactgtaagcagacatggcgaggctggggccctgagagaggccagcctaccaaagggtgctcaggttggaccagcccctctcatgggcaaaacatccctgcagggttcaggtgcacagttcaagctgtcaatgtacctgccagtctggggtctggaggagagtggtcctcttctcacagcccccctaggcagtgacccagtggggaatatgtgtgggggctccaaccccacatttgttctccacactgctctagtagaggttatccatgagggctctgactctgcagcagactttttcctggacatccaggcatttctatacatactctgaaatatagaatgggggtgttatggggagaattggtggttgttaaaatgccagcttttagtagtctggtgatgatgggttttattcccct

SEQ ID NO: 479475 - DNA, 663 bp, Homo sapiens
ctgttctaaagacattttaagtaaacggatgatgcaagatttttctcagccccttcactggactcatggcagggacatcctctctacttggcccaccttgttcaacctcttacagaagctctgtgtggggaccacagccagaccatgtgtgtcacctcaagaggagtggagtgatgccaatgtgaggatgcccatgaccctgaatccccagagagtgtgtgacattgcttctttagttcctttatccacagacaagattgtgttagcagctcagttggccccttgcctcattgcattgggcagcttaccttcacccacaagggcaaagggctggtgtgacagcatttctgggtacccacactcagtgggtcctgagctcttatctggaatccaagaagaatgagatcacatggattgttgaaggatgcttaaggtggagaaattttgagcaataaaaacagctctcagtgaaaaagggagatagagaggggacaggaaagacaggtcgtatttcccaaagtcaggttgtctcttccccaaagtcaggtcatctttccctccacttactgagtctggggtctttataggcataggatggagagtgcatgctgattcatttttaaaacaagttgaggcataactggaaaactatttttacaagag

SEQ ID NO: 479476 - DNA, 807 bp, Homo sapiens
tctgaattcttcagcttttggactcttggacttaaaccagtggtttaagccagtgacttaaaccaggggctctgggtcctttggccgcagattgaaggctgcactgtcagcttccttacttttgaggttttgggattcgaactggcttccttgctcctcagcttgcagatggccttttgtgagacttcaccttgtgatcgtacagcagcagcagcagcagcagcagcagcagcagcagaagaagaagaagaagaagaagaagaagaagaagaagaagaagaagaagaagaagaagaagaagaagaagagaaagaagagaagcagcagcagcatggcatagtgcctggtttcatgccagtggaagtgttaccacaggggcggggtgctgttgggctttgtgcccaccagtgttccaatggcagtggtggggcagtagggaaaagggacgcattgtgcactcatgccagcagcagtgacacagcagggtacacacatacatggacttgggcagttctactgcaaaggcagtggcagagactttcagttgtccctgaaggttctgcccagggagttgctgagttgctactggctcgatagctcttgcatgatgtggctggaggccaaggcttggaggacattcctggtgaggagatatgaaaacaaacatgtacctgatttctttttttttttttcaatttggatgcactttatttctttttcttgtcagattgttctagctctaggtacgacttccagtactgtgttgaaaaacaatggtgaaagtgggcaaccttgttgtgtaccaga

SEQ ID NO: 479477 - DNA, 608 bp, Homo sapiens
ctaacggagaagctttgccacataagaggatggaataccaaacttcctatggatcaggctctggagagtttgatgtcctgaaaggagagttaaggcaagaggttgaggttgcagcattttggtcaaagccattcaacaagtctgcaggaagtttcaaactttcccacatcttcctgtcttctgagccctctaagtctctaggaagttccaaaatttcccatattttcctgtcttcttctgagccctccaaactgttccaacctctgcccattacccagttccaaagtcacttccacattttcgggtatccttatagcagcaccccagtctaccactacccagtctatggtattttgttacagcagccccaacggactaagataaagtttttatgtgaagctatttataatgtaatcagaaattgctgcatagcaagatatagctctgcttctagtggcacttacattacaaactcattgagtgaatgggatctgagaaccaagtctctctttatctcctgacaccaaaaacctgaacatcctccagcggtaataattccaccataaaagtgggcttttatgacggttttgaccagttagagcaatagc

SEQ ID NO: 479478 - DNA, 841 bp, Homo sapiens
ctcacactgttgtgcagtggccataagatcaggtattgccagtcaaccatgagtggaactgagtggaccatgaatccaattgatgagtggactgtggaatatgagaagcaatgttgtgttattctcagtgcatatcaggaggcagcttgtcccattattgatgatgctaccttgaattacttggttaaggagaggctggtggtcagccctggggtcagtaaccacaagaagccgtggctcccggaaggctgcctggatctggttagtgaaggttccaggagtgaagtggccagcaattggagtggctccagtggcagcagcaaacttcagcacagccctctggccagtattcccggaggatataacactgacatcagcagggttttcaatggcaacaacagcacgagctgccagcagaaacttctcccaggtcctcttcagatttatgatatagatgccatcacttttccttttatagatgacatcaagggctccggacattgtgaaagtttccctttaagttacgatgggaatccagaacaacgccatatggacccctctgtaggtggaaagcaagtgaccccagatagtaatccaaatccacaaacacaaaaaccaaagagcactggggaaggatcaagagggaacaccataggtcatgagtctcttgcctacttccaaggggccagatagctgctatggccactggaagcacatggggggctcttgtccctaacttttaagatcattaggatggattaaagagggcttagttagctttgggccccaacccagggctcaaacacagtaggttaatcactctacagataagtgacatatc

SEQ ID NO: 479479 - DNA, 1372 bp, Homo sapiens
agctcatgataaaagttgaatggatgaggagttgcttcttatagatgagcaaagaaagtggttttttgagatggaatctactcctggtgaagatgctgtgaacaatgttgaaatgacaacaaaggatttcaaatgttatataaacttagtcgataaagcagcaacagggttggagtggattgactccaattttgaaagacattttgtggataaaatgctatcaaacagccttgcatgctacaaagaaatcttctgtgaaaggaaaagtcaatcaatgtggcaaactttattgttttctcattttaagaaattcccacagccaccccaaccttctgcaagcagcaccctgatcagtcagcagccaccagcattgatgcaagactctccaccagcaaaaagattacagctcactgaaggctgagataatcattagcattttttagcaataaagaattttttcattatttcatttatttattagcaataaagcatttttcattttttgttttgggcataatactattgcacacttaatagactacagtatagtgtaagcatgacttttatatgcactgggaaaccaaaaaatttgtgtgatttgctttactgtaatattcacttaattgtggtgatctgaaaccaaatccacaatatctccaaggtattcctgtacttcttgattgactagttcagttcctcttctaaagaaggatagtgttggagtggacactgttatttgcctacacaatgtgagctaaggcttgcattacctttgcacatggcacaggttgagtaccctgtatctgaaatgcttgggactagacctattttggatttggaatttttttcagattttggaatatttccatatacataatgagataccttagggatgggatccaagtctaaacatgaaatgcatttgtttttcatatacaccttatacacatagactgaaggtaattttatatactattttaaataaatttgtgtataaaacaaagtttgttttcaatacttatgtgtggaattttccactcgtggcattacatcaatgcattttggagcattttggatttcagatatttagattaaggatactcaactgattggtccctggtgccttatttacttcatttggtgaggtcacattttcctggactgtcttgatacttatagatgttcgtctgtgtctgggcattgtagtctttgtagtctgagcttgtttgtacatgcccttcttggaaaggctttccagatacttgaaagcacttgagtgttgtgatctaatctgtactgctttaggggggactccaagcccagtaacagtgtggttcttgcagactcatagaggtactgccttgatggtctt

SEQ ID NO: 479480 - DNA, 845 bp, Homo sapiens
gggtgactataatagtcaaataggaacctccatactgttttccgtaatggctgcattaatctacattctcaccaacagtatacaagagttcccttttctctacacctttgccaacacttatctcttcgttttaataatagccatcttaacaggaggaactagtggaccccagtgtcaactgcttcaggacaatctagaaggctacaaacctgtgcagcatgtgactctactgaatactgtagacaactgtcacacaatggattttgctagttggcatcacagagagttggaaatgatagatttacaccggattaaagaaagaagaggttttttattcggctgggagcgtcagcagactcgtgtcttaagagccgagctccctgaaaaagaaattcctagcccgtttaagggcttacaactcttaaggggtctacgtgaaagagtcataatagatcgagtaagcaacagagaaaatgaaagactgccaaacttgcccttggatatgaccactatcaacaatttggtgcacattttatttaatattaagcaaaaccactattaaaatttggtgcatattttattggtgcatatttccactattatcaatttgcgcatattctatgtaatattttatgttgctggatttggtttgccagtatttttttgaggatttctgtgtctctattcataaaagatgttggtctatagttttcttttcttgtaatatctttgtctggttttggtgtcagggtaacactggcctcatagaatgagttaggaagtgttcccttctcttctattttctaaagcatttgtaaaggattggtgctaattcttctttaagc

SEQ ID NO: 479481 - DNA, 680 bp, Homo sapiens
gttaggagcatgggttctgtcaccaagcttgtggtgatttgttatggcagccctgggaaaccaatacagacagcatctaagggaagagagctaaacagagagaatagcaggtgcaaaggctctgaggcagatcttttgcctgcctgcttgggaaagagcaaggaggtctgtgtgttcgggatggagggagtgatgggttttctgcagctgaagcagaagctgaaggagttaacaggtggaagttctctgctaacagcactttccacagctgggcagcatgttcttcctggaagaggagggatagtgtggtttggttctgtgtcctcaaccaaatctcatctcgagttgtgctctttagtgttggaggagaggcctggcaaccgtgatcttgatggatctgaaaactgtgacacaggaagaatagttgagtgtgtgtatccattcaccagttgattgacactttgattcttgccaatttgggaataccattaacaaagctgctatgaatatttcagtacaagtctttgtgtgaacatatgttttcatttctcttgggcatatacctaggcatgggatcactgcttcgtatgagcttcattttgggatttctattgctaatcttttcttctgcaaagtctaatctcccatgaatcacatttaaggtatttttcatctcacct

SEQ ID NO: 479482 - DNA, 1218 bp, Homo sapiens
ctgaatttgccctatgtcgtaaatagaggttaaactaggaaccaagaggcctgatctggcttctagtcttgtctcaaacatgacctgccgtgggaggttctttccagctcattggatcttggtttccttcactacgaagttactgattaaaagtggaattacagaatcagaagaaagaaacacttttaagactgctgataaatattgtcaaattgctttcataaaaggaattcttatttttctttccattgacagtataggaacacaaaaacatccaatcatcaacaaagtaaaattcacaatgtctagcaaccaatacaaaatgatcaggcatgcaaaaatgcaggacatagtgacccaaaatgaggagaaaaataaattcatcaaaacatatccacgaatggcagagaagatagaattagtagataaggatattaaaacaattataaatgccagagataaaactgcaatatttgagatgaaaaaaactctggatggaattaacagcacattgaactttgtagaagaaaagattggtgaacttgaagacatagcagtagaacgttaaggaaaaaatgagtgtgtaatataatatgatgcacttttatgaaataaacgatgacaaacactcatatgtttgtatgtgtgtatacaattacgtaagcttggtaaggatacacaccggatagtcaacatgacgtttctgtgtgcacatgtgtgtgtgctcgtgtgttggaggggtaattgtgggacagttgcatcaagctttgttatatgctattcagtataaagaggtcctagacatagttttaatactttcaagtactttaaaaaaatcatgcttggattgttttatcttattttttgagatggtttgaaggaaggagaagggagagatttatgagctccctaatattagttggaagcagtaattgtttctgaaaatgatgaaatgatgtctctagtataatatagcaaaagggaatttccaggtggagaaaaaataaactgaatgattcaccagagtaagaaagatgcaaaaactttattttctttagactatagcaaatcctctattactcaacctagttgcacaaagttaccaactggttaccaactttcaaatcatttgagcatagtaaaatatgtttaataaaattatagtcaatacactattaaaacattttattctgaaaattttcataaattcatacaagt

SEQ ID NO: 479483 - DNA, 702 bp, Homo sapiens
tgatcaatgatgttgagcggcttttcgtgtgcctgtttgacatatggggcaccccaagcccagtaacactgtggttcttgcagactcatggaggtacaccttgatggtcttggacaagatccagaagaattctccagattaccaggcagagacttttgttctcttcccttatgctcttccaaacaaacaaaatctctttctgtttggagccacctggaagtgggagtgttgtgacacaagcatccctgtggccatcacccccaggactacactggaagtctacttagtgttctattatactgtgactgagctcacactcaaaccacaagatgcagtcccttcccactcttccctccccttttcaaaggcagaggagcctcaccccatggccaccatcaccagaagcccatatagaagggaaagggttgcttttggagccacaagctgtacattctggggttagggatagggtgatgccagcactcctttagccaccccagctggtgtctcagtaggtcatggaacccccagtccactgtctctgagcccagttcagcagtaggactcacctaaggtttgcttgtctatttagggccctggaacactttagcccatggtggtgaggcttgtgggaactcagggaagcactgactagattgtctcacagttgctgccatctcctgctccccagcatacagaaac

SEQ ID NO: 479484 - DNA, 907 bp, Homo sapiens
atctacaatagtgatgttatccacagaagtaattgggaaagttgcatatcttgtggaatatctctggaataagggctgcctgggagacaagagtgaaactccatctgaagaagaagaagaagaggaagaagaagaagaaggagaaggagaaggggaaggggaaggggaaggggaagaagaagaaagaagaagaagaagaagaggaagaagaagaagaaagaagaagaagaagaagaaagaagaagaagaaagaagaagaagaagaagaaagaagaagaagaagaaagaagaagaagaagaagaagaagaagaagaagaagaagaagaagaagaagaagaagaagaagaagaagaaagaaagaaagaaagaaagaaagaaagaaagaaagaaagaagacagattcactcatcctttatgccttttaggttgggtttgaccttggaaagaaaagttggagcagcacccttcaaacaaaaggggcaacacattcacggacaaggcaactattcaaccgaagttttacagtctccctcaactgttctgctagtttcaatcactgatggtttaaatgtaaccgtccattactcccagaaggatgttatttcatctctactcatttctgatagtttcttctccttcttgtctatgctgcagtctacatgctctatttaccaggtacacaaagtagatgacttttaccatagtataatggtatcagttcaggtcctctggtaagcagacatcaaggacaagttagcagtataagatgtgtattggggagtaatgcctgtgaaaaatgactggagagaaagcaggagtagacatagaaagtcatagaaagatcatgatgccaatcagactcgtgattgagtgtggcttttgttgcaggaaaaaaaaatcagactc

SEQ ID NO: 479485 - DNA, 809 bp, Homo sapiens
ttctcctcggaaggaaccaatcctgccaacaccttgatctcagacttctagcctctagaactctgcagcagcatggcagcatacatgcttatcagctgtggcagggcattggcagttgtggggctaccagcctcagtgcaggtgttcacagcagtggcagtgccagcgttggctgaggggcagggccactcgagtctattcacacgtttgcactggcagtggtgtcagtgcagggtcaaagcactggtatgtgcaaggctggcagcaccttatgcacatattcatgctagcagcagtgtcaatgcgggacctctggcctctgtgcatgcattcacaccagcagcaatgacagcacaagattggagtgtggggccactggcctctgtgtgtgcatttgctctggcaatggtggcatggttgagtcggggatgggaggacagtcacaatgatgggacttttaacaacagacaaaaaaaacccataggcttctctatctggattatcacaaaggggaaagatctggaaatgactgttcatcaaagctatgattgaaggagcgactgcttctcagttgtgtcatttctccttgcatttttcagagtagcaacatagtatagcggttcagaaccactgacggaaaaatacatttccctgatacattgactttgggcttgtccatgctttggcctttaagtgggacaagttattctctatgtcccttgtgtttcagcttgaccacgtaccttgctttagccaacgatataatagtagacgtgatgcaagcagagatgtgaaatgtgcttctacaa

SEQ ID NO: 479486 - DNA, 738 bp, Homo sapiens
ataccagtaccatgctgctttggtgactatggatgtttggtatagtttgaagtcaggcaatgcaggcttaatctactcagacagaaatgaaaagggtgacactactgtgaactgggaggacaattccactggggattgggaggctgcttccactggatgtggagaaagctcttctactggcaaagaagccttatcagaatataggggctcaaagtccccagctttatcagggtcttctcagacatcttcattccaacttacaggatcccattctttaccattcaatgccctcactttaacagtagatatcctgcgaggctgggagttaaatttgcattgtaattcagccaatctcaggatgaagtcctgcattttatttccagcaatttcagccctgcagctacaggagatcaggttctcccttggggcatacctaaaagctcttaaattagagagtcaattccagaaaccccagaatcaattcagaaaactcatctttaaaattatcttcctctaaaatcactgtcagtaccaaaatttgtattagccagtattcttcagagaaacagaaccaactggcggggtgggagggaggaagagagagagagagagggagagggagagagagagagggagagggagagagagagagagatattattatgggaattagcaaattagttcatgtggttaaggaggccaagaattcccatgaactgacatctgcaagctggagaa

SEQ ID NO: 479487 - DNA, 618 bp, Homo sapiens
ttttcaagttttttacctggtgtttacttttgtcacctttgtcaaagatcaggtggttgtagatatgtggctttactttcgggttctctattctgttccattggtctatgtgtttatttttgtaccaaattcacatgctggctgtgacagagaggaatgggatggttcctgggtcaccagcagaactctcaggcaggggcaagaagaatgctcaggcagcagcagaatgctcaggtggtgggaaccccagaaaagatcacaggcctatggggctaggctctcagaagggctccagaccactgctgaaatggtcagcactcttgatgctcgatgggatggctattcccatcaaacttcgccgctcccctccccagctcagataaatgcagaagttccaccagcttctcagctgcagttgaagggaactcactcaacttagagtggtgggtgctgtccatgcccgactgtgttttcaagaaaagtgatgatttctgaggtctaattcagagctgggaccaggataaagccctcactgatcccctgaaagaagccaatataatgtaaacaaagctcatttaatacttgtgggtttcaaaatgagacatggctcaacatcaa

SEQ ID NO: 479488 - DNA, 536 bp, Homo sapiens
caccacatcattctgcaggtcgatggtctgctggcgtctgcggatgtctgtcagtatgctcttctgttggtgtgttcctctcaacatccagcctcttgtgtgcttttctgccagtgtgttcctccgccagtgtgttcctctcaacatccagtcacttgtatgttcttccaccggtgtgttcctctccatatccagccacttgtgtctctgccctctagggtctcagggtttctataggcacaggatggggtcatggcgggccagcatggtctttggaaacgcaacatttaggcatgaaaacaggagtgtctgtcctcacctgggtccatggaagtcacagaagcatcacattgttttgcattttattcataagaagcaagtcagtcaggccacaccatattcaagtagaaggagatttgactttgcctctgaatgagaggtgtatcaaagaagttgcagacatgatttaaaaccaccactcttctcttactgataaagacaggaaatcgtgtagttaacttcagctgctccgatcg

SEQ ID NO: 479489 - DNA, 756 bp, Homo sapiens
acacaaagaagccagagggattccagtaaagggcaggggcaaaatgccaccagtctttttgctaaaacgtaacaagagttatgctccagttcccaacaagttcctcatctccacctgagaacacctcagcctggatttcattgcccatatcattatcagcattttggtcaaagccattcaacaagtctctagggagttccaaactttcccacattttcctgtcttcttctgagccctccaaactgtttcaacctctgcctgttacccagttccaaagtcacttccacatttttggatatctttccagcagcaccccactctactggtaccaattcactgtattaatctgttttcatgctgctgataaagacatacctgagactgggcaatttacaaaagaaagaggtttattggacttacagttccacgtggctagggaggcctcacaatcatggcggaaggcaaggaggaggaaaatgctttccacttttcctgttcaatacaatgttgtctgtgagtctgtcatagatggcttttattatcatgagaatggaagtgatttggatattgttatgtgggatattaccttgatgcaacagtgacctctaagtagcatgcatgctctgtcagagaccataaaacagaaaggcttatgggccaaattaaaatatgcaaatcacacaatttattgaaccaattgaaaatgcaagctgtcatttagggctagatttttaaaaaacattccagtgctactca

SEQ ID NO: 479490 - DNA, 514 bp, Homo sapiens
ctccaacagacctgcagctgagggtcctgactgttagaaagtcaccaacatcaaagaccaaaggtagataaaaccacaaagatggggagaaaccagagcagaaaggctgaaaattccaaaaaccagaaagcctcttctcctccaaagcatcacaactccttgccagcaagggaacaaaactggacagagaatgagtttgacgagaaggtgggtaataacaaacttctccgagctaaaggagcatgttctaacccatcacaagaagctaaaggccttgaaaaaaggttagaggaatggctaactagaataaccagtgtagagaagaacataaatgacctgatggagctgaaaaacacagcacgtgaacttcatgaagcgtacacaagcttcaatagccaattcgatcaagcagaagaaaggatatcagtgactgaaaatcaacttaatgaaataaagcgtgaagacaagattagagaaaaaaaaagtgaaaataaataaagcctccaagaaatat

SEQ ID NO: 479491 - DNA, 733 bp, Homo sapiens
gattaataacaaccaattgttcaaggatggcttacctagatgtttatgaggacaaggggcttagagaagcaggtctcaaatttgaggccacaggaggaaactccgggatcctacataaagaccgcaaatgtgacagctgcaggggcacatggctgcagatgactgcagactctggcagcatcaatgggattgtggctcctagagtcccactcagcagtagcagcagcagcctccgaggaggatgggatgacaagctgagaaggagacccccatgggccctggatgaataccagacaaatgacagccctcattatgagaagcaaaagtttaaaacactggaagatatacagaaaatcagcagccctcctagtgccctgtggcttttatttttctttgctgctaaagaggctgcccacgtgttctttcctctacacattgccgtggatatatcccacacgttgtctatgaccctttacacagaggctacagcaaaagtggtctataagcgctgccaaaagctgttctagtacagcatcaggacagaatcatataacctctaattcttccccttattattctttgtattttcaataaacttgcaaaagacgcaagcacaaagtgaagtttgttccagttttactctccacagaaataaacttacctaaagccatgaaatcaaagcacaatccagacttcaatcctattttcaaatctgaaatattacaatgtgggg

SEQ ID NO: 479492 - DNA, 583 bp, Homo sapiens
ctccaacagacctgcagctgaggaacctgactcttagaaggaaaactaacaaacagaaaggaatagcaccatcatcaacatgaaggacgtctacaccaataccccatctgtaggtcaccaacatcaaagaccaaaggtagataaaaccacaaggatggggagaaatcagaggagaaaaactgaaaactctaaaacccagagcacctcttctcctccaaaggatcgcagctccttgccagcaacagaacaaagctggacggagaacaactttgacgagccgacagacatagacttcagaaggtcggtaattacaaacttctccgagctaaaggaacatgttcaaaccgatcacaaggaagctaaaaaccatgaaaaatggttagacgaatggctaactagaataaacagtgtagagaagaccttaaatgacctgatggagctgaaaaccatggcacaggaacttcgtgatgcatgcacaagcttcaatagctgattcgatcaagtggaagaaagggtatcagtgattgaagatcaaatgaatgaaataaagcgagaagacaaggtttgataggtgtacctgaaa

SEQ ID NO: 479493 - DNA, 693 bp, Homo sapiens
ctgttagatatacacggggttggacaaggggcaagtggagctgaaatcaagccaagcatgttccatttgccaagccctgtgcccatggggctgcatcttcttgtagacttccagtactatgttgaagaggagtggaatggcctgctaggggacccagccagctcccagggcctttctgctgcttcctctacccctgtatttcactcggctctccagattgactcagctccaggtaaagtcggaaacttctcccgcaaacagaccttcagcttctccagtgggggtgtgtgttctggagaagagggtctccctttcctacttccacagttggggcactcaaagtttctgggggttgtcctgggtcctgcagtcacagtccacctccttcagagggtctgtgtgtcctctcaggattgctgccctttcaggttcttgatgatattattattcactgactgcagtgactgcaggttctccatctagcctccttagggtgctcatcagtttgagctcagagattatagaggtcgcaactaacaaagcaggaaaatgtaactctaaatatatttataggatgcctaaaccctgcaaaaattgtccatttcaacactcattagaaaatgaccaataagaaacagatctcaacattgcaatgatataactttggaagactgatagaaataagttgggctt

SEQ ID NO: 479494 - DNA, 1119 bp, Homo sapiens
ctgaattttttctttccaacaagagagacaccatctgagatggggccgcaagtggggcttggaggatggctaggagagacgttcttcgccgagagtcgtcgaggtttcctgcttcaactgtgcttggacggaacccggcgctcgtcccccaccccggccggccacccatagccagccctccgtcaccttttcaccgcgccctcggactgccccaaggtccccgccgccgctccagggccgcgcagccaccgccgccgcctctccttagtcgccgccttgacgaccgcgtccacctcgcaggtgcgccagaactaccaccaggactcagaggcggccatcaaccgccagatcaacctggagctctacgcctcctacgtttacctgtccatactgtgatgactgggagcgggctgaatgagatggagtgtgcattacatttggaaaaaaatgtgaatcagtcaccactggaactgcacaaactggccactgacaaaaatgacccccatttgtgtgacttcattgagacacattacctgaatgagcaggtgaaagccatcaaagaattgggtgaccacgtgaccaacttgcacaagatgggagcgcccgaatctggcttggcggaatatctcttcgacaagcacaccccggggagacagtgacaatgaaaggtaagcctcaggctaatttccccatagccgtgggttgacttccctggtcaccaaggcagtgcatgcatgttggggtttcctttaccttttctataaattgtaccaaaacatccacttaagttctttgatttgtaccattcctgcaaataaagaaatttggtaccccccccccaaaaaaaagtaaatttcaatagaagattgttgttttccttgaataagaagctgaaattgtggagtgaagtttttatttggtttaatttttatgggggtttttattttttaatttttattttagattcagggggtgaggacatatgcacaaagaggtcaaatatctttctgagttgacagagcttggctggggatggtagtctcaccttcccctttgtctttggctctcttcagagatatgtctcctttcaggcactcaagatgtttcttgtgggttgaa

SEQ ID NO: 479495 - DNA, 514 bp, Homo sapiens
cctgactgttagaagaaaacctaacaaatggaaagcagtagataaatccacaaaaatgaggaaaaaacagtgcaaaaatgctgaaaattccaaaaaccagaatgcctcttcgcctccaaatgatcacaactcctctccggcaagggcagaaaactggatagagaatgggtttgacaaagtaggcttcagaagtttagagaagaacataaatgaactgatggagctgaaaaacacagcacgagaacttcgtgaagcatacacaagtatcaatagccaaatcaatcaagaagaagaaaggatattagggattgaagatcaacttaatgaaataaggcgtgaagacaagattagagaaaaaagattgaaaaggaatgaaaaaagcctccaagaaatatgggactatgtgaaaagacaaaacctacgtttgattgaggtccctgaaagtgacggggagaatggaacaaagttggaaaacacacttcaggatgttatccaggagaacttcccctaacct

SEQ ID NO: 479496 - DNA, 540 bp, Homo sapiens
agcctaacgtcctatttctgatgcctttcaattttcaaaagcattcagcatgccaaagtgccatattttggaaaatcatgttctgcagcccaacattctctttcctgaaacttccctggacaaatcaagaacctcattttttacagtgaatcctgggaccttaaaaaaaaaaaggaaatgccacaggaccaagctgtgcaacacttccacagggtacctcacggcacctcacggcaaaggagggaggttcagggacacaagaggactcaccaatgaggtcctgggctgttggggagacgatggaacacaaagggatcctacaggtaccatgcttgaatccatggcagtgccagaacgcaggggaaaatatttgaaagaacttgggtgttgtgatctaagcagtatctactttagggggcaccccaaacccagtaatgctgtggttgtttcagacttgtagagataccaccttaatggtcttagacaagatccaagagaattctctgaattacccagcagagcctcctgttctcttccctt

SEQ ID NO: 479497 - DNA, 637 bp, Homo sapiens
aggtagataaatccatgaaaatgaggaaaaagcagtgcaaaaaggctgaaaattccaaaaaccagaatgcctcttctcctccaaacgaagaacttcgtgatgcatacacaagtatcaataaccaactcaatcgagtggaagaaaggatatcagagattgaagatcaacataatgaaataaagcatgaagacaagatgagagaaaaaagaatgaaaaggaaagaacaaagcctccaagaaatatggcactttgtgaaaagaccaaatctacacttgattggtgtacgtgaaagtgacagggagaatggaagcagattcaccaaggttgaaatgaaggacaaaatgttaagggcagccagagagaagggtcgggtttctgacaaagagaagcccatgagactaacagcagatccctctgcagaaaccctacaagccataagagagtgggagggtaatattcaaaattcttaaagaaaagaattttcacctagaatttcatatccagccaaattaagcgtcataagcaaaggagaaatagaatcctttacagacaagcaaatgctgagagattttgtcaccaccaggcctgctgtacaagaggtcctgaaggaagcactaaatatggaaaggaaaaaccc

SEQ ID NO: 479498 - DNA, 1016 bp, Homo sapiens
gggcaccgaggcttttccatcttctgcaatataggtccctcccacaacatgcggggattatgggagctacaattcaaaataagatttggggtacagcccccctcgtggctgctttcatgggctggcattgtctgcggctcatggtgcaagctcttggtgggtctatcattctaggtctggaggacggcggccctcttctcacaactccactagtcagtgctccagtggggacactgtgccttacgtggaaaattgatacaaagaaaagactgaaaaatccattctggcaagcacagaatgggtgtgctggcagcctcatcagttgtccagcaccagtgatgtctagatccagcagtggtggcagtaatgtcttccagtacttctgtggtgtagctctgatgcctctctgcatggttcttcagccctcctggaatctcccctggcaaatccctggtggaagtccaaaaattcgaaagctgaagaagttggtgtctgatgttcgagggcaggaagcatccagcatgggaggaaagatgaaggctggaagactcagcaagtctcctcattccactttgttctgcctgctttattctagccatgctggcagctgattagatggttcccacccagattgagggtgggtttgataatttgatgctacaaaacaaactgcctatccaggccttttgcccatttttaaatttgattatttgatttttgtgctattgagttgtttgaattatttacatattctgtatatcaagtctttgccagagacatagtttgcaaatactttctcccattccataaggtgtctcttcactttatggattgtttcttttgctgtgcagaagtttttaaatttgatataatcctgtttgtctattttttgctttgatccctgtgcttctgaggtctttttctaaaaattcttgcctagtcctatttcataaagtgtttcccttattttttcttctagtagtttcaggtcttacatttaagtctttagtccattt

SEQ ID NO: 479499 - DNA, 1141 bp, Homo sapiens
cagccaaaccatatcagactactggccacaacactctgaagaatggtgccaaagtgcttcattgggcagtggcagcaggatccgtgcccattcacatgtggcagcagaagcagcagcacagcagggtgcacactcgtcagctggagcaaggcgctggcaagcttggggctattggcctccatttgggcattggaaacagtagactcagtgccgggctggaagggtgttggggcacaagtccacttgtattcatgtgtcctgctggatgaatacatcctttggattcacgctggcagcagtggtggcgtcgtgaagggtatggggctgctggtgtccccaagcatgtttctgccctcaatgggaatgggcatctctggccatgctcccctgcagacattcctgtaccaaaccctctgggctccacaccggctggaatcctgtccctaccacctctctaagcagctctccctgacagttaaagtgtccgtgggagttgtggggtatcctgctgccagaatgattgaagtacatggcaagagtgagttgttcctcgcctgctcaactcaccccttcaccggaagacttaatggacagttgagtcattcagtagaagaagtcccgattctttattgactgcatgaagcataccataatatgttattgagttgctcttattttaaaattgctcattacaacagccaaactgtactgactacttcagggatggaccaatataccaatcaaactgtgcttcattatgtaattgcaatagaaaaaaacaaagattaaggggccttgaagggcctaactagtgaatctttcaaatcgtgtaaaaagtttgagctgcatttatatttaaactaactttggcggggggcatgggcaatcaagtatatgtcatagcggctttacaagtagactttgcatgtagaaaacagaaaaggaaaaagtccatatagttttcaaataagttatagaactttaagagttaactatgtacaaatacatgtataatgcaaaaggcatgctcacacacgagtgcaaatattagaataaacattttcatctatttgaaaacatatcctttctacaaatgatcacgtgacaggaaaagttgagtgataatatctggggaataatc

SEQ ID NO: 479500 - DNA, 628 bp, Homo sapiens
tctcacgagatctgatggtttcgaaaacaggcgtttctctctgcacaagctctctctttgcctgccgctatccacagtggtttgtgatgttcatatgctcgcaattgcaccagcagaaaagccaggaagtgggagccggctctcagcacaaggagcatctgcgatgtgctggggctccacgtcagcccccagttgcctcggaaactctgaagccagaaggctgttatggttaagtcgtgcaaacagccaagatggcagcccacccctccctctgggagctctgtcccagggaatcctgaaacctttgtcaacgggtgaacactggcatgtccagagatgctgtctgggagccagtgattggagtagaaaaaccacagcagtttacctgatgttctattctactgtggctaagctgacactcacgctacaatacaaggtccttcctgctcttccctccacatttcacaggcagaagaacctctctctttggcaactaccaccaccagtccacaggttttctgccgggccacttctgatgttcacttaaagtccaagagttcttctgtcagctcatggtgaatgctgccaggcctaggacttacccttgaaggcagtgcgctcccctctg

SEQ ID NO: 479501 - DNA, 473 bp, Homo sapiens
cctgaagacagaagacaagtgttacagaatgttacatcttcctttagacacccacagagaaaacagccaaactgagtcaccttcagttgtctgctgtctgcccacttgttctccatttgtgctgcccaatcctcaacttcaggcttctccacattccttggtgcttgcatcacacaagctagagatcaggtggaactgtggaagtagggaatgggaaggtgaaagatttcaaaggcaaggctggatggtgtcgctcattcaaccaatactgaatgccctgttctctctagaaaagggacctcttggaaagacttacattttgagagagcaaacagcaaaaaggaagaaagaggtgccttttgacaagtgcattggaaaaggaaaaatacttaaaaaggagaaatttaggatcatgctagccaaatacaagcaaaagaataaatgaaagaagcacaacaaatctccaaaaattc

SEQ ID NO: 479502 - DNA, 773 bp, Homo sapiens
ccctggatgatatcctggaagagcaaaaggacactaagttaaaacctaaaacttaaatcttagatggcacttctgggcattccctgggccagaagggagactactaccctgaagggtgagtcccaggccaggcagcattcaccacaagctgacataagagacctcgggccttataggaacatcagtggtaatctggcagtactccttgtggctggggttggcagtgactatggggactcatatccagggcacactgatacgaagaaggaagggctccccacggccttgggcagctcagcccctgtggctctgcaaggagatattccagaagaaggcattgttatcacaggggaagacagctccatgtatgttaataccccaaaagaacttccagtggaagaagatgtaaaggtggaagagattcgtattgatggccctgaccccgtatgcacagatacttaccactgtgtcatcgttgcctacaatattcagtacagtaacaggctacaggttattaccttcccttaaagtttaaatttcaaaatttaattgagaaaatataaaaagaaaaagaaagcaggtgcctaaagacaaggtcattataactgacacgatgtaatacattttgtgcttaaggtggtccatctagtctgtggcagctatatctatttgctctactattttacactaattattaacattttctatgtttactgagaatgtggaaaagttttaaaaacatgacagtagatcataggcacttaatcaatatc

SEQ ID NO: 479503 - DNA, 1023 bp, Homo sapiens
ctctctcccgtagtccgcaatcatgattaaagcagctgctacatttaattacctttctaagagacaatttgctgaggaaattggtatggatataagtaagccaggtggtattcttcaagaaattgggagaataacactgaaggtatttcagagatttttcaggctccaatgcacatcacaggccttgagaaaagaaggtttccagagagagccccagtgtgcccatgagactttggaccttgctgctcaaggtacttctagtctctactccctgaattcctgtgcagtacttctcacccacttcagctgtgacacagatggacccagggctcatcaaggtcaagacatctggcagacccgcaattttaaccaggccttgaatgtctgccagagatatggccagcgtttagtgcttgtggcctttccagcctcacagtgcaagctgttactggatctaccattctggagtctggaggatggtggccctcttctcagagctccactagacagtgtgacagtgggaacactgtgtgggggctccaaccccacatttcccttttacattgccctagcaaagtttgttcataagggctctgcccctgcagccgacttctacctggatttccaggcgtttcctttcatcttccaaaaccttggtggaggttcccaaacttcaattcttgacttctgtgcacctgtaggcccaacaccatgtggaagccaccaagacttggggctttcacctctgaggcaatggcctgaactgtaccttgatgctttttcgccacagctagagctggagtggctgagatgcagggcagcaagtcccaaggctacacacagcagcaaggccctgggcccatgaaaccatcttttcctcctaggcttccaggtctgtgatgggaggggctgctgccaaggtctctgacatgctctggagaaattttccccattgtcttggtgattaacatttggctccttgttacttatgcaaatttctgcatccaggttgaatttatccct

SEQ ID NO: 479504 - DNA, 744 bp, Homo sapiens
cattacctcagctcactgcaaccttcacctcctaggttcaaatggttctcgtgcctccttcacccaagttgctgggattacaggatctcctgagggctgtgtcgcaggccatggtcacctatattttggctcggaataaatctcttcaaatattttacagtttgactctcttcatcaacagccacttgctcaagctgagctttcgcttgccgtcgaccactgctgtttgccgctgttgcagacccgctgctgactcccatcccgccgctgactcccatccctccagatccggcagggtgtccgctgtgctcctgatccaagctataacactcaccgcatggcccaagattccattccttggaatccgtgaggccaagaaccccaggtcagagaacatgaggcttgccaccatcttggaagcagcccgccatcatcttggaagtggctcgccaccatcttgggagctctgtgagcaaggaaccccccggtaacaatgttatgctagagtcagattggaaaataggaatttaggcaagataaaaaacatcagagcttagttctcaggttgatgtttagaaataagtactttgtgacaaccacaagaagacaatcaatgtttacttagtacagtttccgaaagcttcacatagaaaataaagaagaaatttaaggtagaaatgaaaagaatgtctattgacaatatgaattattctctttatcaaaaataatttgtacaagagtgca

SEQ ID NO: 479505 - DNA, 885 bp, Homo sapiens
agacctctggagagagaaactgggacatgcaagagggtgaggtcaacatgtggtactctgcaactttcacaaaggaagatgaaaagcaaaacaaaagtttagttctgaaatttcaatcatgggtctctacataccctggagtgggtgctccccctgagaccaaccggaaggtggttgaaacagtgttgaaaagtagccatgagcttgatgttaattggagctgttccagaggggtaccaggagagaggactgaaaatgagcagcaaacagcaactgttaaaaacagcaagagaatacaggtacaatataaacatggaagcagggctacaaataacagttgccttttcaatgtaaataatggagggcagaggcctccaatacgggaagctatatttgaagtatggggggaaatgaacctagaatctatctccagtaaaaacatgcttaataactgaaggtaaagggaagatattttcagaatttcaaattctcagataatttgtcttcagcagaccagcaccttaataaatgctaaattataattcccaagttaaagaaaataattttacatggaattctagttctgggataagaagcagcagcaatataaaccgtatatatgtcagtaaatataaaataccttttaaaaatatgacatatattttaattgttaattatttaaacaagaacaaaaacaatgtcctgtgaatttcatagcactgtagaaaaatataaagcagcaaaatcacaaaggagaggaggagagataaatggaattgtactattttaagtttgctgtattgttcttaaagtaatttttaaaaataaattatcataatattaaaatatgcattgaaacttatggaatgaccaataaaagaacac

SEQ ID NO: 479506 - DNA, 755 bp, Homo sapiens
caaaggcataagaatgatatgatggactttggggacttgggtggaaagagtgggaagggccaagggataaaagactacaaatatggtgcatctgtggacaatgctccaagcacctacactgttgacaatactttgagcacctacactgtgaacaatactttgaatgcttacactgtggacaatactccaggtacctacactgcgagcaatgtaaacatttacactgacaatactcccagtacttacactgctcacagccctccaagcactaacattgctgacaaagctcccagcagttcttccattgaccatgtccctagcatttccatctcagacactactctgagccctgctacctctgatggcattctgaacccttctagcactaatcatactcccaagactgccacctctgacagaactcccagatcatctgatagtactcgcagaccatcaagttttgacagtacgccaagctcttccgcttctcacagtgctcccaacacttccatctctgaaaatgctcccaacacttctgacattggtaatgctctcagtactccaacactgccagtactgagattgagactagacatagaaagaaacagagtgctataggaggtgaagaaatcaagcagaaaccaagtggaaaacaaaacaagtgaccatcaccaaataatgcagataaagattcagagagtccatgtgcagatttgttacatgggtatattgtgtgatgctgaggtttgggtttc

SEQ ID NO: 479507 - DNA, 550 bp, Homo sapiens
atctacttttggtctttgatgatgcacccctgtggccaacactactttgactgctttgggtcagacctgaggtcagcacagcactgcgtcttccccaaggcctgctgtgaccactccgtcgctactgcttatgtccgtcgctactgcttatgttccctccaggccctgggcctctacaatcagcaggtggcaaagcaaggcatgtccagaaatgtcatcgaagagttaagtcctggaatcagagccccaagtgcctgcttggtgctctactacccccctgtggctgttctggtacctaagcccccttacttttctttctgcttttctcaagcagaaggaatttttcctggtaaccaccacagctggatggtactgagtccagtgcctcacaattgctgtgctctgcctcccccacctcccagagatgctctccacaccatgcttttgctaccagggtaggggaggggtggcgttatagatccaggactgtttttcctatctcttcaatagttgttaattttgtgtttttgcagactgggggggatggccc

SEQ ID NO: 479508 - DNA, 705 bp, Homo sapiens
ttccatctgtgagagcgcacccttctatagaactaaaggattgtaaatgcaccaatcggcgctctgtaagatggaccaatcagtgctctgtaaaatggaccaatcagcagggtctgtggcttcactgctgaagtcagcgagaccacaaacccaccaggaggagcaaacaactccagacacaccaactttaagagctgtaacactcactgcgaaggtctgcggcttcactcctgaagtcagcaagaccacgaacccactagaaggaagaaactctggacacatccaaacattaagaactgtaacattcactgtgagggtccgtggcttcattcttgaagtcatcaagaccaagaacccaccagaaggaaccaattctggacagaatagcacaatgcgttacgcacgtatttgtggtgatgctgaagtaaacaaacctactgtgctgccagtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaaaaaaaaagaaaatgcttaggggaaa

SEQ ID NO: 479509 - DNA, 549 bp, Homo sapiens
ctcctcctagaggtttgagccgcaaggcactgaagaagcgagccacacccccatcacatgccctgtatacacatgccatggtggtttgtggcacccatcaacccatcgtctacattaggtatttctcctaatgctatccttcccctagccccccatcccccaacaggccccggtccagctgacaaaatgcagcacctgggaagagatgctttgaacaaccaatgggtcaatgaagaaattaaaagggaaattaaaacttttcttgagataaatgaaaatgaaaacacaacataccaaaacttatgggatacagcaaaagcagttctaagaaagaagtttataacaataaacacctatattaagaaagaagaaagatctcaaataaataacctaaccttgaacctcaaggaactggaaagacaagaagaaactaagcccaaaattagtagaaggaaggaaataataaagatcagagcaggaataaatgaaatagaaactagaaaaacaatagaaaagataaatggaacaaagagttgctgtttttaaaag

SEQ ID NO: 479510 - DNA, 681 bp, Homo sapiens
gaaactaccttcacctccatcatgaagtgtgatgtggacatctgcaaagacctgtacgccaatacagtgctgtctggcggcactaccatgtaccctggcattgccgacaggatgcagaaggagatcactgtcctgacttccagcacagtaaagatcaagatcattgctcctcctgtgcataaatactctgtgtggcagcaggaaggagatgtgctgagcaaaagtgaaaaagccccttataaaatcatcagatctcgtgagaactcactatcacgagaacagcatgggggtaatcgcccccatgattcaattacctcccaccaggtccctcccacaacacatggggattatgggaactacaagatgagatttgggtggggacacagccaaaccatatcacttaaatacgcatttttcaaaagaaaacatacaaatgaccaacaggtatatgaaaaaatgctcaacatcactaatcatcaggaaaatgaaaatcaaatccacaatgagataagctcacacccgttagagtggctattttcaaaaggacaacttttagaaaggatgtggagaaaaagaaacccttgcatgctcttggtgggaatataaattccaggcatgtcacctttgctacttcctctccgaatcattttcaaagtagtttataaattataaatatgcatc

SEQ ID NO: 479511 - DNA, 772 bp, Homo sapiens
ctactgctcactgtttggagctataacactcaccgcaaatgtctgcagcttcactcctgacgtcagcgagaccacaaacccaccagaaggaagaaactccggacacatccgaacatcagaaggagcaaactccggacacaccatctttaagaactgtaacactctccaagagggtccatggcttcattcttgaagtcagcgagaccaaggacctaccaattctggacacaaaaggaatcagcagaataagatttagagataacacagatgttggaactgtctggcatgaaattcaaatagccattagtaatatgctaaaggccccaatggaaaaggtggatgacatgcataatcaaagagatcaaaactataagaaagaactaaatgaaaagcacagcaacagagatgaagaatgtgtctggctcattagcagactcgacatagccaagggaagaagcagtgaacttgaagataagtcaatagaaatgatcacaattgaagcacaaagtgaaaaaaagaaaaggaaggcataacagagcattccagagctgtggaataacatcatatagtaaaatcactggggtctgtctgcatttacccttcctgaagcgtggcctggaaaacctctcaaggctgtaagatggagaaattatagagctcatctcctttgttttctttctctaatggatcactgtccttcattttctgatgtacagtgtcttgcaaactgctatttcatgtaacttgtctgtgttttagttgtttcagcatg

SEQ ID NO: 479512 - DNA, 526 bp, Homo sapiens
gggcacagcttcaaccatgatgatcatgccaggggctacagctgctccagaaggtcttattgccccagctgctgggagtgctgccagcaaacagcctccagctgccagtgcatacaggggctgcctcagcttcagagaatcaccaccccagaggctacgtccctgctcaaggtggaagaagaagaaagaagaagaagaagaaaaaagaagaagaagaaagaagaagaaaaaggaggagaaggagaagaaagagaagaaggagaagaaggagaagaagggggatgagaaggggaggggtgcctttgatgtcatcagcattggagcatgggctagcaggccggtccagggaatgtctcttcctaacaaaggagtggggctttcaggcataattaaaaagacatgtgaaaagagtaaagttccccagtcacaacttagtggctgggagaagttatctagtgactgcctgtcctaggaccccttggatagtgacagatctggaggacagttgtccaggacagaggagtat

SEQ ID NO: 479513 - DNA, 746 bp, Homo sapiens
ttctgcttttccttgctctctgccggtcatgccaacttcccaactttgttctctggaccctcaaggtttggagtccattgtgatgcagggggccaaggtgtggcagctgcagcagagtgccagcagattcaggggtgcttgcccccttgccaacgttcatcacagtggtgaaggcaaggcaactgggagggggaatgggggggccactgctggagactgtgtgcacagttgcactggaggtggtgttggcttggggaggggtgctgcccagtgcaggtctgggtgccttctctgtgccccgcaagcaggagtgatcactcaggaacattgctacacaaacagtggtacaggggccagccaaccttccaaggaaccaccaggcagaccaaggacgatctttgcaaaagaggtctattctgcttcttcagtgctggaactggcaatgcaggcttctattgtcaaggctactgctgagctgaggaaaaaaggatagaactagtgaggccatagcatatttaaacagtgtttcttgagcaaagaaaaaaaaatacattgtgatatattcaatacctttcatgtactaacagatcataagatgcaagttaaataaactaaccattaagaggacacagaaaagtcaatcaaataatttgctcattagatgatctttgagagaaattgtctaccatatttataagttgttaaataaatttatttatttatttatttatttatttatttatttt

SEQ ID NO: 479514 - DNA, 758 bp, Homo sapiens
ggaggcactcaaggacctcatcaacgaggcctgctgggacatcagctcgagcggcgtgaacctgcagagcatggattcgtccacgtctccttgctgcagttcaccctgccgtctgagggctttgacacttaccgctgtgactgcaacctggccatgggcgtgaacctcactattatgtccaaaatactaaaatgtgctggcaatgaagatatcgttacactaaggattgaagataatgtgaataccttggtgctagtatttgaagcttcaaatcaggagaaggtttcagactatgaaattaagttgatggatttggatgttgaacaacttggaattgcagaacaagagtaccactatgtagtaaagatgctttctggtgaatttgcaatggagaccttggaaatagaaaacaaattgtcacagacaagtactgtcgataaagaggaggaagctgttaccatggagatgaatgaaccagttcaactaacttttgcactgaggtacctgaacttccttacaaaagccactccactctcttcaatggtgacactcaatatgtctgcagacatacaccttgttgtagactataaaattgctgatgtgggacacttaaagtactacttggctcccaagatggaggatgaagaaggaccttaggcattcataaaattcaagaaaataaaactaagctctttgagaactgcttctgagatgccagcatatactgaagtcttttctgccaccaaatttgtacctct

SEQ ID NO: 479515 - DNA, 686 bp, Homo sapiens
aaagtcacctagaggagtacagagaaacttgggggaggggtgttcctggccatgctccactgcagatgttcttgcaccaaacgctctgggctccactcaggctggagtcctgcacctgccacctctctaagcagctcttcctgtgagctcaagagtccatgtgttttgtggggttttctgctgctagaattccagaagtcgtccatggcaaaagcaagccatttcccacctgttcaactcatcccttccccaggggtcactgggacccaggaaggaattctggtacttagcagcaatgtgcagccttcccagcttcctcccccttcaggccaacatctgcgaacttctgtccactctcaatgccttccctctgaatatctgctcagcgtgtgtgtcagtgttcctgatgtcgtggtgtctcgctgggagatgttcctcctggctgtgtctagttgaccatcttggctcctccttcctatattttatcacaataaaaaaactcatcatgagaacatttaaaagaataataatatggcttatcgtgtttggcttctaaaataaagattttcactgacaaagacattctagcccacagctgggttaccaaaacaaacaaataagaagcacaaataggtaacttattcactgctttaaaaaaaatgattttccattataagatgaaatgt

SEQ ID NO: 479516 - DNA, 693 bp, Homo sapiens
aatcccttctttctcccttctgtcaaagtatcgtatgcgttatggtgatctgtgatcagcagtctttgatgttacaaccatgcccatataaaacagtgaacttaaatttggtccagataggagatcaaaccagccacaccattcctttaagccaaagccaaatcaagagcaaagccctaactctctttcattctatgagggctaagagaggtgagaaaggttcagaagctagcagaggttggttcatttggtttaaagaaagaagttgcctctctaacataaaagtacaaggtgctgatgcagaagctgtggcaagttatccagaagatctagctaagataattaatgaaggtgactacactaaacatcaaattttcaatgtgggcaaaacagccttctgttggaagaagatgccatgttggaagaagatgccttctaggacctttatagctgaagaggagaagccaatgcttgccttcaaaacttcaaaagacaggcatctcttgttaggtaggggccaatgcagctggtgactttcagaattggcaatacattaattcaaaatgttttcactaagcaccaaatagaatcgtccccaatctctgcaccgagaacccctttgaaagaatgcctaaaacttaatcagtttatttaggtttttaatcaagaaatccattagcaacaatcttcctt

SEQ ID NO: 479517 - DNA, 1389 bp, Homo sapiens
cccggaaggcagagcttgcagatggtaaaagaagaaaggagattcctcttgcaaaagaagccaagtataaacatggaagaacaactgcctaagcaagtagaaaagtgttccataatagtgcgcaatgaatgaagagttctggattaatctctggaactcaacctgcaccctgatctttattttgaatgggatctagaacgggatcttgaagtagctctttttggcggaggggacacagaatgaccctttgagggtggagcaggtaggggtgaattggaacgagactggctccttgatctgtattttgacttcatatcaccttttccattttctttggaagatcgggacagagacctgcttggagatttctcatactcatccttagatctgctttgagaacaagaacaggagcccagatcagatttgggcatagatttgctccttgagctagatttcctgccttttgaacgagaacgtgatcgacctttgctccgcaacctgatcaggagtgactttttgagatacttcgagatctactgtggctgctcctgcgactcctacttcgtgaccatcttctagatctatacctggatctgcttccagaatcagatcgcctatggcttgtgcctggcttaccttcaataagcctaatatttctgcaccatccagtttgtccaaagcaagcttcatgtcaaaataggagtgaaactcaacgccctcacttgtgcattccttgtgagcatcaacataggttacttcatctgcttgttgcataaaatcctttaaatcttgccaactgtaacaactagaaagactttctataataagctcgtattctgtatgaacaggtggtccatatttgtctctgccagatgttctctgactgctgtatccacttccaccaccatctccctgcatctaatggcaaaaggccgctgtcatcatggcttccgagcctgcattcaatactttcataaaagaaatcgtggtgacagtgtatatcaggaaatgagtcatgcgttatttgaaattctaaagacatttacctccagaatcagagcaacaataataataacaataaaacattcacgcacacacaaaacttctctgacagatgacatgcaagttgatgtaatagcacagtctctggcttgcaaggtagacataaatacctacagcgcgttcccatcagtctcaaactgggccatctgcaagataggatgggaagtgcgtgggctctgcagtcagaaagaccttgatgcatatcctgacattaccattttctaactgtatgactttggatgagtttcttaaatatgaaatggcaagagtaatagctagcccacaggattgttaaaagggttaaatgagatcatgtacataaagcac

SEQ ID NO: 479518 - DNA, 747 bp, Homo sapiens
aggcacaataacaacccccaaagatgtccacaaagatgtccgcaaagtataacaatccatactttcacggcatgacatggcaaagggactttccacagctctgccaggaagcccctcttccaagactacaggtctcatcttctctggtaatcctactgcctccccttgcccttgctggcccacggaagcaacagcaggaagccacaaaaacagagggagaaggggaggagcccatgacacaggcactgaggagcaggagtcaacccgtgaaagctggcaccaggacgggtctgtccttcaagggaaaagacatagcccctgtgggagaagccatccaaggcagggaggggtggtctagctttcccctccgaaccattccttccattggctgcacccaggcagctgacacaggagcttactcagaaaactggcctgcaggggtcaaccctcctgccctacaaagtggaactggaaaacgacacaaaaataaattgagagcaagatcaggggtacatgtgcaggtttgttatgcagaatcacaagtgggctgcctgagaaggagcttgcagggtgatgaatgcaaacttttgaaaaacagtatatagggcatcagaaatgttaaagagtcatgagatcattgtccctatcaagtcatttcctttcctttgtcttttatgtgctcacaaaactttttataagcccacaagactctgtgtgtatgtgtatgtatgtgcatgcttacacaac

SEQ ID NO: 479519 - DNA, 1330 bp, Homo sapiens
tgcccacatcagctcctcaagcttctcccgagtgggcagcagcagcttccgggatggcatgggtgaaggctatggtggggtcagtggcatgggaggcatcaccaccatcatggtcaagcagagcctgctgagtccccttcacctggaggtggaccccaacatccaggctgtgcacacccaggagaagaagcagatcaagaccctcaacaagtttgcttccttcatcgacaaggtacagttcctggagcagcagaccaagatgctggagaccaagtggagcctcctgcagcagcagaagatggctcagagcaacatggacaacatgttcgagagctacatcaacaaccttaggcggcagctggagactctgggccaggagaagctgaagcctgaggcggagcttggcaacatgcaggcatgcaggggctggcagctgtatgaagaggggatccgggagctgcagtctcagatctcgaacacatctgtggtgctgtccatggacaacagccgctccctggacatggacagcatcaccactgaaatcaaggagcagtacaaggagattgccaaccgcagctgggctgaggctgagagaatgtaccagatcaagtatgaggaactgcaaactctggctgggaagcccggggatgacctggggcatacaaagactgagttctctgagatgaacatcagccggaacatcagctggctccaggctgagattgagggcgggcttccctggaggccgccatcgcagatgccaagcagcgatgccaaggccaagttgtccgagctggaggccgttctgcagcgggccaagcaggacatggcgcggcctctgcgtgaataccaggagctgatgaatgtcaagctggccctggacgtagagatcgccacctacaggaagctgctggagggcgaggagagccggctggaatctgggatgcagaacatgagcacccataggaagaccaccaggggctatgcaggtggtctgagctccgcctatgagggcctcacaaaccccagcctcagctacggcctgggttctagctttggctctggtgtgggctccagctccttcagccgcaccagcttcaccagggccatggttgtgaagaagatcgagacccgtgatgggaagctggtgttccagtcctctgacatcctgcccaagggaacagctgcggcagcccctcccagcctgcccctcctgcggctgccccagagcctgggagggaggctgctgtgcaggggagcacagggaacgggagggaggctcacctgaggctcagtgctagccgtcagcccattcgagggggagtttacc

SEQ ID NO: 479520 - DNA, 667 bp, Homo sapiens
cctttgaccaaaatgctgatagtgatatggacaatgaagttcatgctgagatgatttcagatggagatgaagaacttgttgggaactggagtaaaggtcacttttgctatgcaaagagactggcagcattttgcccctgctgtagagatctgtggaactttgaacttgagagagattatttagggtatctggcagaaaaaatttctaagtggcaaagtgttcaagaggaagcagaacgtaaaagtttggaaaatttgcagcctgatgatgcagtagaaaagaaaaacccattttctggggagaaattcaggcttactgcggaaatttgcataagtaatgaggagccaaatgttaatcaccaagacaatggagaaaatgtcagagaccttcatggcagcccctcccatcacagacctgaggcctaggagggaaaaatggtttcgtgggttgggcccagagtccccctgctctacgcagcctcaggacatggtgccctgcgtcccagctgcttcagctccagccatggctaaaaggggagaagggttggtccctggtagcttatttagtttatttggtgaggtcatgttttcctggatggtgttgatgctagtcaacaatcttcagtgcctgtgtattggtgagttaggtatttattgtagtcttcact

SEQ ID NO: 479521 - DNA, 844 bp, Homo sapiens
ggagccgtggcacaggtggtttaggcatagccgccagccatctgactggtggcgcattgctgcctactcctcgccaggcatggtagctgaagaagtcgctcactccgtaggcgatcatcaccaaacacgcaaagaacgaggtagccgcacgctggttatacggctgcgtgcccttcagggacgtcaggtcaactgccgcagagcgggcgatgaaggcgagggtgaagaagacgattgtcaccagccagaggaagacagatacgaacatcacccagccataggccgggtacaggtggtacggggtgtctgcaatcagggcccacaccagcagccccagcaccagctgcagcagcatgaacgcccgaggcgggagcgcacgaagcccaggtccgtgcgcagcgcctacaccaaggctccagcgtcctgcgcgggactgctggtcgctcgggccgccgtcgccgcccctccagtggtgggtgccagctcccgcgccgctcttccccgaggctccctatcccgctgcggcccagagcactccaggaggcctggatgtggcccttggtcctatggatttcttgcctcatgtgaagggcacactggaggagatatagtgcagggccttctaaactttagagtctgacttgtttgccacgatcaggaatgtgtgatgtaacatggcatgaaataagtgtagacttctccatagatgaggggcctagtatattttgtctgatacgagtataactacacctgttatcctttggtttttcatttacatggaatatcatttcctatccccttacttttagtctatatgtgctcttcaaggcaaggtttgtcaggt

SEQ ID NO: 479522 - DNA, 540 bp, Homo sapiens
tggcttagcacaatatgaatttatttctctctcataagaagtccaatgcagattttcctggcctgtggttttcctctgagcaaagacttggagatccaagctcatttagtcttttggggctgcagaggagcctcatgccatggctagtaccaccacaagccttcagagagtactgtcaggctactgccaatgttcccttaagacccaaaggcccttcagtcagcttgtggcatatgttgcctggcctggaactcatccttcatgacaaagggctcccctctggcccagggcagttccagaaatgctgtccaagagccaagtcctggaattgggcagaaggagtcttgccccatagacaccacagctgggaatatgctaagtctcacctgaatccaagaagtctcagagtctcacccacgacacatgacatactatctgggtattactccttgttattcagggcccaagggctctttagtcagcaggtgaagggtcctgccaggactgggtctcttccttcaaggtagtggattccctttt

SEQ ID NO: 479523 - DNA, 621 bp, Homo sapiens
tgagatcaactagggaacagatgtagaatgactgctaggacactccaaaatgtaaagaccaggaagaggaggagaatccagcaattaagaggagcagctagtgaggtggattccaacctgctgctttggctggctgggattccaagccagcgggtcttaacttgtgaggtgccatggaagtggggcccacagaataacactgcttggctccctggattcaaaccccttcctagggatatgtacagatggatttcctgccttgccagggatcctggggccagagtatgtgaaaccgctgagctgggaagtccaagatcaaggtgccagcaggactggtgtctggtgagagctgctctctgctttcaagatggtgctttgttgcagcatcctctggaggaaatgaatgttgtgtcctcacaggacagaagggacagaaggggcaacgtggaactggcataattggagacactagttattttactaaggctttgactggaataacattttcagatttccttgaaaaaaatgagtgtgacctatagagccgataaaagccccttggaaaaactggcctcatactttgtcctttacagggtcctgacctgtggactttgaaaatgt

SEQ ID NO: 479524 - DNA, 688 bp, Homo sapiens
tctctcctgcaaggtggctttagggtatttgaactccatacatcatgctcagggctccaagaggcacagctgcaggccataaaaatcactttgctgcagtctggaatgggcccctcagtgacagggtgtcacatcatttttgttgtagtcatttggctctttgttttagtgttgccctgctcaaaggccatggggagctggcacccttggctacccttcctttcactgtctttgtgggtagaaaggccaagaacttgcgggaagagagagtgtggaaaagttttcctggggcaaatcagagtgtgtcctccaattttcagaaccagagcacccttattttcttccccaaaacctacctccactcacagcagaggaggctcaccccatggccaccaccatcacaggcccacagggagtactgccaagctactgctgatgcttccttaaggcccaagggctcttcagtcaactcttggtgaatgctgtctggactgggactcactcttcagggtagatgcctgaacacctatcccacaaaattgtgagtaaaatggttgttatttaaaaccactaagttttgggatggcttgttaggcaacagtagctaactgggacaaatgctaaagagaaaaataaatgagggcaaagaaagaaagacaggtaagggtactattttagagggaatgat

SEQ ID NO: 479525 - DNA, 746 bp, Homo sapiens
aggaaaaccagagacctttgttcacttgtttatctgctgaccttccctccactattggaatgggtgctgctgattggttggggatgaaatcacaggggtgtggaaaatggtccttgttcactgggtcagcctctgggcagggtccagaggaccagactccattgagttggccgttggcaccaaggagcctccatgaaggaggccattccaggatggaatgcaaaatcctgctggtgaaagagtctgggacatgtgattccatgtgtttaacctttgaaaaccaggagagcatagaaggaggtgcaaagaatgctgaacgtcagcacagcctatgtccaacacagcaaaccattgtccctgagcctgtgtcctcaccagcagatccttcaggaagtattccagaagaaggcattgttatcataggagaagaaagctccatgtatattattgcctttgaagaccttccactgggacaagatgcggagatggaaggcagtgatattgatgatcctgatcctgaccctgtatgcgaggaagctgcagaagaaaagcttgaagctggcagagattgggtcatgagatttaagaaaataagccatctccatgacataaaagtgcaaggtgaagcagcaaatgctgatggagaagaagctacagcaagttatccagaagatctagctaagatcattgatgaaggaggctacgataacaacagatattcaatgtagacaaaacagccttctatt

SEQ ID NO: 479526 - DNA, 531 bp, Homo sapiens
caccatggctgcaggcacacagtgacaacctggaagatctgtggcatgagggcacagatcctgccatggagtcataccataaagctgtgaaagttgtcccctggttgaggtacagcatgaaggctgagtgggtgtgtatgttcagctgctctctggtgcccaatgatactactctggcaaaagtaggcactgactccttctcattgctacctggtgaggatggaggctcagtttgctgttggaccccactgacactacactgtggggcaatcagcaaactgcctgcttttgtttggcagggagtagaaggtcagctttctgctcagctttaccagtacctctgcatgggaatcagagcaccagctgcttttgcctggtgggcattggaagatcccacagcagggaagggtacagattttctactggtgtttggttggagtagggcaggttacctggtgcttctgtctcaccgttcttaagattctttacttcgttttagctctggataacctgatgacaatgtgtctaggc

SEQ ID NO: 479527 - DNA, 802 bp, Homo sapiens
tctggagccttaagatttgatgttggctgtgccagggaccacggacatgggcaaacttctgagctaccagcccaacaggggcataaaacgtccccgagatggcaaagaggaggagcagaagatgcatcagaaacaaactagtactcaagattgggaagaggaaatgattgtggtggaagaagcagaggatgacaaacatttgctgcttcagattattgacacagagggtgaggaggaagagaaagaggaggagccattggatgaaagctcaattaagtttccagacaatccagagaagttcatggaatcccaactggacctacatgacatcattcagaagatgcacttggtggccaccatgccagacctgtacctcttgctggagctgaatgctgtgcagtcacttcttggtttgcttggacacaataatacagacgtgtccatagctggggttgatttgagtcaggaattaacagatatagacatcttctatgagagtggagagggagcagaagtactcattgatgctctggtggatgggcacgtgatagcgctgctggtgcagaacgtggagcgcctggatgagtctgtgaaggagcaggtcaatggtgtccataacactcttgttattgtggaaaacatggctgagttctagctggagatgtgtacaaaaggtgcgcagcagggtcttcctcagtggctgttgaagaggctgaaggcaaagaagccttttgatgccaacaaactgtattgcagtgaaatgcaggccatattgctccaggacaatgatgaaaacaggaaa

SEQ ID NO: 479528 - DNA, 736 bp, Homo sapiens
cttaaacaggtctgtgttttaatgaatttgtggcatatgggccataataatcaaagcgcctggcatttcctggaatttatgatctttctcaggtatttatagcagtgcaagaacggactaatacaatgatcaaacccgaagatgtcatcgaggattcacaaaacagttctatcattttggtacaccatccgtttaacagacatgtatttagaacctgctgtctacaggcaccatggggatacagcaatgaagaagacacagtcctactctcaagttggaatcttgtggagaacacaccaaagcctgtcagagtcccctgtgataaactgtatgacaaagtaaacatgggcaggtctcctgaattttggggacctggggaagctcccatgggaagcacactttttagagatagtattgctgcctggaatgatacactgagttcaatatcatcctttaaaaatggcggtacacaggcttggggaaatgaggatctgaagggttttgtccctttgaagggagaatgtgagaaagaatgcgagaacatttctaagagcagagcatggcccccagctgagaaccagggaggaaatagacttcagtccaacagctgcgaggacctgaattctgccaacagttaggattaacttggaagtcaattccttccccagagtctccagacaagaacccagccaggccaacaccttgatttcaaccatgtgataccctgagccgagaa

SEQ ID NO: 479529 - DNA, 1366 bp, Homo sapiens
tttattgttgctcctccaacagatgcccagtgaatttggacccaaacctgatggacactgagaaacaggccactctgcaagcagcagagagatttgggaatgagttttgtatcacgtatagcatcagggaagggggtgactattatccatctggaagagaaggagtaccagtgagtaactctaaacgggatcccaatgacgagatggaagactggaaaaggagacactttcaggtgtgcataatggagggtttatgtaggaccaagaccaagcctctcaattatgctaagttgtccattattgaccagggatttgatgacaattctactgcttatctggaaagcttaagagaggacttggtaaagcgcacctctctgtctcctgattcagtcaagggacacctaattctaaaggaaaaatttattactcgggcagctcctgacatcaggaagaagttgcagaaattggccctaggaccagatagcacattagaggacgctcctgaaagtgaacaccgagaccctagcaggcagagacacaagcagctggaagttgagaggaacacatcagtggaagaagacacagtggctggacatcaagaggacacctgcggaagagctcaccgacaggccattgataggaggaatgacatggagtttggctggggcagacggaggagagactggaccactgagcagcccgattccaaaagaatagcaccttcccgctccatctcccttctggctcccccgtctgctgagagctacctccactcaataaaaccttgcactcattctccaagcccacttgtcctctgattctcctgatacaccaaggcaagaaaccctgggatacagaaagccctctgtccttgcgataaggcagggtgtctcattgagctgactaacacaagccccctatagatggctaaactgaaaaagcacccttgaacttgatatacgtgtatgtgaattgggtatgtgtgtcactgaattgtcgtatcttccagagacactgttgcctcttcattgttactgaatgttttttagaagcttgggatcagaatggctgcaagcacctgggtgtctctaaaggagcagtttctatgttgtgggtgggagctaatgccaaactgatttcagttacccctctaaatcttacctaagctccttatgacatgagcgcctttgctagaaataacagaaaagagagaaagattagcatagcaatgctcatgttttgcagaatgaatcatgacaaaccttattttgaacctgttaactaagatttatggaaataatgtgaatttgatcgtcaactctgaattattaacattaattattagttatttaatatgtttcacatt

SEQ ID NO: 479530 - DNA, 685 bp, Homo sapiens
ccttctttctgaagatctgataggaggatgctgtgagattatttctcaactgctttggttcccttggatcatggccctcctcctgccggcggcgacggcgacggcggcggccagacttgggctgggggcgaccgggctgcggttttacctccattttgagaccggacttgcctcttccaactcgagatcaatatggaagactattttgtgtgtgtggttgaaatctacctgatactcttttgtaatacggctaagctggcactcaatctacaagacatagttcttcccactattcttcccccttcccaaaggcagatagacctcatcctttggctaccaccaccaccaccacccaatgattgggactcacctttcagcagtttgggcttccctctgacccagggcaggtctagaaatgctgtccaagagccatgtcctggacctcaaaagcccatttggttctctaccaccctgtggctcaggtggtatctaaggtgcaagaaaaaaatcccctttactttccccattacttttcccaagcagaagacatcttttctcatagccaccacagctgacaaagttctgagtctcacttgattgtagctattgtcagagtgtcacctaaggtgcatgatgtacaatctggatgttgttgctggttatttagaacttaaggggtctttgt

SEQ ID NO: 479531 - DNA, 1265 bp, Homo sapiens
agtaggtggattttcaatcctcaccctcctcataccctccaccttcaagtaggctgtggtatttactgttccatgttttgtgttccccctatatttgtgtccggaactggtgggttcttggtctcactgacttcaagaatgaagccgcggaccctcgcggcggcacgtccggagttgttcgttcctcctggtgggttcgtggtctcgctggcttcaggagtgaagctgcagaccttcgcagggagtgttacagctcataaaggcagtgtggacccaaagagtgagcagcatcaggatttattgcaaagagcgaaagaacaaagctaccacagtgtggaaggggacccgagcgggttgccactgctggctcgggcagcctgcttttctagatacagagtgccgactggtgtatttacaatccctgagctagacataaaggttctccacgtccccaccagactcaggagcccagctggcttcacccagtggatcccgcaccgaggctgcagatggagctgcctgccagtcccacgccgtgcgcccgcactcctcagcccttgggtggtcgacgggactgggcaccgtggaacagggggcggtactcgtcggggaggctggggtagcacaggagcccatggagaagggggggaggctgaggcatggcgggctgcaggtcctgagccctgccccgcgggaaggcagctaaggcccagcgagaaattgagcacagcagctgctggcccaggtgctaagcccctcactgcctggggccggtggggctggctggctgctccgagttcagggtccgccgagcccacgcccacccggaactcgcgctggcccgcaagcaatgcgcgcggccccggttcccgcccgcacttctctctccacacctcccggcaagctgagggagccggctccggccttgatcaacccagaaaggggttcccacagtgcagtggcgggctgaagggctcctcaagtgccgccaaagtgggagcccaggcagaggaggcgccgagagcaagcgagggctgtgaggattgccagcacactgtcacctctcatactgtttctgctgtaaaatctactgttagttcaatggggttttctttataggtaactagatgtttttatcttggtgcttttaggattttcactttttatcatttatcttagaatggtttgatttcaatgttccatggagaagaccttttgtgttgtatccacctgggcattattaaattttctgtattggaaagtct

SEQ ID NO: 479532 - DNA, 869 bp, Homo sapiens
ccttatagtgtagtttgatgtcagatggtgggcagggccatagagctcccaaaagattatgacctttgtcttcagcttccagagcaggtatagaaagaccaccagaccaggggcgtccccattgagagaggaagcctactcacagtttttcggcatctgggagagcctgcagcatggatccagttccttcaaaaggtctgtggattctcttggctttcctgacaaaacagagccaaaccaaaatgcacaccatcatgtttccagtagggagaacaaagaaagctggagatcttacatttgcagctgtcttcatcatcaaaaatcgggaagattagactccaaagttgaagatacgttcttttatgctgacagcagaataacattgagcttcagtgacttacgtggcaaagatctgtggaccatccaaacaaacaagaatacagttgatgagagtgtgctctaaaattagtgttccaccacaggacaatgaaggatgctgtgtgaatatttggaagacgaccctaaagcaaggatccccatttgctgcagaataaaatcaacttccttactgtggcttgaaaagccaccatgatctggttcctttttacctctggattctcatagcctcacattttgtgctccagtaacactagatagtttgttattgtgcctaaaataccatgctgtttcctacttttcctcattttatcccttctgcttagaatattctacccgatcctatctgcctggtcacatatttgaatgcagtatcttggctgttaaaaagaaaaataatacctttttacataattaaagcaagcacaagcctctatgccctgtttccatctatttcctttttaacaaatgtc

SEQ ID NO: 479533 - DNA, 503 bp, Homo sapiens
tacaaatcaagttgagttttgggttatgttgagtagaaatgtgtttggtgattaccatccatcagccattaatatagcagctgatgaagccatgatgcttatcctcaacaaggacacaaaggacagcactgagtgcaatatgtcacagttgctggactctccctcccccaactcccagacatgctctccacaccatgctgtggctgctgagatagatgtctctcccagcgatatgatgttaaaaccagttactatgagggctcacctgatttttggttcttatgatggtgtttttacatccagcccttctggctacagtaacaacaggatggttcaaattcttctatggcatctacgacatcatgataaaagaatgcatctctgttatgcccaacactgagagtgcctgctttgttgttgctgccccctctctgttcaaccatttctctgaaatgttcatttgtttctgctgaaataggcacgggggaaaccagcaagcccac

SEQ ID NO: 479534 - DNA, 1075 bp, Homo sapiens
gattaacatttggctagttacttacgcaaatttctgcagctgaattgccatgcagccacacaaggagagattaaaagcctcaaagaagaagacattctggatatactatgaaaggtggaaaaacataccagatgatcatgattcagtggggacccagggatatgacatttatcaaagaaataagaacagcagctgtgaaggggtaaccagcaccacactgaagtttagaatccaacttacaagggaagtgaaggacctcttcaaggagaactacaaaccactgctcaatgaaataaaagaggatagaaacaaatggaagaacacggccatactgcccaaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaaagagctcaaacaaatttacaagaaaaaaacaaacaaccccatcaaaaagtgggcaaaggatatgaacagacacttctcaaaagaagacatttatgcagccaacagacacatgaaaaatgctcatcatcactggccatcagagaaatgcaaatcaaaaccacaatgagatatcatctcacaccagttagaatggcgatcatgcaaaagtcaggaaacaacaggtgctggagaggatgtggagaaataggaacacttttacactgctgatctttcagttataataaaacatattatttgtagtaatatgtcacctatattaatagtacttagactataacctggttaaaacccaccagactaaatgatctctaatagcttcttccaaggctaatattttatggatgtaaataaaacgatggcttagttgtattactgctaaatatttatatccaagccacctcttccttcacaaaattgtactaggaaaatgaaatgatattaacatataatatagtacagtgtttacctg

SEQ ID NO: 479535 - DNA, 911 bp, Homo sapiens
ctcctctttgcctctcgccatgattatgaggcttccacagccttgtggaactgttctgatggccgagctgccccacaggatcatcaaggaaacccagcgtttgctggcagagccagttcctggcatcaaagcagaaccagatgaaagcaacgcccgttattttcatgtggtcattgctggggaatcaaaggattccccctttgagggagggacttttaaacgtgaactattacttgcagaagaatacccaatggcagcccctaaagtacgtttcatgaccaaaatttatcatccaaatgtagacaagttggaaagaataagtttagatattttgaaagataagtggtccccagccctgcagatccgcacagttctgctatcgatccaggccttgttaaatgctcccaatccagatgatccattagcaaatgatgtagtggagcagtggaagaccaacgaagcccaagccattgaaacagctagagcatggactaggctatatgccatgaatagtatttaaattgatccaatcattaagtgtgcatcacttctcctgttctgccaagacttcttcctttttgcttgcatttaatggacatagtcttagaaacattacagaataaaaaaacccagacatcttcagttatttggtgattaaatgtacattagcaaatctatgtcttgtcctgattcactgtcataaagcatgagcagaggctagacgtatcatccggattgttgtgaaacgtttaaaagcagtggtccctccctgcttttattcatttcccccatcctggtttaagtataaagcactgtgaatgaaggtagttgtcaggttagctgcaagggtgtgggtgtttttctttattttatttttttgaggggggttcgttacatatgtatacatgtgc

SEQ ID NO: 479536 - DNA, 605 bp, Homo sapiens
ttcttttactattcatcacacactatgtgtggttctcttatatttgggtgtctttgtgctattggggtcctgggatggtctcctacccctcacactcagaagtgccttctcccgctgcctggcttctccccgttgctgacacctgctccaataacagaggtatggctgaggatgcacactccacagagcctgcaggagctgggtacaagtgggagccccacccctttcaagttgtattggtgggaggtccctggatgcagctgtagccatccaaatctggctgcagacccaggattctctgtactcttggggacctgggtaggtccccgtacctctcgaggctcagaagtgcctgttcctgttgcttggcctctccccactaccagagcccactctgatcttggaacaaagttggggctgagctctggtgctactgcagcccagctgggttcccagttaagtatttgtattagtgtgttttcacacggctataaagatactacctgagcctgtgtaatttataaacaaaggaggttttattgacacacagttctgcatggctggcaaggcctcagaaattttgtaattttataaagaaggcagcc

SEQ ID NO: 479537 - DNA, 756 bp, Homo sapiens
ctctgctttctgctttattattcttctgaatagtccatccttgatacacaattgacttggcttctggcttgtgtagaaatgtgtgcaagtccctcaaatgctcatgtttcccgaggggatagagaaaaagattttccaccaggcacacagacgtgtgccactacctatggtccttgccagtgtgaccacgtcacatcctatgtaagaacaggccaagagattcggaaggttggcatcaataaatgtcgtaatttaataaactatattatggaacaatatgcctatgaaagtcacctgccattgacagttttgtcatctcagaagatgaatcctgattaccaagaagaatttttgttgctgctacacaatgtaaataaaatcgaatatgttcggaactgccttcttagtacttccacgctgcctcttaatcttttcatcatcaagagaaaagattacctgccttatagagtcatcaaggaaaaattttgtgcatcatactgagaaccaggagacacgggtttttttaattgttgtttatttttgtctttttcttgttcctaacttacaggctaatgtaaccttaatcaagttagctttgtgcatttcttattttataaatagtgatgtgttttttataatctacaagagtgttgtaagcataaataagaaaatacctgtgaaaagccttagattcagaaaagaataaaattttgtgctaagattcaatatggccaaagaaataattgttaatattaa

SEQ ID NO: 479538 - DNA, 597 bp, Homo sapiens
ctatttgcaacctgattgcaggtaacccactctgagaactctctgccatccggcagtatgaaccagaggcctgagcaccagaaatctacagaaccgtacgcttatgagacaatccattccagcacagcagtagaaaggggtcaggtgggattggattccccacacagagtccccacaggggcactgcctagtggagctttgagaagacgaccactgtcctctggcccacagaatggtagatccactgacagcttgcactgtgcactcagaaaagccacaggaactcaacaccaatccatgaaagcagtcattggacctgtaccctgcagagccatagaggtggagctttccaaggccttgggagcctaccccttgagtcagtgtggcctggatgtcagcagggaagctatccacttctcagacatactcctgttccagtgctccagctattcggaccacacaggtacctcttttcatctgtagaaatgtagatttttcaagttgagaggaattgtgactctatcttgaaagcctgaacctttaggatgtcctcctgcagggatgctctcaccctaaagtgttccagaaaggttgtct

SEQ ID NO: 479539 - DNA, 636 bp, Homo sapiens
ccttctgagatctatccttctttgagcctcaaggacatcctataccttccttaaaatgcagtcccttggtcatgccatatttcaccttattttccacagggaatccgcacaccctgggccagaaagcaacctgctgccttgaaagaaatgaccaagccctggcagcattcatcactggccacctgaatagcccttggttcctgaatagacagcagcgatacccaggtactgcatcaaggaccttgggtgaaccactgagacatactggcttcaggtaccagtatggacttaactcttggacagcatttctagacctgcccgtgaccagacaggtgcccacagccctgaagggagggaagtgtgggaagaacggcttcttgtggtttgagttatggtttgagtgtcggctcagctgcagtacagtagaacaccagaatggctacaaacaagctcagacagtgaagactacaatagatacctaaatcttcaatgaccagatgccaaagaatatctactagcatcaacaccatccaggaaaacataacctcaccaaatgaagtaaataaaccacatggaccaattctggagaaacagatatgtgacctttcaaacagaaaattcaaaatagctgtgttg

SEQ ID NO: 479540 - DNA, 618 bp, Homo sapiens
cggcttcattcttgaagtcagcaggaaagtgtatcatctgtttagatgaaagtgcagagaaacaagaacaaaccaaaccaaaactcagcagcagaaaaaaaaataaccaagatcaaaacagaactaaatgaaattgaaacacaaaaaataaaaaagaaaaataaaacaaaaagctggttctttgaaagagtaaataaaattgatagaccattagcaagcttaaccaagaagaaaagacagaagatccaaacaagctcaactagaaacgaaacgggagatattacaaccgacaccccagaaatacaaaagattattcaaggctactatgaacacattaatgtgcataaattagaaaacctagcacagatggataaattcctgaaaaaatacaaccctcctagcttaaaccaggaagaatcagaaacgctaaacagaccaataacaagcagcaagattagaatggtaatacaaaatttccgacagaaaaattcctgggcaagatgaattcacagctgaattctatcagacattcaaagaagtattggtaccaatcatattgacactattccataagatagagaaagaaggaatcttccctaaatcattctatgaagccag

SEQ ID NO: 479541 - DNA, 1556 bp, Homo sapiens
tgctcacagcagtcccgggagaaatgctctatgcaccacgctgaccctgccggggcattgggagttggtggcattttttccttctggttactggtgatcactcccttttctcatctttttaggcgtagagaacactggaaagtcagagaaggcaacatggtgaggaaagtaaaaattggagtaatggagccacaagccaaggagtgctggcagcttccatatactggaagtgacaagaaacagattctcccacgttgtcctcagaaagaatttgccctgcctaatatcttcattcagtccttattgggctttatttatcacatgcaatgcaagtttgaaatgtcctctcgtgggttcattaaaatcatctgcaactgctttctgaatctttttgttgaaatatgtacaacatttcaaagtagtctaggactagcaaaaatagcaaagtagagagtaatagtgaagtcctgttttctataattccatggagttcaagaaaccttggtttttgttttaggaaagcgttatgacttcttaaatgtggtgacaaaattcgagacaaccagcccgtgaaggcatgtccagtagcaggatttctcatgtaggcgttgagcaacttcctcagtaaaattttctgggaaacggaggctcgggagattgccacaagggaattaattaattttgggctgtggctactggaaggggtaagactattgctcagtagtgacgaaaaatgtttcctttctcccatttcacacaatattgtgttctatagaatgatataagaagtagtatggattaaactaggggtcaagaacttttcctataaaggtccagatagcaaatatgtttggttttgtgagccataaattctctatcacaattgctcaactctgccaacatagtacagaagcagtcatggcgaatatgtaaatgatgacgtctgtgattcaatatatttaataagataggtgacagttcagatttggctcatgggcctcagtgtgccaatctctgcactaaaccgtaagggtgaagtaaatccaaactcacaatgtctaaacttagaaaatgatagaatacaataaaaatgacaataagcagtcaaaatcattaatgattactgttaggtatcatgaatggaaaaaagcatttttacaaatctgcacaatttctcttcttaaatatggaatgtaaatatcaaactcagtacaatgtttaaaattttatctattatttacaatgcacaagataagaacaagttctaatattctgggtcatagtttggcagtcatctggatatgtagtatctattaataagcattcgtaataaaaagctgcagagattgagagcacaagagtaaaaaaaggacagagaaagactgaggctaagtaaatcatagggaatgtaaaaattatgcagagactcattatgtcatggtaaatgattctactaaaatttaggaaaagagttccaacacatagatggctcatactttataatgggctgtatttagagagataaaccacagtcctcatgatgtcctttgttgttc

SEQ ID NO: 479542 - DNA, 616 bp, Homo sapiens
gagggtccatagcttcattcttgaagtcagaatccactcagttacccagcaggagtactcccagggacacaatgggaggcaccctgctagtgcaactggtaacaggtacaacatgtacaaatccaactgcagatgctaaaacagacatttgttgcagcaccagtcctatggaccaaggtattagaggaagtctgatctacccaggaatcagctccaaccccattaaactgcaattccagataaaatttcaccagcccaaggattcaacaagagaaatactatgcctgctgaaaccagtttgtaaagactggaagcagtgtttgcttcttcaaatgtacagacacaaattaaaagttacatggatcatgaagaatcagacaaacaggtcaccatcaagggaaactaataaatctccagtaactgatctgcaagaaattgagatctataaatttcctaacaaaatacaaatgatctccctaaagaagctcaatgagatggaaggtaacacagacaactaaagaaatcagataaatgcttgaatacattcagaagtttaattaatataaactgtaaaaaacaaccaaatataaatcttagatctgaagtgtacaatgat

SEQ ID NO: 479543 - DNA, 736 bp, Homo sapiens
gggaggagccccccccctcacagcgctgaaaggagcaagacacatggattcctgggccagaacgggagtgggatgtacctctctccacagggcaggtccagaaagactggaggaggtgccaagacaccggaatgacaaacggcagacaaattctcaaaccgttcagtatggtgcagaagttgcagcaagggtcacacttgagaagcctgcaaggagaaatgaggactatctcactagctttgtgtacatatcagactgcctaagtggatggctagcacagggaaatggatgtaccacacttcactcacctacaccgttctcagtaaactctttggtgctttgtgtaacccctgagggactcagatacaaggttggggaaatgggaaggaagaaatcctgcaatgacagtgattcagttttgcccctccctggtaggtgtgggcccacaaagataagatgtagagcgagaaagagagaaaaggaaagaggagagagactgaagcaggattctgggcaaagtctgagatgacctgatgacctgtgtgatctcttccactgacttgctaccatggaagttacataggaggttaggctaccttttatttatttgccattctccctgggcattgtatatattggcatagttgaaattgctttgcaggtatgtctgtgttctagcccacaggaagatgaatgagcataaagaaattcatttccaatgttttaagacccagtc

SEQ ID NO: 479544 - DNA, 706 bp, Homo sapiens
cggcttcattcttgaagtcagttcaggctgtgatgtgaggacacctactgttaggggtagaaggggcttgagttatgggggcgaacccatatgggtctacagcaacctcaattcctgcctgctcggaagaaaaaattcgactgagcggcataaggccgaaaaagacaccaaggaaatggaataatctaaagcacaaaaagtttaagtttcccaatatcacaagagtagtatgtgctgttaattgtgaaggctactgccaatgttcccttaaagcccaaggcctcttcagtcagcttgtggtgaataatgccaggagggcagtgggctcctctgtgccccatggcaagtccaaaaatgttgtccaagagccatggcctggaatcagggaccccaagagcccacctcggtctctagcccctgtggctggctggcacctaaggtgcaaaacaaaatcccctttactttttcttctgcttttctcaagcagaatgatttaaaccccagatcagataaaaatacttggaagagcataatgactcaatcctatcacaacatagagctggattagataacaccaaggcaactttatgactaataaatatatgatttaacacagagactaatccaataaagtccccaagtaaacctatgtagaaacagccaatgtcttttagtgccaacactccgttccttatctggacacaga

SEQ ID NO: 479545 - DNA, 657 bp, Homo sapiens
aactttctagagacttgttgaatggcgttgactaaaatgctcaggtggtctcagatggagatgaggaacttgttgggaactggaacaaaagtgactctcgtcatacttcagcaaagagactggcagcatttttgcccctgccctagagatttgtggaactttgaacttgacagagatgatttaaggcacctggcagaaaaaatttctaagcagcaaagtattgaagatgtgagtcggatgctaataaaatcattcagttttatgcattcacaaatatatggtttggaatttgaacttacgtttaaaagggaagcagagcataaaagcttgaaaaatttgcagcctgacaatgcaataaaaaggaaaaatccattttctgaggagaaattcaagctggccgcagaaatttgcaaaagtcacgaggagccaaatgttaattgccaggacaatggagaaaatgacatggtgccctgcatcccagctgcttcagctccagctgtggctaaaagagaccaatgtacagctcagtctgttgcttcagagtgtgtgcaagccccaagccttggtggctttcgtgtgctgttgttcctgagtggtgagagaaggcatccttgacttgtcccggttttcaaagggaatgttttctgttctaaccat

SEQ ID NO: 479546 - DNA, 555 bp, Homo sapiens
caggaaaggaagcgaaaagtcctgcagtaagtcattcagagagatgggtacaagacaaagtcccttttacttttccctttacttttctcaagcagaagaagccttgcctcatagccaccacagctgggaatgtgttaattctcacttgaagccagcaagtctcagaatctcacccaacactcaatgtagtacctggatatcactgctggttattcaggggccgaaggctctttacttacccagtgatgaatgctgccaggactgggttcttcccttcaaggcagagggttcctttctggctcagaatgtgtctagaaatgttgtccagaatgcttttcaagtttatttaagacccgatagcattttaacccatggtggcaaggcctttgggaactcatgtttggactactgggatcagtgatttgcttgtacctagggctcatttaaatgtaccttccatgggtagatgccagctgagtttggtctagtcttcctttgtactctaacagggcagaactgagttgagtgcctcacaattgctgtgcactcccttcc

SEQ ID NO: 479547 - DNA, 686 bp, Homo sapiens
ctacacctgggcctgcttgagccatggctaaggcagccaaggggcactgcaccagaattatggaagcagagacccaagatgttcagatgtgtccggagtttcttccttccagtgggttcatggtctcgctgacttcaggagtgaagccgcagaccttcgcagtgagtgttacagctcttaagggtgtcacgtccggagttgtttgttcctcctggtgggttcgtggtctcaatgacttcaggagtgaagccacagaccttcacatgagtttaggagagcagttctctgctgagatcatccgggctttgctgtgtggcatgttaaacccgaactgcatcaaggacaatgctaccaacttcgaaggaatcatcaagttcagtgtcagggtttcctcaacttttattactccctgtcttcaatgccaagtggtaaaaattatgttaaaaccagagagactatgggagaggtataaatagatgaagcaaaggaaatttttagagcagtgaagctattctatttgatactgtaatggtggatatacgacattaagaacttggcaaaacccataatactgtacaacacaaacagtgagccctattttaaattatggattttaatgaataataatgtatcaatatcagctcatcaattctaacaaatataacatactaatgcaatatgttatt

SEQ ID NO: 479548 - DNA, 1015 bp, Homo sapiens
tgagatctgatggttttataagtgtttgacagttccacctacatgcactcatactctcttctgccaccttgtgaagaaggtgcctgcttccccttcctacatgattttttaattcaagaagaaaaatgggagtacaatagaagagaaaaagacactcggatcccagggaagagcataccggcaaacagctcccatggcagcatccagctgataaaagtgagtgaagccccagtacggatctgggtgcagggggtgcctcctctgctctacactcaggcaaatctccagacagttggagtacctgctcacctggatcagcagcctgagccaccccaccttttctgtgcagagattgtggcaaagggggctgtccccagttcctgtgcagagaacttgggactaaagaggtttccaagccccatgcctgggcacaccaatgggcacttgatgggagccctctggaagcccctcaacactggaggttgggctgaactattgagggacatgtgggtgtgcctgctcagtctggctaccccacccatcttagaccgctatcctgggctgagcagagagctcagaaccctgtgcactccacagatcagcccattgcctgagacaacagagagcttcttccagcaaataaggattagaaatacaaccatccgttttggacacagctggctcgtacctaaaagtgtcatctaccaacctggtctccagatgagaaggagccagggcaagaattatggtaacataaaagatctgaatgttttgacaccactgaaggatcacgctagctctcctgcaataatcccaaaccaaaatagaaactcataaatgacagataaagacataacaacatgtattgcaaggaagctcaatgagatccaagacaaggttgaaaatcaatacaaagaagagtgtaaaccaatcaaggaaatgagggaagaaataaacatcttaaaaagaaatcattcagagcttctggggttgaaaaactcacttaaggcatttc

SEQ ID NO: 479549 - DNA, 929 bp, Homo sapiens
ttttcaaataactcagtaaatccttcagactaaagcagccatggcacaaatggccccaggtacagcttggctgttgctctggatagcacagaccccctcgctctctctctgcgcctcctcggcctgggctcccactttggcggcacttgaggagcccttcagcccaccgctgcactgtgggagccgctttctgggctggcgaaggccggagccggctccctcagcttgcagggaggtgtggagggagaggcgctagcgggaaccggggctgcacgcagcgctggcgggccagctggagttccgggtggacgtgggcttggcgggccccgcactcggagcagccggctggccctgccggccccgggcaatgaggtgcttagcacccgggccagcggctgcagagggtgtactgggtcccccagcagtgccagcccaccggcgctgcgctcgatttctcaccgggcattagctgccttcccgcggggcagggctcgggacctgcagcccaccatgcctgagcctcccacccactctgtgggttcctgtgccgccccagcctccccgacgagcgccaccccctgctccacggcgcccagtcccatcgacctcccaagggctgaggagtgcgggtgcaccgcacaggactggcaggcagctccacctgcagcccctgtgcgggatccactgggtgaagccagctgggctcctgagtctgccagcgagaccacgaacccaccagaaggaagaaactccgaacacatccgaacatcagaaggaacgaactccagacgcgccaccttaagagctgtaacactcaccgcgagggtccgcggcttcattcttgaagtcagtgagaccaagaacccaccaattccggacacaggagaaataaagatcataaagatcatgtttagaaattcaatttgact

SEQ ID NO: 479550 - DNA, 1226 bp, Homo sapiens
acctgggaggccaaaccaagcctagacaatccgtgcaaagtaaccctgaggaggacgacaagccctgctccagtcacacccggaagctgactggtctatgcacggccgaagcatgaggaaaatcgtcgtgggacttattttccttataacatggacttgtgtggtaaaagcttccactgcttcttcccacacagaggactgctttcagtgcatacatgaggtcactgacgtaggacaacaagttaaggcaatctttttgttctatagttattatgaatgcttaggatttccaaaaggagcatgtttgtatgataacactcagtacaaagtctgtaatccaggagtgaccagcccgatgtgtgctatgacccctctgaacctcccatttccagtttttgaaataagattaaggactgaagactggtggggactcataaatgatacaagtaaagtattagctagaacagaagaaaaaggggtgcccaaacgcataatcttaaaatttgatgcttgtgctgctactttgaaaaaggttgaaaaagatcctgtttggctccaaaaagggaaaggaagcccctcctgcacgagtggaagctgcaaccctttagaattagtaatcacaaacccctcagacccaaaatggaaaaaaggagaatacatatctctaggcattgatggaaaaggactagaccctaaggacggcttagttgtcttggacgacaactgtataatggtaccacaaaaacagttacatggtggagttccagttacacagaaagaaatccattcagcaaatttccaaaattgcagactgtttaggcccacccagaattccactgggactggactgtccccacagggttatactggatatgtggacgtagagcctatgctaagctacctgatcagtgggcagaaaggcaacatagttaccatggtttttcaaatgtcaactgtgttcagcatgtgcgtaggtgctatagggacatgtgacaaaagtgcaagcaatagtacgaactctcatggaactttgcattgatgatagtacgatatcctaagactggaatatggtaagatataaattgctcaggtattctaataaatttcccttctcatcaattcagactagtcctacttctgggacaacacattttcttaaagggcatctaactgtaatccttcattgcatattgaaaactacaaacctagggtttgttagcattttt

SEQ ID NO: 479551 - DNA, 568 bp, Homo sapiens
tgaataggaagaaatactttcaaacttttacaaggttttatattgggctatgcagttcagtctacaatctagtaaatgttacttagaggcaagcagatgttctgaatgccgagagatctgccagggtatgttccagagacggccccctacaccaggatctctgcacaggaaaggtggaatggctccggctactgatgcagataagctgttgcttccaatgcctggagatgtgctggggcttggagcagagaggcccccctgtgcaccaccatctatgtacaagaagggtgaagcggctcaggttgctgacacagatgagtggatactcagaatgcctgatgatatgtctgggtgtgaagcagagatggcctgcctgcaccaatatctctgcacaggaggggtcaatgaggagctacatccttcagcttttttggtcagtgtggttctctctcatccaatggtagccctggagtcgcttagataatggaaagcatcactttcgacaacatcatggaaaagggttgggaagccaagatttcttggttaaataaaggaggtttttaattat

SEQ ID NO: 479552 - DNA, 499 bp, Homo sapiens
tttcctcactatgcaagggtccttcatcattaatacctctttaataaaaactcttctcaaggccgctttacttccaaaggaagctggagtcattcactgcaagggccatcaaaaggcatcagatcccatcactcagggcaacgcttatgctgataagaatttgggcctgtcctcggaatgctacaaggaatggggtgctgctgtaaagatacccaaaaatgtggacatgactttggaactaggtagcaagcagaggtggaacagatttgagggctcagaagaagacagaaaaatgtgggaaagtttggaacttcctagagagttggagggctcagaagacaggaagatgtgggaaagcttggaacttcctagagatctgtggaactttgaacttgagagagataatttagggtgtcttgtggaagaagtttctaatctataaagcattcaacaggtagcagtgcacaaaagtttgaaaaatgtgcagcctgatgaggct

SEQ ID NO: 479553 - DNA, 1100 bp, Homo sapiens
tctgagctcctgctctttctcctctttgagcctgtcacaaaggctgagatgctgacgactgtcatcaagaagtataaggactgctttcctgtgatcttcaggaaagctcatgagttcatggaactaatgtttggcattgccctgactgagatggacaccaacaaccactcctatgtctttgaaaacacagtagaactctgcgaccaagggaggctgagtgatggccagggaatgtccaagaaccacctcctaattcttattctgagtgtggtcttcataaagggcagctgtgcctctgagaaggtcatttgggaagtgctgaattcgataggggtgtatgctgggagggagcccttcatttatgggaagcccagggagctcctcactatagattgggtgcagagaaagtatctggagtaccgggaggtgccctacaatgctcgtccagagtatgaattattgtgaggtctaagagcccattcagaaatcagcaagacgaaagtcctagagtgtttaggcagctagacagtaccattgctagttcctttccatcctggtacatggatgctttgaaagatgtggaaggcagagcccaggccgtcattgacaccacagatgaggctacttccatggcccatgcaagcccactatcatgtccaccaacttctgtcctgagtcaagtctgaggcagattccccctctgtgtttgaagagggcagtcaaggttctaggcaggggaggacgagagtggagctggagggaccacagtgttctttgtgttcctgtttcatatgagtgacttagaatttaacattttgtgtgtgtgggcgggggggggggggcagtatttttcaaatgcttccccttttggttggcttaattcacttcagaatcttagttcatgaaaatcgtcacacatgtactgctgtttatctggtttaagagtaaggatttcatagtttgtaaggaaaaaaattgaaaacctgtcttatgatctggaacagtagaatgtggtgtcgggattggattggaattttctttgaaatgtgaaagaactccgtatttaaatcatggaacaaaataaaggattgttaattttt

SEQ ID NO: 479554 - DNA, 1041 bp, Homo sapiens
tcacactgaccagttccatcacccgaaaagtcccctgtgcatctcttttgagttggcagggtgttatgggccgaattataccccttcctcaaaatgcacacatacaaagtcactgcatttggacatagagcctttgaagagtttaatggaatcattgttgtgtctcctggcggcagcgtttctccctctggaaataagacctctaggccaccagaatgtaatgtcatgggaataggaagcaaaagtgttgctagtgggtccctaggggtgatgaagattgaagggccttgctccaaaatcctagagccccctgctgtgattcaccaatgggggcctgccaaaaggtttaaacagcatccctatccgccactgatacctcaagcagcattggatctgctggatcatatggcccaagtggcagggcagcttgcacagcagcctggacctgttgcagagccttctcctcttctgaacctcactcaaaactggcagccttttggtcgaccagtgatcttgtgtaagggaaaatcgatcaaggtctctcctaataagattatgacacaaagcaggagagtggatgtacccctgaggtatgacggtaaaggtatattgctggccttgccagctgaaggcaatttgcttctggtgggacttatggacaggaatggagaaaaaggcatttgccaaatcaatggctgcatcccagcccttcataatagcctttcccttcataatagccctcaccctcccagtcagggagccaatgtgggggttctgcaagctgctaagtatgtctatgccaattatacattctggcactgggaaaatggccacaggatgagtccggggacccactggatcatcttgcatttaggagcaaccaaccaacttcattatgttccttgattctccacatatggtcaaaggtattaaatatagggtcactaaacttttttctcacaagcagttaatcaggagtgtcaaatgcatttattttgcataattctctaaacagttcacgccaaaggctatcggtgttct

SEQ ID NO: 479555 - DNA, 643 bp, Homo sapiens
taatcaagttaacatcatcagtgacaaattttgttggtactatgtgctgtcggtgcactaagattgggaagctaaaagcagactcagggagtatgcctgcagctgcaggaagaggacatgaaaggagtttggtttatattccaaacatgacagggtgctacagaaacctgatgcgaaaatgtggaaaatatagaggtttgtggagaactgaagggacccagttatcctggaagctgggaaagaattctaaaggcaatgcaactccctcacaaggatgtgctccattgtctagcatcacggtgtgcatattacttaggcttgtctttcgctttctaagttatgaaaaaccaaagccaactaacaaagatggattcatccagccacatgttcacaagatgatgggtacatgtctcagaaatattagatcaaggaatcttttgactggaacattcatcaccatattaatccgttttctggctgctgataaagacatactcaagactggacaatttacaaaagataaggtttaattggacttacagttccacgtggctggggaagcctcacaatcatggaagaaggcaaggaggagcaagtcccatcctacatggatggcagcaggcaaagggagaacgaggaagac

SEQ ID NO: 479556 - DNA, 813 bp, Homo sapiens
acttgcgctgcagagaatgtctgatgagggagaggcctggagtaggctactgttgctctagggtggcaggggttagggaaaaatcaggagaggctgtaggctactgttcatctaggatggcagagtttagtgaagaagaggaagacactgtacgctactgttgttctacaatagaagatgttcctgaagaaataaaagaggctatagcctacttttgctctaagatggcggagattaacaaggagccagaagggaatataggccaccattgctacattatcccaaaggttaccgaagaagtaggagaagctagttcagacatgcctgaaccatccacaagcacaagccaagaaaatcccagcatgaaatggagaaagaaaactacttgtgaagctaaagaaggtgaaactgacgagttgttgaaggcagcaaagaagataagatcatttgttcagcagaattcagaaagacgtaaagcggggaaaaagtcaactgtattaattttttattaccacagtaataaaaaaagggatgaaaatcagccaaatgaggatgaagacagccacgagtaatctcccacctcaagtgattctgagagctcatcagaagaccaagacctatctcatctctaggttaacctctagaaatggtctcctgtgcagagaaactacatattgcaccaagattcttggatgttggtgattaaaattcaaccaaaagattttgaaaagttctgtatatctctgtggtgttttctaataatggagagggagggaaagaaggggaagagcatgtgtatgaggagggagggag

SEQ ID NO: 479557 - DNA, 470 bp, Homo sapiens
gactttcgagcgcagagacccgtaaggatgatgccaccattaaccatcatgggaaactcaaccaggataaggcataaagcacttgatatttgtcaggactgcaggatacctgctcctctatttaaaagattaaataattcaaagtcccgtattatcacatttgtgctagaccctacgggctcagaagaagacaggaaaatgtgggaaagtttggaacttcctagagacttgttgaatggctttgcccaaaatgcggatggtgagatggatgataaagtccaggctgaggtggtctcagatggatatgaggaatttgttgggaactggagcaaaggtgactcttgttatgttttagcaaaaaggcggcagcattttgttcctgccatagagatctgtagaactctgaactttattgggggaacccacccccaatatttccacgtaggttcttcctattttccgtaagtgtc

SEQ ID NO: 479558 - DNA, 529 bp, Homo sapiens
gctgcctaagaccatggcaacctacctcttctatcagtgtgacctggatgtgagacatggagtcaaaggagataattctggaattttaaaatttgactgccccgctggatttcagacttgcatggtatctattgtccttactttttatgaccctgacagagctttgagagataatcatattagaaacctagacctgggtcctagctttgttggttgtcaatgggttgccattgtttttaggctctcgcagttgacaaagcaagaaaacatagaagttggagctccttgttcttgggcctttagactcagactaaattacaccactggctttcctggttctccaactttcggacatcagatggtgaaacttaggcttcacaaatgcatgactgaacccatggatttccttctaataagtagaataaggcatgagtgacggcgtatcagttgcaaatgacatgacaaaagactttgcctgttatgttactggtactcttactgacactctattttgccctctcacctgcac

SEQ ID NO: 479559 - DNA, 984 bp, Homo sapiens
tacacgaggcatagctggcgaggcctcaggaaacttacaatcatggcagaaggtgaagaggaaggaggcgtgtcttcacatggccgccaggaaaataagagacagggggaggtgctacacacttttacaacaaccagatcctgtgagaactcactcactatcacaaggacagcaaaaaggaagttggctcccatgattaaatcaccttctacctggcccctcctccaactctgtgaattacagtttgtcatgggatttgggtggcaacacagagccaaaccatatcacctttctaatttcctcatgaattactgtggcacctcaactactactctgcaatatttctgccaagactggacaaagggcaacatgagtgaggaccaaccccggcacttagctgcacaggaacaatggcgagcccctttgggcgcctcactgatcagaagggcagaggacaccctgctggatctggaggagtggaagtcaatggcggcggtggtggacggacggccttcggcggtggtggacggacggccttcggcggtggtggacggacggccttcggcgttggtggacggacggccttcggcggtggtggacggacggccttcggcggtggtggacggacggccttcggcgttggtggacggacggctttcggcggtggtgaacggaatgcacttactgataagagatagaggcaaactgaaccagcagctcctggggatgcgctcggtgggtggtacccgaagcccctgcattatctctctgtgatagtttaagcccctgcacctggaactgtttatttttctgtaactgtttctgtaaccattaatctttttaactttttgcctgttctgcttctgtaaaaatcgcttcggctaaactccccctcccctatttagaccaaggtatcaaaagaaatctagctccttcttcggggccgagagaattttgagctctagctgtgtctcagtcgccggc

SEQ ID NO: 479560 - DNA, 1217 bp, Homo sapiens
caggggcgagggttgaaaaactgtgagaaatgaggatccagtttcagtcttctacatgtggcttgccagttttcccaggaccatttattgaatacagtgtcctttccccactttatgtttttgtttcctttgttgaagatcagttggctgccttttctacagattatcatcaaggtgtaggcttggtaggtttagatcctgctaacagtgtgttccagtactgggaagttgatgttggagtaaaaggaacacaaactctcaagaagttacatagattttttccgcaagcagctcttgcagcaagaatttatgaagtgacgctggtcttgagagaggtagtgcagaagacaaatgtagagttggagccctcacacagaatccctactcaggcactgcctagtggagctgtgagaagagggtcaccgtcctccagaccccagaatggtaggtccactgacagcttgcaccatgtgcctggaaaagccacagagactcagcaccagcccgtgaaagaagccaggaggggggatataccctgcaaagccacaggggcagatctgccaaaggctgtggaagcccactttttgcatcagcgcatcctgaatgacgacaatggcaatatttatactgtcataggtgactacataaaccagatcaacacttcaagaggcaagtttaacagtggggttttatataaatttggtgaagattttgaagctgccagtatacaatgtgaggtcttaaagtatatacaccagacagcaaataatatgctttatctgaaattaattatgaataaatgctcaggatcaaatgtaaatttttcccacaacacctaatgtacagaattgttgtgtttcgttttttgaaatcaaatcaaatgtggctccaagacctccacttgtcaaatatggtgaatagtttattgaatctctatttttattcatgtctttctcctcatttggttgcaccaggattgaatagcacagggcagtagattagaggcctttctggtaatcattccatagtcactgctgaggatgttgcctaaacttaaatgcctaaacttaaatgctcttaaaggtatgtggtgctactggtgctatagttcctctaagtcagaatgatctgaaggacccttagcatttaacatggtctttggtgtcatccacacaggtatactcatttcaatacaccaatacctctaggatgcttca

SEQ ID NO: 479561 - DNA, 730 bp, Homo sapiens
ctgccaaagtgggagcccaggcagaggaggcgccgagaatgctctctggcctgctcccatgtaagatgtgcctttgctcctcctccgccttctggcatgattggtatccggcagacaaaatttctaagcagcaaagcactcaagaggaagcagagtataaaagtttggaaaatttgcagcccgacaatggaatagaaaagaaaaaccctttttctggggagaaattaaagccagctgcagaaatttgcataaagagtgcaagccccaagccttggcagcttccacatggtgttgagcctgcaggtgcacagaagccaagaattgaggtttgggaacctccaccaagacttcagatgatgtgtggaaatgcctggatgttcaggcaaaagtttgctccaggggcagggccctcatggaggacctctgctagggcagtacagaagggaaatctgggaatggtagacccacttacagcttgcactgtgttcctggaaaagccacagacactcaatgccagccatgacagcagccaccggggtggaggggggctgtaccctgcaaagccacagaagcagagctccccaagggagcccacctcttgcatcagtgtgacctggatatattactgacacatcagctcctgtatccataagcccataaaatgtctttcctgtaatttgcactgtacagcccaatgatttcctttattgcaagaaggcaaagtcctggc

SEQ ID NO: 479562 - DNA, 637 bp, Homo sapiens
gaggtttggaaacctacgcctagatttcagaagatgtatggaaatgcttggatgcccgggtagaagtttgctggagggacagggccctcatggagaacctcttctagggcagtgcagaagggaaacgtggggtcacgaccctcacacagggtctctactgaagcaccacctagggatagctgggaaaagagggccactgtcctccagaccccagaatggtagctcctccgaccacttgcaccatatacctggaaaaacagcagacactcaacaccagcccatgagagcagccaggagggaggctgtaccctgcaaagccacaggaatgaagctgcctaagaccatggcaacctacctcttctatcagtgtgacctggatgtgagacatggagtcaaaggagataattctggaattttaaaatttgactgccccgctggatttcagacttgcatgcgctgcctccgattgccctggtgctcttggttgatatttgactttactctgccgaggggcaaggaagaagcacttattacacaaagataaatgatcagatgtttctcaaagtctgactttggatcatttccagacttctgaagaggtttatttattctgactatttttgccagtgttcttacc

SEQ ID NO: 479563 - DNA, 650 bp, Homo sapiens
accattaagacatacgcatgcgtatgttcttgacagcactattcacaatagcaaagattttgaatcaacctaaaggcccatcagcagcagactggataaagacaatgtggtacataaacagcacggaatactatgcagccataaaaaaacgagatcatgtcttttgcagcaacatggatggagctggaggccattactctaagcgaactcacgtgggaacagaaaatggaataccacctttttccatttataagcaagagctaaacatcggtatacatggacacaaagaagggaacaacagacacccgtgtctacttgggggtaaaggatggggaggagggaatccagctttaacttataaagccaataaagcccttgaaaaactggcctcatattttgtgtacacagatcacggccatttcacagacaactacccaaaaacatctacagacggcattgctcctactgtcaacccaaaaaactctccgtcccctcgtcagcaggaaatgcgtcatgaattatttgcaggtgttcctctttttcaatgtaggcacttatagctataaacttccctcttaatactgcttttgctgtatcccatgggttttggatgatttttctgtgggtagatgatttagttccttgccttc

SEQ ID NO: 479564 - DNA, 716 bp, Homo sapiens
accattaagacatacgcatgcgtatgttcttgacagcactattcacaatagcaaagattttgaatcaacctaaaggcccatcagcagcagactggataaagacaatgtggtacataaacagcacggaatactatgcagccataaaaaaacgagatcatgtcttttgcagcaacatggatggagctggaggccattactctaagcgaactcacgtgggaacagaaaatggaataccacctttttccatttataagcaagagctaaacatcggtatacatggacacaaagaagggaacaacagacacccgtgtctacttgggggtaaaggatggggaggagggtcactagtcagaagtcactttattggaaaggctatcctccatttaatggtgaagacgttaaatggtacttgtacttctttccaaaaaaatgatacttttatcagttattttactacagtacctggaacatgtaaacttgcaagcaatatttggtgaatgaaatatttggttaacctgaatttagtattgcagtcttcattactagaaagcatttacatgttttaactgtcagggagcaacactggtttaagcaacttttggaaggttaattgtaaagaaaatttcgtgtgtgtacatactggctaaagttaaaggggtatcattcagtttttctgtaaatcgagcattaaaataaaagcacaatgggtttctgtt

SEQ ID NO: 479565 - DNA, 1111 bp, Homo sapiens
gtctgaagatctgctcagagtgtgccagtcttcctgatgtctcaggcctttgaggggcatggacctgatgccagcaggaactctcctgtataaggtgtctggcgacccctctgctgtgctgtggggaattcctcctggatcaaaatcatcccgtttccctggcactggcaggggaaaaatggcagactggagccacagtgatggcagccacacctccctgcaggagttcagtcgtcgcaggcagctggcagccacagtgatgacagccacccctcctccggggggctcagcatctctagccgtgtggccaccaagaatctgcacagctctgtgcttgggacccaaggccctggtggtgtgggctcacgagggagatcccctgatccacaggttgtgcagatccatggcaaaagcatggcttcctgataagggtagcacaatcgctcatcgcctccctttgctggagatggtagtaccccttgccccatgtgactcccagtagttcttttctaagatgaaattacattattgaagctttctggtcactccggccaaatgaaatatcactcattaacctgaagcaccctgcgtaagacctgtcactttgcagctgacatagtgacacttgctctaatttcagttgcgatatacctgctgcagttcttctctttcagagcatttcatttccagtcacttgagtacattctgacaccctgtgatttttaaagtcaaataaataattgcttaatttcctcctgagctttgatgaaatgtcaaaatcattatagaaattgatgagaattgtgctagggtcttgtcagtagctcactgcatccctattaccctcattcctagtcaaactctggggtgatttaaggagcatgttctgatctaaatttagattttaattgcaatagttaggatataatgtttttcattgactgtttacttttgtttggaattaatttggatgacagagtcagtattaattaggaccaggagaatgtgcaggggaaaaaactatcctgataatttaaaaatttatttttgtccaataacttcaaacttttctctaaaacgtttttgcagggtggttaaaaatatcacattt

SEQ ID NO: 479566 - DNA, 639 bp, Homo sapiens
cgaggaccactgattttgagttaaacttcagtttgatttggaatgtgcatgcacagattgcggatagatagactgccaccctcgtcattgcagaaggaaacttgtgagttatgcccagtgcaattctttccaactctgattccactgtggttactgctgatggactctaggtggccacagatgatacaaacatgttcccatggagcctcatgtcatcctgacatgctgttccagtctaaggtaactgctgttcttcagtttagaaaaggagcaactgttttggatacattttcagtgccagaactctttctccactgccttagacttctcagtggtgaagtgagaaggagttttgacagctacagagcaacatttccaaacgagaaaagaaaacaaggcaaactttttataaattattcaaataatatgttaaattcaaggaaaagaaaatttccattttatggtgaagactgatgtttcctaagtctattgaaactatccaagtcaataaattgaagttacacatgtgctcttctgttctgtatcttaatttttaccttatttatgatgctttccattgtgcaaaaggaaatagtgtccctgtgtttgtccattttcatgctgctgataaagacatat

SEQ ID NO: 479567 - DNA, 543 bp, Homo sapiens
ttggagctattcctgtcacgttattgtcaaaccacaggaaattatgcctttcctcattaccacattgagcgctgggcacttctcattggatttagggcccacctgggtcatccaggatgatctcatctcaagatccttaattacatctgcaaaaaaaactctttcccaatatggagcaggacccctctggagtgagggtcttatgacctacagtcagacaaggaggtatccagaagaaggcattgttatcataggagatgacagctccatgcctgttacttcccctgaggaccttccagtgggacaagctgtggaggtggaagacagtgagattgacaatcctgagcctgtgaaccttacctccatgacaaaaatgttcctggaactcagcttcccaacgtcatctctacttcagttctttaggttgccagatgttgaagataaatcactttaactgtggttgcatagaattggttgggaatcacatgagtttcttcatgtaaaaactaccaagacctctgctttgggtctagatcctggttt

SEQ ID NO: 479568 - DNA, 550 bp, Homo sapiens
ctttcaggagccacctggaggcctctttggtatttgagtttgcttagtaacatggcagtatcagaaaaagggatgcccgtagggagaaggaagtgtgagagtggggctcaggattcagcatttttaatgggctcccaggtggtgttgaagctgctggctcagggagcacagtctgagcatagtctcccaaggtcagtgtcagaaaagctggccacagcagggctggcaagctccctaaagcagttgggtaaatgcctcacatgcgacatcactgggaagcttccaatgaaccagtatccaggaatgactgttccagaaacacatcctccctttcttcctccaggcaacaaggaggaagcaagaagggctggcccaaagaataccaacaaggcaaatttggggcttgtgtgcacttctgactttgctaaaattctcatgcctgctttaggaattgccaaatcaagtcatcctgttgcctgacaattccaaaccgtgctcacactaccctccttgtgaagtcttttttgatttgtcccaagtatccagtcac

SEQ ID NO: 479569 - DNA, 701 bp, Homo sapiens
tctcgcccacgatgagcccgtgcttctggctgttaacagggggcactggagagggacaactggacgggagagaggggttcatctcgattggcttgctgcttcgtcaggatgcaggggcgcttcactctggctgcagcggctggtggcagcctccaacttctttccgcacttccagaagcatcctcctggggccggtcggtcacaccggcaacagctgggaggcgccccttcctcagcggcctgagcttagcctagcgtctcctcctctaaacccctgctcccagcagcagccgggtagccctccctcctccgcagaggggtacccggccacttggacacagagccccacagctgactacggagagctgcacagctgtggcgatagaacacaggtatcctggcagcaaatatgcccagtagagggtaatccaagccttatctttcctcctggaagtaaacctgaagtatccgatgaaggagcagacttcagtatcctagcctccagaaaggaatgcagccctgctgacaccttgattttagcccagtgagatatgttggacttctaactgccagaattgtaagataataaatttgtgttgctttaagcagatcttttcccatagaaactacctgtactcacattattgacccacagttgacttctaggggtatccaaccactgtggtttgaatgtgtcccct

SEQ ID NO: 479570 - DNA, 942 bp, Homo sapiens
acatcaaagaccaaaggtagataaatccatgaagatgaggaaaagccagcgccaaaaggctgaaaattccaaaaaccagaatgcctcttctcctccaaaggatcacaactcctcaccagcaagggaacaaaactggatggagaatgagtttgataaattgacagaagtatgcttcagaaggtgcataataacaaactcctcccagctaaaggagcatgttctaacccaatgcaaggaagctaagaaccttgagaaaaggttagaggaattgctaactagagtaaccagtttagagaagaacataaatgacctgatggagctgaaaaacatagcacgagaactttgtgaagcatacacaaatatcaatagtcgaaccaatcaagtggaagaaaggatatcagagattgaagatcaacttaatgaaataaaggatgaagacaagattaaaaagaatgaaaaggaaaaacaaagcctccaagaaatatgggactatgtgaaaagaccaaatctacatctgattggtgtacctgaaattgatggggagaatggaaccaagttgggaaacactcttcaggatattctccaggagaacttcctcaacctagcaagacaggccaacattcaaattcaggaaatacagagaataccacaaagatactccttgaggagagcaaccccaaggtacataattgtcagatttgccaaggttgaaatgaaggaaaaaaatgttaagggcagccagagagaaaggtcaggttacccacaaagggaagcccatcagactaacagtggatctcttggcataaaccctacaagccagaagagagtgggggccaatattcaacattcttaaagaaaagaattttcaacccagaatttcatatccagccaaactaagcttcataagcaaaggagaaataaaatcctttccagacaagcaaa

SEQ ID NO: 479571 - DNA, 896 bp, Homo sapiens
atatacagacagctagtaagtgatgagtcagggtcacagagtcaatttcaagtcacttagcaaatctttcatggagaagtttctgaaccttagcactactgaccttttggacggcatgacagctgtgtgtggctgtgctgtgcatcagaatgctaccaatatccctggcccctactcactagatgccagtagcattcattaccccagttgtgacagccaaaattgtctgcagacattggcaaatgttccctgtggagtaaactcaccctgggtggagaagcactgccctaactccaccgtgtgtttccaagacgagaggctctctgtttgtccctttcctaagaataaacatctgtttctcttctgggtttggtggacattagatcttcagttgctcagaggacctggagacttaactgtttcttcaataaatattccactaacccttctattgttagatccccatttgcactcccccactccccaccacgaagtacctgggccaatcaattcctgagcctctgggggttccataatactcggtttttccttggctttctccattgctgattgaggttcctgctttcttgggcctgctaaatcaattagcatatccatctgcttaccagctgctgaaattttgttcttattatctcctctctttttctttgttgtcctggacttctgccttttgttttgcaaatgtctttacagtcatgggagttaagtaagggatttcaggaaagatgaccaaacaaaatagaacgttccccaagaaaactgatttaaagaagttgagttcagggtcagtcttattttattttatttttttccatctatggatctttcttttagtttgtaccctctgggctgattcaaattagaagagtattttc

SEQ ID NO: 479572 - DNA, 588 bp, Homo sapiens
ccatttccatcaccacttcccatctctgagttagaaaaagcataaatgatgatgtatgacttcgagactttctcttttggatcatcgattctggaggaagccaactgtcaaattgccatatggaaagacctatgttttgaggaactgatgcctccagtcaacagccagacaggaactgaagtctcttgcagacagcagtgcaatatggaaatgcaaaaaaggaggaggaagaagaaagaaagagaagaagagggagaaggagaagaagaaagaaagaaggaagaagagaagaagaaggagaaagagaaagagaaggagagggagagggaggaggaggaggacagaaggaggaggaggaggagaggaggaggagaggagggggaggaggaggaggaagaggaggagctactttctttttcaggcctttctgcagagtttcatgaaaacttttctagcactaaaagtaaacttgtggattccaggctttctgtgagatcttagatctaggactggtccagaagcttttaactaagccatttgaaacagtttttcctaatcctcaaatgtagagggcttattataatattt

SEQ ID NO: 479573 - DNA, 656 bp, Homo sapiens
tgcaactaagagtaggctgcctgctgggaagcttagactgcagaaactactcaggaggctggaagaaaacagcagatgctatggggatagcccaaagaacaggtgtaattggaaggtattttaagtcagttagagattcacattcctcaattactagaggaaaagagaaagtaaacaagctgttttctgtgctttttatgaccctatatttaccctcaagctcttgtaacctagggagggcgccaaagatacactgcaggaggaaagggttgtacttccttgttccgctgactcagcgggttcctgaagcatgcttagctttctccgacattaggctcctgcagcacaggcagtttctccagtacctagctcttgcagtgtacagtgccagccgtatccagcataagaacaccttctttgacttttacatacaagttcttgccaactatgctgtcttggaaatgtgaacaaaaatgcacatgcatatttaatccatggtatataatcaacattattcttcatgaagcccccagaagattttttaaaaaatataaatagtattctatatgtataacatatagaatactatttatattttaattatgattatgcaaaatctcttgtcattttgtgttatttgttcaactttaaagtaa

SEQ ID NO: 479574 - DNA, 1111 bp, Homo sapiens
gcgggtcttacgacctacagtcaataagaatgtggtcatgtcgattttctatgtcaattactctttatgggaacatctgatatcaaatatggtcatcttcaataaagctggggaattcaagatcaaggcatctggtgaaggctgctctctgtttctaagatggtgccttgaacactgcctccttcagaaggtaggaatgctgtgtcctcacatggcaaaagtatctgccctaagggtgtttactctcagtttggcggccccttgccaatggagtggaccaggaggcaagccacagcagctgtgcagctcttttgaactgaaggctgcacctggcactgttcttactgaactaaaggtgttaacaatccccttattaaacggactgagaccacacagtacttcaagaataaaagtggacactggaatccactttgcaaattctctaaaggtgatagggaataaaacactctagaggcatccttttcagcagaaggttttaggactgaaatgtaattttgcttagaagcatctagggttagagctgtataccaagatataactgcttagaattaatagaaaactcaaaaactcttgttcacaaatgtgttctaaggaaccaaagacatttaaagaaatccactgttgctacatcattctctcgtgttctcatttattttaaatccactggtgtaactgttttaactgcacttccagttttttgggccaagtgattatctccaactttatgttcctctgctttgtaattttctcttccaactttttcttatgaccaaaagcttttgactttccttttgaagtagcaggtatttattatccctttttctagtatatttttagttaatgtcttctatttcaatatgataaaatgtttcatatgtgaggaactaagcaaggtcctgcagagtctacaaaaatgactctttagaaatgcaattataaccttacaccttcccttcaccagacactccttacagggcatgcttatcccaccaggagatagcctcaagagacaaaagtcagcttacaaccaaaagtacaactacttttgtccatgatggagtcagctcaaccacctgatagataaggcacc

SEQ ID NO: 479575 - DNA, 1157 bp, Homo sapiens
acacaatatcagatctgcagtgattcttcattgcctgccctcctgtccacactcctgcctactgccacccacaagggtcatcatgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttgagtcagggctgactccatttccacagccactgtgagttccagtgctatgtctggtagcttctcccatacctagtgaagacaaggatagatgttttatgtaa

SEQ ID NO: 479576 - DNA, 530 bp, Homo sapiens
tttctgcgcatgcccatgcaactgctctgcaaagactccacaccactctgtgtgtcacacccaaggctttggtggcatgggctcaccaggggatctcctgatctgtgggttgcaaagatccatgggagaagtgtggtttcctggggtcacgcagtcactaaccacttttcttggctgggtgtgggggttcccttggctttgtgtcactccctgctgggctgtcaccccactctgcctttcttctttgtgtgtctagttgttttcctaatcagtcccagttccattcaggctgctgtaacaaaatgtcttagaccggtaacttataagccatggaacttgatttctcacagtttggaaggctggcaagtccaagatcaaggcaccagcaacatctgggacagcaaatttgatagggcttctcaaacagtcacatgagtctgcaagagcaatgtttcccagagtgcccactagattttcctcatatacattctattcatgtttaatgacagaaacactgttccttattttcc

SEQ ID NO: 479577 - DNA, 3822 bp, Homo sapiens
ctgtctttcttaccctcttcagtgcctcttctagtgatccttatttgcattaaagatgagtcttagacaccatctgagtattcaatcagtttattctgacaatgctctcacaagacggttagaggaaacatgttggtgtcatgggccagatatactcaggtggtctgataaccagatgaccaggaaggtctctgtgtggaaactattctcagtttggggaatctttccctctttctttataattgcattcattcttgcaacactttatgacaaaaaccctcaacaaattggcatagaagagatacatctccaattaataaaagccatctatgatgaactcacagccagcatcatactgaatggggaaatgttagcattccccctgagaactgggacaaaacaagaatgcccactttcaccgcttctattcaacatagttctggaagtcctagccagagcaatcagacaagagaaagtaataaagggcattcaaattggtaaagaggaagtcaaactgttgctgtttgccaatgatatgatcatagaactagaaaaccctaaagacttatccgaaaaactcctagacttgataaatgaaattcagtaaagtatcagaacacaatcaatgtacatcaacaacgaccaaaatgagactcaaatcaagaactcggtctcttgtacaacagctgcaaaaaataataaaatgctcaggcatatccttagccaaggaggtgaaagatctctacaaggaaaactacaacatattgttgaaggaaattatagatgacacaaacaaatggaaacacatcccatgctcatagatgggtagaatcaatattgcaaaaatgaccatactgcccagagcaatctgaagattcaaggcaattctcatcaaaatatcatcattcttcacagaactagaaagaatgatccaaaaatttatatggtatcaaaaaaaggtcccatagagctaaagcagtactaagcacaaagaacaaatctagaggcatcacattacctgacttcaaattatactacaaggctgtagctaccaaaacagcatggtactgaaatgcaaaaaggcatgtagaccaatgaaacagaatagagaacctggaaataaagccaactgatctttgacaaggaatatatgatgaattaaatatatttagatcattttagtctatctccttaagtcttttatctctgttttatatttattaatttctttgtgtttctgtgttgaattctgattttttttccaaatgctccttttttctaactatgtctctcttcaatagtctttaatttgctgactgactaggccatttatttgtaatttttatagtttgtcattattagaaattctcatatgtaatttcttccagacaagatttacatttgtatctgccagagctgttagcaccactttcaactaaataattacagtagggtttttgaggcctcaggtataatatgaattgtgggctcagacccacatgggttatgagggttttcaccttaacctttgtctcatgattcccacatgtagcccttaaaaatcaagactccatccaggccacggtagagttgcagatacaccaaagaaaatatcaactctagtactccctgacttttgtggattcacccttttatagttccctacattttaaaaagtggttttgtgtgtgtgtgtgtgtgtgtgtgtgtgtgtgtgtgtgtgtgcgcgcgcgcgcatgcatgtgtgttgaatgtaaaattttcagatatatttaactgggataagattctctgaacatccttttcagcatattgccagaaaaggctggcactaacttattttaaacaaaatttacctcactgtgaacttctgccatggatttaacttaaacataagacatcataattatctcttatgagtgacttctagataacattgcgaacttttaatttttgaattattctcttggttcactagtgacattttatttgtgacccctcaagaaattatataaactgaagaaggatcatcaagtaatagactgtctttctgttgcctacgatgttgattgaagtgcaacagggaaatgccataagtatcatttattaaattgtgatttctttagatgtaagaacaaaattcaagttataagtatttaatatactgatcatggcctgatgtcctaaaattatctctgaacgtcacacaacaaaaatattttcatgtgcatgtacttgcaataagtcattagacattacagaacactgcagggactcagattcatgcagttaccaaggtgattttaactttgtttactccacattaaaaaaaaatgctgagaacccatgttaaaggtggtttccacttgtatcggtatatttagtctttaccctgcacattcataatagtctgaaattctctcttattattcatgacccttaagagtaacaaatagtcatttaagctggtagctccagaaaataagtaacagtgatcaattttaacataatcaaacaataccttgtatttttgttcaatagcagctgtaagtgctttacttgctgaaaagtgactgtattcatttagttcagcacaactgtgaattatagctaagacacctcctaaaaatttgcaattcagaagttagcacactagaaaaagatctattatgacattggcacaagaaagcctcatccaaataattggcaaacaagcttttattccactttcgtaaatatacgatattagaaaacttctgcttaatgtctaaataaaatgcttaatgtgagcacaataaaggtcttatgttaggcctacattaaagcaagataaaaatagtttttatagtcatcattctgccactctctgaaatgatatacttttcagaaagatatttgttgccaattgccatcttcaaaatggaaaatttaatccaaaatttgatttctaatattatgtgtgtggagaagcactgcttgccccatttatttttaaaaagtgatgccaagcaaatgtattgccatttaattttgcattttcatttaactttggtcaggatatttctgctttccaccacattgtaatggcaaaattgcatgtcttatacctttcaactttctatttaactgttattgtgtttcaaagaaacatattcagaagtcaaacaatttgatattcaatggtttcttaaaatatcccttggaaacatttcaaggtaaagccaatattacatattttaattgatttttaccattaatctttttcttaaggcaatataccataaccataatagtaactttgagaatgaggtttatttttttaaatacgattcctttaaaataggctaattttattattgcttttacaaaacaaatgttaaatattttttaaaatatcaagaaatcaagaaatgctattttctccagctttagtgaggtctgattaaccaaaattgtatatatttagtgtgtaaaatgtgatgtgttaatatatatatagtgaaataattaccacaatcaagctaatcagcatatccattacctaacatagttaccatttttgtgtgtaaaatacttttctttttaatgagagcttttttgagacttttctttgttcttgaatataagccaaggtactttttatatcctgagcaagccatcctttgatttttgccacttaaatggtgtgcagctatttcaagattttcaacaatattattgtaacaacttagtatcatttttcacaaaatctaattttaatttatgtataatagaaatatgtaatattttatttttaaatatagctttttaaaactcaaaggc

SEQ ID NO: 479578 - DNA, 1776 bp, Homo sapiens
agaaaaccaattaggaaaggggatgataaaaatgcaataccggagtggctggcaagatggccgaataggaacagctctggtctgcagctcccagtgagatcaacgcagaaggcaggtgatttctgcatttccaactgaggttcccagctcatctcattgggactggttagacagtgggtgcagcccatggagggtgagccaaagcagggtggggtgtcgcatcacctgggaagcacaaggggtgggggaactccctcccctagccaagggaagctgtgagggactgtgcagtgaggaatgctgcattccggcccagatactatgcttttcccacggtctttgcaacccacagaccaggagattccctcaggaacctacaccaccagagccctgggtttcaagcacaaaactgggcggccatttgggcagacatggagctagctgcaggagttttttttcataccccagtggtgcctggaatgccagtgagacagaaccgttcactcccctggaaagggggctgaaaccagggactcaagtggtctagttcagtggattccacccccacagagcccagcaagttaagatccactggcttgaaattcttgctgccagcacagcagtctgaagtcgacctgggacgctcaagcttggtgcggggaggggcgtctgccattactgaggcttgagtaggtggtttttccctcaaagtgtgaacaaagccaccgggaagtttgaactgggtggagcccaccgcagcttggcaaagccagtgtagccagactgcctctctagattcctcctctctgagcagggcatctctgaaagaaagtcaggggcttatagataaaactcccatctccctgggacacagcaagcgggagaaggggcggctgtgggcacagcttcagtggacttaaaggttcctgcctgctggttctgaagacagcaacggatctcccagcgcagcactcgagctctgctaagggacagactgcctcctcaagtgggaccctgaccctcatgcctcctgactgggagacacctcctagcaggggtcgacagacacctcatacaggaaagctccggctggcatctggtaggcgcccctctgggataaagcttccagaggaaggaataggcagcagtctttgctgttctgcagcctccactgatgatacccaggcaaacaggctttggagtggacctccagcaaactccagcagacctgcagcagagaggcctgactgttagaaggaaaactaacaaacacaaaggaataggggcaacatcaacaaaaaggatgtccatacaaaccccatccaaaagtcaccagcatcaaagaccaaagatagataaatccacaaagataaggaaaaaccagagcaaaaaggctgaaaattctgaaaaccagaatacctcttctcctccaaaggatcacaactccttgccagcaagggaacaaaactggacagagaatgagtttgataaattgacagaagtaggcttcagaaggtgggtaataataaattcctctgaactaaaggagcatgttctaacccaatacaaggaagctaagaaccttgaaaaaaggttagaggaattgctaactagaataaccagtttagagaaggacataaatgacccgatggaactgaaaaacacagcacaagaactttgtgaagcttacacaagtatcaatagcctaatcaatcaagtggaaggatgtcagagattgaagatcaacttaatggaataaagtgtgaagacaagatt

SEQ ID NO: 479579 - DNA, 1135 bp, Homo sapiens
ctcccacagtgcagcggcgggctgaagggctcctcaagtgccgccggagtgggcgcccaggcagaggaggcgcccagagcgagcgaggactgcgaggacttgccagcacgctgtcacctctcacttccaggtgcatatgggcattgggacccaatgctgccccactggtatgcatgtgcttatggtgccccacctctgcatacctgcccgtgacttctctgctgccctgtagatgtgcacttacctgcagcttccccgcccacaacccctgccacctgtggccacccccctatcccctgccaccttgcttgtgtgcacttgtccatggccaccctgccgcagtgcactctcccgtggacactctgctgccctgccagagcgcattttcaggcagtccccatcagactgtcattaccagagactggaaacacctcagcccctccagcacgagcatgcagcccaggagtactgagctgagtcttggtcccctgaaagaatccagaaacaaagccaatctactaaacctaacttatgctacaattaaacccacaagggcatcaaataatgtgaaaacaaaactccccatcgaaagatcaggaacttgaaatattataaaatagttttctaattctgtgaaaaatgacattggtagtttgaaaagaatagtcttaaatttatagattgcttagggcagaatgactattttaatgatattgattcttcttaaatatgaacatggaatgtttgcccatttctttgtgttgtctgtgacttctttcagcagtgttttgtagctctccttgtagatatttgtcatcttcttgctctgacctttagtgagactgttgtacagttctcaagtaagataaataagaaatctcttgaatcttttctgttcgcaaatggtgctcagttctggggtttgagttatatttgattccaggcctgggcataatagagaaaaaaagcaaatataggaaactcatcattgaatcagcattactttgagttccagtttcctaaatgaacctgcttgctacaattacttttcagagtatttcattagctatttcatcaatttggtactttttattgcatttagttgaagaacagggttgaatacacatatttcatt

SEQ ID NO: 479580 - DNA, 741 bp, Homo sapiens
gtttaaggttatctcccttgttccctgaacattgctaattactaatagtgacccccgttttagcatgcaggaagccctggttatttcctcctttgttttctctcctcagaggcagtctccttcacagggcaagctaaatgagaaaacagtaaaaagtgaatggtctactgcaaacctattacaatggctaaaatctggaacactgacaacatcaaatgttgatgaggttaaggagcaacaagaactctcatttattgctgaagagtttggagggtttggaagaagacaggaagatgagggaaagtttggaatttcatacagactggtaaatggttgtgaccaaactgcggatagaaatatggacagtgaaggtaatgctgatgaggtcccagatggaaatgaggaagctattggagtaaagaatggtagaatcagcagcagcgttcagcctcagcatggaaaacctgtaggcatcagagtccaacccatgagagcagccatgtgggctatgtccagcaaatccacgacgtaatgttgtccatttgaaaaaacagccttgatacttaaagcaattcatttttcatcaattctttaacacattcaacaagttctcttaatcaatggactacatcaataatacttttttttcattgcatataatgttattgctagagagatactgaaaatgatgaagaataaataagtaggctttgctcagcagctaatcttaaaagccgacac

SEQ ID NO: 479581 - DNA, 678 bp, Homo sapiens
actgtgctgatgcagttccttctgcaaaaatatcaaacgaaagaactgatcacaaaggcagacatgctggatattgtcatcaacgagtacaaggatgaatttcttgagatcttcaagagagcttctgagtgcatggagctggtctttgctgttgatgtgaaggaggttgatcccaccagccacagttactcccttgtcaacaaactgggcctcacctatgatgcaaggctcagtggtgatgaggacatgcctaagattggcctcctgattatcaccccgagtgtgatcttcatgaagggcaactgtgcctctgaggaggagatctgggaagtgctgaatatggtgaacttatattccaaggggagatacttaatctttggtgagccaaggaagtctatcaccaaagatctggtgcaggaaaagtacttggagtactgccaggtgcccaacagtgatcctccatgctatgaattcctgtgggcttatttaagaatgtataagacataaatcttaataaatcagaccctgtgtacattggttcatttatttcccaaacattaagtgaacatgtcttttttgtaaagcactttactggggatgctaagagaagcaagatgcactacctgcccatagaactttagagtgcaagagcagcagtcatatgaagatgatggtgag

SEQ ID NO: 479582 - DNA, 824 bp, Homo sapiens
ggcaacagctttgaagcagagagcacccacttaaagcagcagtctggccacgttttggtaaagcagctgtgctatgctggaggatcccttctacccctggttggcttggactctccaaaacctgaaggctggaatgggtaaggtgcccaaacagcaaagatggcaacccacccctcctactgggatctccttcctagggaagttcaatgccactaccagtggaattccaagccagtgggtcttatcttgtgaggtgtttcggaatttccaatactctcatgaaaatggagaagtggggttgtcttggatgagagcaagcttggatttaatttcgttggttcttagtggacaggtcattgaagaaaaaaaggttgggtggtggtgtgaatatcaccaggtaggtagttaccagaatacatcacattcctttactgaatcattttctataaagaatgaatgcatgggcttcaaatgctgaggtgattcctatgatgatactgtgcacttgaagatggaagacaaactgaaaggtcatgggaaaaatccgggccagctttaggaagctgatttacatttttagctcaggtcctgggaaagtacagagcctcttagttatcattattatgtttttaaacacagaaaactcagggacatatagttaatgaaaatttttttatggtaatgaatattgttatcaatgtgtcttggaaaatgaattgataatgtctaaaatataaatgaatttctctcttttgaaaataaagttgacctttgaaccatacagatttgaactgtgtgagtccacttacacacagattttttta

SEQ ID NO: 479583 - DNA, 568 bp, Homo sapiens
gaggttcatttgttattttcttagtgacctacagaaatcaattttgatccttccggaacccatctcagaagcaacatctcttttaagctgatgttggggcttctgcactctcataattcggcaagtgggagggggtgttacagcttttttactcctgtggtttggcaagttccaagtccttgtctcatgatcaagagtaatgagatacatggacaccagagagtcatggagatagagccagcaatgaatggaattagtggccttataaaaggggcccagagagatcctcacccttctacatatggatacagcagaagatgcatctatgaacagaagtgggcctcacagacatcaacctactggtgcctgatgttgactctcatctcagaaggacttctcaatcttcagaaaccagtgattcccaacatttttgacaccagggaccggttttgtgagagacaacattttcacggacatgtgggaaaatggtttcaggatgaaactgttccacctcagatcatcaagcattagttagagtctcataaagagaacacagtctagattcctc

SEQ ID NO: 479584 - DNA, 675 bp, Homo sapiens
tgttcttatgatcaggtgatccctaccctatgattcaaccttgttcttctctggcacacaccccttcctccacctgcattccttctcataaagccccccttgctatccagtctctatcctattcacccaaaataatgtctttctggcctctccctgttttcttaacagatgcaggagacaccaaacagggacttagcccccgaaccgagtttgaaaaagatgaaaacaactccatcaatccagtccaagaggaggaggacgaaggcctagactcagctgaaggatcttcaaagcaggatgaagacctagacttacctgaaggcctagactcagctgaaggatcttcaaagcaggatgaagacctagacttacctgaaggatcttcaaagcagaatgaagacctaggcttacctgaaggatcttcaaagcaggatgaagacctagacttacctgaaggatcttcacaggaggataaagacgtagaattacctgaaggatcttcacaggaggatgaagacctagagaaaaagcgatcatctaggtcaagaaatgaaatcgaaatttcagaaattacagaaattctccaaggaaggagccagataaataaatattctgatttcattttcctccttctccagtgatctgcagggacctaccattcactaaaactaaccc

SEQ ID NO: 479585 - DNA, 517 bp, Homo sapiens
tcaacccattctgacaggccccaatgtgtgttgttcctccccatgtgtccatgtgttcttgtcattcagggttgttacatagaagtctactgaatgtgtggagccctcatggaggacctctactaggacagcgtggaggggaaatgtggagttggagcctccacagagtctccacttgggcactgcctagtggagctgtgagaagacagccactgtcctccagaccccagaataataaatccactgacagcttgtgctgttcacttgcaaaaggcacaggcacttatcgaccacccttgagagcagccacagggactgacccatgcaaagccacaagagtggagctgcccaaagtcttgggatcccaccccttgcatcttgtggtgaaggctgccaagcctagaactcaccctcagggaagtgggcttccctgtgtcacagggtaggtccagaaatgctgtccaagagagactgacctaaggtattcttatttatctaaatattttgatgttaggac

SEQ ID NO: 479586 - DNA, 2743 bp, Homo sapiens
ggaaaagacacctctatagaggcagaaaccattttgatattaggctaatgcttacttcagagaatatgctaacagtaggccaccaatctctccagacttgcaagatttctgatgagaagtatgctgttaacctgatgactttcccttttaacgaggacccaaatgttactcaccaagaaaatgggaaaaatgtctccagggcatgtctcagaccttcatggcagtccctcccatcacagccccagaggcctaggagagataaatggttttgtgggccaggtccagggccaccctgctgtctgcagcctctggccttggtgccctgcattcaagctgctccagctatggctaaaaggggccaaggtacagctcaggctattgcatcagagggtgcaagccccaagccttggcagcttccacgttgtgttgagcctgtgggtgcacagaagtcaagaattgagataagaccctggactgtggacttatgagtcaatgctgaaatgagttaagactttggggtactgttgggaatgcatgattggttttgatatttttcatagttcattgttcgtgtataaaaacacaacttacttttgtattgtgattttgtatcctgaaactttagtgaattaatttcctagttctaacagttttaggtagagtctttagggttttctacacataagattatgatatctgcaacagagacaatttaacttctttcttttctattttggtgccatttttgtttaattgctgtggctgggacttctagtactatgttgaatagaagtagcaaaagtggttcagagatagatttttaacatctatatgtgatatttattcacaggaacaatagcatattcatctctcctaaattcagacactggacttcttagtgttggctatagaaagatattattgttgactatatttaaaatagaatttatcaataaatacctaaaatgtattaacattttgttaattgctattaagagctgctgaaatgccataacttatattgtgtctagctgttttcaacgtaattttgctttaattatatttttttaattgttcagacaattgtggtaatagcatgtgtgtaattttatttactgtatttttcacataacatgcattccttatagttttaaatattctatatgaattaatttaatagctacaaaatattctgaaatttatcttagctattttccagttgttaaaaacttggattttttcctcatattcttgaatataatatttctgtaatgaagatatttacgtttaaagttttgttccatatttgggaatactttcttagtataaatacatagaattaaaacgaatggatttgcaacttcaggtcttgtggaaagcgtatgccaagaaggagttagaaatgcaagagatttattgagaaaaatacttgtgaaatcatagagggcacagaagtaggcagggagagatccagatcacaatgtacataagacacttgtgaaagagaggaaaagaaaagtaattattatgaaagattctcaaactgtcatgaagcttggagaaagtcttcactagcccaaaagaaaggagctctggttattgtacattaagtgtcccatgttctgcagaaatgcctaagctttggtagccctaccatgctcagtcagctgccagggaagagcatggctttggaggaaatgttgcaacaaataatgaaggtactgtatctagtgagtgtcagctaattgcattcctccagctgagctgcaagtgatttcttgactctccacagctattccagcaaatatggacatttttaacaataatgtagtatcaagttattttctgaaaggtctataaaaatttacactctactacccatgttctgtcaccagcttttactgccattattggtagtaattattagaactttgaaagttaaaattgctattcaactgttactttcgtttgtattttttgattagtaatgatgtgatttttcccattggtttgttaaccagttattgttcctttctgttaatttattcctaacggagactgaatattattatatatttatatatggtacaaatagttttcttattgtttgcttttactttttaattattttaattcgttaaagctataccttttaatttttagcgatttttgcctgtcacattaatatgtgaaaatactccatagatttgaaaaccatttctttatcttttttctatttattaaattcttatgtcagaatgctatataagaatttatattgatgtgctatgacaatgtaaatttaatgtatcctaaattgacaatgttcttaatatcaattactgaataaactttactttctctactgattttttataatagcatcaataattttagattcccatgaaaatccattatccatatcttgaaaccacaatgggtgtcaccgatatttacacctatgcagtatggctacggacaattgtatttcactatttaatttgtatggtcctgcctgctagtgactctaagcatcttttcatttacttcttcattcattccagaaatatttattaactcagcaaaaacgaaattgacaacgatcccttgatttttgtatagaatagttatatttattaaccagtttgtctcttatgaattaatcattcacatatttgaaattgttctctactttttttcattttttccatttgttggattttctttgtattctagaaacatc

SEQ ID NO: 479587 - DNA, 1162 bp, Homo sapiens
gccggcttcacaattgtaaaaggatataatgagtcatggaaatgtaaatttttgcctggggttaaaggattgtattaaattagataagaaaaacctgaaggttcaaagaagtggtggaagaattgtggaaattaatcttgcggaagaggttctctgtgtgaacttattgactaaattcaaaaaagggcattctatggtttttctcattcgacttaacaataaggagtccacgcaacccccaccaccagacacatttttgtcccagactcagttccaagcttcgagtcaaagccctagaaaagaaaactggatcggagggatccagaggcaaatgacaaaagtggttaaaaggcacagcaaaggccctttgtgcttcctggatgcaagccactttagcactcatggcggaacctgccaaggttactgggactcagagatgcaaggatggaagagaaagggtacactcaccagcagtcttgccacgggagtataccgaacaaaggagacagggtcatttataacctgacacgtctaccctactgctgtgtccggtttccgttggctggaacgggacctcacattctgtatttgtccagattggctagcaacttagagcttttaaaaagaggcaaaggcagaggacaccaaaggaaggaggaagtaacttgtggaatgctgagaaaggttcccttgatcaacctagccaatgatttttttgtgtgcacaagaaaaaataaaacaaaggcgtagaacacaaaactacttgcaaatttccaaaagctaaattttacaccccttgcaatactgccatttactactggtttctttctgacccagtcagaagatttcataatctacttgaggatatagaaaaatataaggcaatcacaataaattctattactttgctattaaaatatttaagaaattttgcgattgcagagagaaagaaatatctagtgtgggtggggtggtaagataagggttttggggaagagaaaatatttgaattatgttctgagacatgcaaatgttcccttgggctaggagtaggggtaagcatgtggaatgagaaagatttccaggaagatggatcagcatataaaaaggtacaaaaccatagacaggtctgacacatttgactagatcagacagaagaaat

SEQ ID NO: 479588 - DNA, 564 bp, Homo sapiens
ccctgagcgaacatagatcctctggtttacacatgagaaagctgagacacagcaagatgaagctcttcgaccaaagtcacgtagctatatgtatgctctcaggtgcacagtgcaagctgttcggggatctaccattctggggtctggaggatagtggccttcttctcacagctccaccgggcagtgcccccgtagggactctgtgtaggggctccaatcccacatttcccttccacactgccctagcagatttcaaagttccacaaatctctaaggtcggggcaaaacgccaccagtctctttgccaaaatataaaaagagtcacctttgctccagttcttaataagttcctcatctccatccgagaacatctcaacctggatttcattgtccatatcattatcagcattttggtgaaagccattcaacaagtctttaggaagttccaaactttcccacattttcctgtcttctgagccctccaaactttctaacttctgcctgttacccagttccaaagttgcttccacatttttgaggatcttttcagcagcgccccactct

SEQ ID NO: 479589 - DNA, 753 bp, Homo sapiens
ggagcccaaagttgtaaaagctcatggcagatgtgtggatccctggggactctcactcaatcatcatttctacagagtggggccttcatctttctcccgtgctggatgcatcctgccctcaaacatcagactccaagtttttcggctttctgactcttggacttacaactgtggtttgccaggggctctcaggccttcagccacagactgaaggctgcactgtcagcttccctacttttgaggttttgggacttgggctgagccactactggcttcctatctcttcaacttgcagatgttctatcatgggagttcaccttgtgatcttaggtgaagagaaggaagtgtgtttccggagatcaataacagctggattcctggagagaaggccagctagcaggacttgtaagtgtggaggaatgcaactacctccagagaagcagtacagaagaagttttagtttcaagtctttcatctaccttgatatgactcctgtacaaggtgagatacagggacccagtttcgttctttcacatgtggcctgccagttttcccagcaccatttataaaacaggtttcccctccccagtgtattttttgtatacttttttgaagatctggctgttggttttcacctttctctggtatctccttgagtaacttaagagttgaccttctgaattccttatctgatattccaattatttcatcttggtttggatccattgctggaaagctagtgtgatcttttga

SEQ ID NO: 479590 - DNA, 558 bp, Homo sapiens
ggacctgggcgccaccatgttggtacagtcgaggatcctttctccatccttgacctttgggagtttggttgttaaatgccttgagaagatttcattcagctatttttgtataatagaaaagagctcccctcacccttctcatgagatggaaggagttagaggacaaaaattcttgacaaaagaacctaggaaaatattaaacttcagtagaatccttagtagaggagtagccttgaaagacatgaaagacaaccgcctctgggctgtctttcatggaggaggcctggagagtgcaagtgcaaaaactgcagtagtcttggtgccgatcgtaacatcaggagaggtatttttcactcttatcatgggaagaaggagtagtgaaagaggacatgcttatgttgttctgggttgcaagggtaatgattctagtttttcccagtcagtatgatgttggctgtgaagttgtcatagatgactcttatcgttttaaggtacgtttttcagcctgctgttagcttgatgtggttacctttgtaggtgaccggccccttctgtata

SEQ ID NO: 479591 - DNA, 1273 bp, Homo sapiens
tctgctgcaggggcagagccctcatagagaaactttactaggacaatgtggaggaaaaatgtggatttggagcccccacacagagtctccactggggcactgcatagtggagctatgagaactagagggccaccatcctccagaccccagaatggtagatcaaccaacagcttgcaccatgcacctggaaaagctgcaagcactcaatgtcagcccttgaaaacagctgcaggggctgtaccctccaaagcctcagggatggagttgcacaagtcctttggcacccccgccccttgcaccactgcagcctggaagcaagaaatggaggctctgggaggagcttggagtgctcaggggatgccccgctttggcactaagtgtgaaggcagggaatgtcccgctgaaagaagccagccctttgggatgaggggacaaggggaagaggtcaccaaaggctttccagaagtggtgacacctcagaagaagctgagagaaagaaggttctatgccaatggaagcaaagatgagagagggacagagcactggcagcactctgagtctgagtctctgattccaaatgtccctaaggcccagctgcccttgatcttcccaccttttcttagtagattaaattcctcaagggccttccgaggagccgagaatggcagtgtggaacatggccacagagagcatagcagccgccagactccaaatctaagactggcccaggttccagatgcaactcaaaagggccatttcgaagaaaagagtcctgtgttaagtaataatgggctagatggatttttatgtgataagagcaaacaaagagaaaaccattgttgcaatggccataattatggccaaacaaattacacacttcaagatgagaaaaggaacaaacgtgtgattcttgcaaatgagtttgtccccatttttatgagttatgatataggacaagaaggaattcagaatacaatgatgcaagatgctccatctgtttatggcttcgtttcttaccatatgctgccgccactcagcaaaaacgctggggaggtggaagcttggcatttgggaaagaagtatccttttcagttaaacaaggaggtggaggaaatgataagaaagaagttgaagttggctcattatgaaaaagcaaaaaatctgaacatcatctgtcactctcagtgaactccagcatcaaataaagcatcaagttctttcaaatgtgtctcctaaatatatcttggaatagttcacttctgatcacccttac

SEQ ID NO: 479592 - DNA, 702 bp, Homo sapiens
gcatgccctaccctcagtctaatgtctctgggcctagttcagcactacgacttgcttatgagttgcttctgtttgcatcactgtaaaggaatacctgaggctatgcaatttataaagaaaagtttaattggctcatgtttctgcaggttgtacaggaagtacagtgccagcatttgcttctggtttggcaagtatccagggacaagcgaggaaatctattcctcctctctgctcagcacacagggcccattcagtatcattcctttagactacggctgggcttcttgccctccaatccccgggctccaccagccctcgggaaatgacaggccctgggaatcagagagacagtgcccttcctcatcacgctcagctgccctactccccccaacaggatgtgggcagcctgcatctccgctggactggagccaaaatgccaaagcacagcaccttcgagttccatgcctccagaagggcttgtccctgcgcactgggatggtgcttgtttgcaagattcttcaatgtattcggcattgaactcttttcccatacctctgataatagctctattgaaatgacttgaataaatgctatagtaattaatctaggaggggtaggagggatccagaaagtgtagtgtgatggagaaggcctggtttggggtcagctttgtacattactaaccatgtgaatggacaagtt

SEQ ID NO: 479593 - DNA, 676 bp, Homo sapiens
gccattctaactggtgtaagatggcatcttattctgcaggtctgttggagtttgctggaggtccactccagaccctgtctgcctcggtatcaccagtggaggctgcagaacagcaaatatcacagaacggcaaatgttgctacctgatccttcctctggaagcttcgtctcagaggggcacctggctgtatgaggtgtcagtcagcccctactgggagatctcagactctgtgctggaagaaccactgctctcttcaaagctgtcagacagggatgctgaagtctgcataagtttctgctgccttttgttcagctatgccctgcccccagaggtggagtctacagaggcaggcaggcctcagcaaaccttctggaaagattatagccagttgacaagttccagctgtgatgtctttggtccctattgcagcatttttgcccaaggtggtagccattgacgatgtgtgagtgagacacagtttagaaaaacaccttttcagcttcagtgtacaggatggattggatgcagggacatccatgaaaagacaaccataaatacatagttatccctgaccacaggaatgtagccttacttttctgtatgtgtctggctttagttggcattaaaccctatctagaagatacaggatatctatgtgagtctgcttgggctgcc

SEQ ID NO: 479594 - DNA, 523 bp, Homo sapiens
gtttgacatcagtcttttaaaaaatggattccacatatgagggagatcaggtgttatttattgttcacaaatggttgttcaccagcccactgtttctgaggttcagcccattgagagcagcaaacaaaaacaaaaccttcaaatggcaaagggatttgagagaaaacagcagagctgatacaggaatggctgatggtgttaacccactgtgtatatgtccttgggatccctggaaggaccagaaatatttcagtgggcccagggttgctttagattctgaagcaacttcagggtttaaaggcatccctgaaatgggtctctaccagttggtggtcaaggtgcttgccacccatatatgccaatatgtgctttcaagtgcacctagaattatgaagtggttgctagtgaatgtgcatatgtctagcagtctgggctgaaaggaggataggaaggttgataatgtgaaagatagtgaataaacctgaattgtgtggttggtgtgtctacttaaagaaatatagta

SEQ ID NO: 479595 - DNA, 681 bp, Homo sapiens
tttttgggcccctggatgcaggtatggtgtggtcaatgatagttgcagtggtggaacaagccttttgctcccaagctatccacactggtatttatgatggctgtaatgggttatgcaagatagtcctgaggcctgcaagtggcatgtgcaggccatgtgaaggtgtgctgcagcttcactgctgggggcagcaggatccttgccgatgccttcccttgcactttagccctcgtggcacagtgagctgcgatggtggctgtgggtgtgaaatgtcaatggggctccaaagatgtggagatgcaggggctattgggcccccaggcaggatgcagtctggaggccattgcaagtgtggaggctgcgaaggccctgagctctgggagcccacactatttactggtgctcaaacaaagaaacaggtgaaggcacagagaaagcaaattgaggcttaaaaacaatccttaaaccttcaatgtgcactgtacaggtgttgttcagctgcagtcatgggttaatctttctgtaaatttaaaaaatttaatgttaataaagctaaatgcaattgcatatgttgtgtcttatattcctagtctcctcccttttgcttttgtatttgagtttttaaagtacaattagctctttccactattgcttgtctttgtgagttatatggaacacccg

SEQ ID NO: 479596 - DNA, 529 bp, Homo sapiens
atcaatttgcattgctacggtgaaattttaacaactcactaggaatttccttgtgggcaaaatatggcggaggcatgtagcttttcatcttgtagccatcttattgaggacccaaaagtgggaggcagacacgacaaagactgggagaaaatatttgcagaagacatatctgataaaggactgttatcaaaaatatatgaagaactcttaaaactcaataagaaaatgagcaacccaatgaaaagatgtgcaaaagatctgaatggacatatgcccaaagaagatatacagatggtaaatatgcatatgaaaagatgctcaacatatatgtcattagggaattgcaaaattaaaacaacaatgagataccactccacaccaattagaatggctaaaatccaaaacactgataacaccaatgtttgtgaagatgtagaacagaaactctttcatagctggtgggaatgcaaaatggtacagatactttggaagatagtttagcagtttcttacaaaactaaatatgcctt

SEQ ID NO: 479597 - DNA, 531 bp, Homo sapiens
tccaactcactagtaatcaaagaaaagcaaattagaacaataatgagattctttggcaaagatattttttattttttaataacacttaatgatgacaaagtagccaccaaacaagctgtcttaattgctgatagcagcatatgttggttaaaaacccttttagaaagcacctttgctaattcagctctccctccagagccctctagtcagccttggactttgaatgtgttccgccccccaaatctggcctgtgggaactcataccaggcacttctctgctccttctttgcaggtggtgcttggcaggagctggaaacactttcagccagaaactgctgcccatttctgttttatcctcctcgtctgccacaagttcaaattcttatactaaacattgagagaggtctaatgagagcaaacctaggcactatcctggcaaaaatgtaaacaggaatgtatggattaccaccccatgaatagtatatgatctcctgacccattgtgaatgattgacttcaatgagtcgatttc

SEQ ID NO: 479598 - DNA, 612 bp, Homo sapiens
tatgatactcactgttgaatagcattcactcttctttaaatgtttggtagaattcagcaatgaagccatcaggtcccaggcttttctttactggcagactttttattacaacttggatattgttactcattattgatgaatctcaatttttggccaccaccaccacaagcccacagggagtactgccagactaccgccatgttaccttaaggcccacagggcttttcaatctgcttgtgaatgctgcctggcctaggactcacccttcagggcacagcattcccttctggcctagggcaggtccaaaattgctatccaaaagccaagacctggaatctaggattccaagagtccacttggtgctctacctccctgtagccaagctgatgtctaagggcccaagggctcttcagttagcaagtgataaatctagacaggcctgggtacttcccttcaaagctgcaggttcccttctagtccagggtgtatctagaaatgcagtctaggagctagggcctggaaaggggaccttatgactctgaccagtagtgtcagtcttctgactttattcttcttcaatattgtgttggagaataaagaacacagaaataa

SEQ ID NO: 479599 - DNA, 1720 bp, Homo sapiens
tgctgtaagcagggacccgaggacctcttaatagcagttccttctgagagagaggggcacgctgatgcaaaggatgtgctcccatggccttgggcagctctgcccctgtggctttgcaacgtacagccctctatgcctcacgcccaacccattgctttcatgggctcgtgttgtgtctgcatcttttccaggtgcacagtgcaagctcttcatggatctaccattctgggttctcgaggatggtggcctgtttctcacagatccactagccagtgccccagtggggactctgtgtgggggctccaaccccacatttcccttctgctctgccctagcagaggttctccatgatggctccacccctgcagcaaacttctgcttagacatccaggtgaaaacaggaagctgcaccctccagctgagttcacacagaagcgagactgctggcctgcaagctctaggaggcatttcctgcctggctagcagcagcaggggtaaggtcacctaccctggtgtctgggtgcttcctgggacaacaggcaactgtgagcactggctgagttcacattgtaggaggactacggtgcctgagtgcatgtggggccatgtgctctgtgttctgggtatttccctggacaacaggaagctgtacactttcgctgaattcacacagaagcaggaccactgagctagaagctctagcaggcattgccctcctggttcccagtggtgggggcaggtggcgttagtaatatcaaactgaagttaaactctagtgcagctctgaagtcttctccagctttgtaatatatttatgtaatatttattgagtgtctgctaggtgctaggtagtgtaataagtcttttacacatattaactcatgtaatcttcacattagccctgtgaagtagggattattattattaaatccattttgcagaggaagaaaccgaagctcagagatgttaagtaacttgctgacattcatggagctagtgtgtagcagaattaggacatgattccaagcctgttttgatttctaagtttgtgcttccaatcattttaagtctttcaaaaagcttttcctcatcctccctgccgccatttcaataacttctaaaagaacacccaagatatagcaccaaatcagaaatggaatagtaataatgatgctttggcttaaatgctttgaatgctgtctctttagcaatggacaaatggccttcgagcatggattggaataggaactttggagtcccccgacacttagatttagatctcagctctacctcttctttatctgttagtttctttatctataaattgaatataataatagctaccccaatagggtgattgtgaaatataaatgggttaatacatgtaaagcacttagaactgtccctggtccatagatagagctatgtgacaagattctgttatgaagctataagataaatttagatactgtgttgtttccttgcctcagagggtgaagaggaggcttatctaggtcaaagggagcactggaatggcaatactgttaggaaaaaactgttactcacttgtgcccgttgaagcaacatcggagtagtatttgcagttatctcttgtcactgctggacttgggcagatttattaactgatcaagtttgcattgtggtagtatccccttcatctaccctcctcagacactttgtacagttgttttctcttcca

SEQ ID NO: 479600 - DNA, 1534 bp, Homo sapiens
ccttctgctactcctacgtgcaaaggctcgagttaactcagaaaaagttctcacagctggacaacttcagaagcagggaaaaccaatttacaaattcatcagtcaaccctcatcatgagtatgtttaaattaaagacacctgccttcattcatctatacgtgaatttccacaactatatgtggattttagaatgccacattttgctttgcctaggttcagatcagaatgaaggatttcattgccgggaagaatgccggattcttggccactctgacaggtgctggatgccccggaaccccatgcccatccgttccaagtcccctgagcatgtgaggaacatcatcgcgctgtctattgaagctactgctgctgatgtcgaggcttatgacgactgcggccccaccaaacggactttcgcaacctttgggaaagatgtcagcgaccacccggctgaggagaggcctaccctgaaaggcaagaggactgtcgatgtgaccatctgcagccccaaggtcaacagcgttatccgggaggcaggcaatggctgtgaggcgattagccctgtcacctcccccctccacctcaagagctctctgcccaccaagccttccgtgtcttacaccattgccctggctcccccagcccgtgatctggagcagtatgtcaacaatgtcaacaatggccctactcgtccctctgaagctgagccccgtggagctgatagcgagaaagtcatgcatgaggtcagccccattctgaaggaaggtcgcaacaaagagtcccctggtgtgaagcgtctgaaggatatcgttctctaaaccagtctccaggaagaagagaaagaaaccacactggctagtgaagaagcaggagcttcttgttttaattgctcaccaatggaatacacagagagaaggcctagaggttagagcactagaatgcaaaagaggatttattttcttaagtttaggtagataagtcagctcttttgaatgttttacttatttttgcctgagttcctagctttacgcattactaggaatattttcttttacaggagggagaagggttttgagggagggggtggtgaggggaatgagcctgatgacactattactgtttacctgtcaaaccagggtggaaatttagagggatgcaagtacagtatgtctcattaagcagtctctgttgctgattatatgaagataaaattgttgtatatgctgatctgtatgttatgtacattttcacagtgattgaatcattgtaaaaagaaaaaagacaaaaaagaatcaccactgtctattttatgaagatgataaagcagctttattaaattattacagttatgtttcaaatggtgttatctgccacattgtttccttttatctggtggttctctgtttccccctttaaatgtgttttctctgcttcaaaaatttaatgcattttagtattaaaggctattatggaaaaagtattgagtgtttggtggaatgtgtttcagagagtgtttgtaggctcgcgggaagc

SEQ ID NO: 479601 - DNA, 1785 bp, Homo sapiens
gggagtgctagtgatttcctgtttgcaagatggcaagatgcagcatgccatcttgcaatttacatggcaaaaataatatggatattggctgtggagttactatggaggagcctccactggcctcagcatcagaaatgctttcccctttgggtgggctgcactgggatagggatgttcctgagtctactgggcttgggcatattgtacatgaatttaagaaaagaatgtcttcctcacttttgcctgactcaggaggactgaagaaccgccttctacaatgtggagggtcgccatgtgggaaagtgagtagacattctttggagctgcagagggcagatataagactaatggcagaagttacgaagaggaagacttggtttggcaaaggaaccaatcagagctgctcagaaaaaaaaatgggctgcctagtcaggtgatgaatgacctttgtgtccctgaaagtgtttaaatagagctcgtatggtgttaaagaagtaacatttattgaacacctaatatgtgttgtgtgctttacacatgtgatcttattcaatttgtgaaacaatcccatgaagtagatcgtctcatctatacttttacaactgaaaaactgagggttacgagattaagtaacttacccaagaccaaaccataagtatcccagcaacttatgtcaggggtagtggaggtaagagctccatggaggaggtagattttgtgttagggtctggtggggatccccttatgctccaaggcaatgaacttttcctgattgggagaaactatctaaaatgagagctatccacctatttattcattcattcagtgaatatttactgaactctcatcatatcctcaacactgttcaatgggctagggatgtagtagagaatatgacagttatggtaactgcccttgtgaagcttatagtctggttggctgactctaaaatctatttcataacttttacactgtattgccagagaaggttaaatttcccaatcataaatttactattttggcagctttcttacctatggaagttcaagtacagttatattcaattgaataaatatttatttcctaggcactgtgctaggcactgagatataatagtgaaaaaggaacacattgtctctgctttactgaactcacagcttaaaatggatgattaggcaagcaaattagcaatgataatacagtgtgatataaaatgtgctctgacagggatagtatatagcattctggttacataaagcagtattaacaaacccaaagttgtggggagggggtggtcagggaaagcttttggtcaaagtgacattttaaatgagatcagaaaggtgagtaaatcaagtcccagggataggtatgttatctaagatcccacaactagcaagtggtagaactggagaatttccaggtttatctgatgttaaaacccatattgcaaccataatgctgtctttttaccaccaaatcccagcagaaggagttcttgagatgatgtggaaccttctttcagtcagtaggtcaagggtactgctgaaagtgattattccctttctctgccccaatagagccaaggcagcatgtcacactagcaagggcacaggctttgcattcaaacagatctggtccaatctttgcggtataacttagaagctgtgtgagcttgggtaagttacttaacctttctgactgtcagttgccaaatctacaaaattaagatcataatgtctactttgcatggttgttgtaaggattaaatgcagcaagataagc

SEQ ID NO: 479602 - DNA, 636 bp, Homo sapiens
ggaaagttacttacaagttgctgaaacttacaagttccctttctcaggggagccctaagattttctgtgaagctgctgatgggctgcaacttgctctctgccccatctatgccccttttactgaatgtacaaggtcactttgtgacagattttgacttggtagcagcccaacctggaaggtttgtcaaagatcagatagttgtagacaaaataggtttcaagacaaaaactataagaagaaacaaacaaggtcactatataatgataaaggggtcaattcagcaagatgatataacaattttaaatatatatgcaccaaacactggagcacaaaggtgtattaaggaaatactatcagagctaaagaaagagataggccccaagacaataataactggagacttcaacaccctactttcaacattgggcagaacatctagagagaaaatcaacaaagaaacatcagacttaatctgcactatttaccacgtggatctaatagatatttacagaacatttcatccaagagctacagaatatacattcttttcctcaacacatggattattctcaaggatagaccatacgctatgtcacaaaacaagttctgaaacattcaaaaaattgaaataatat

SEQ ID NO: 479603 - DNA, 795 bp, Homo sapiens
ttcagccttcttcctaggggtatgtatgaacctctcaccttcctggggatcctgggtctgcagttaacagaagatgcctccatgagaggctggtggtcagccctggggtcagtaaccacaagaagccgtgggtcccagaaggctgcctggatctggttagcgacggacagttccaggagtgaagcagccagcaattggagtggctccagtggcagcagcaaacttcagcacggccctctggccagtattcctggaagatataacactgacatcagcagggttttcaatggcaacaatggcacgagctgccagcagaagcttctcccaggttcctgctgcaaggaacttaaggacatcctcctccttcatttgcaggatatcaagcgctccggacattgcgaaagtttccctttaagttacgatgggaatccagaacaacgccatatggacccctcttcaggcccctcttctgcacgtctgctggattttgctggaagtccactccagaccctgtttgtctgggtatcaccagcagaggctatagaacagcaaagattgctgcctgctccttcctctggaagcgtcatcccagaggggtacctgtctgatggcagatggagctctcctgtgtgaggtgtctgttgacctctcctgggaggtgtctcccagtcaggaggcacaggggtcagggacccacttaaggaggcagtctgtcccttagcagagcttgagcactgggctgggagatctgatggtcttcagaaccagcagagatattattcccagtgaggagga

SEQ ID NO: 479604 - DNA, 1278 bp, Homo sapiens
agacttccttttttatgaagttttggtcacgagttaatcagttcccaagatgagaataattggtgctgtcttggtgttacttgttcatcaattgtgtcatgattgtgactatagcttctcatggagaacatccgtctttggtcagtacgttaaaagcccccggtttcacagccccacaagccctctttgcaatgacctgggtccccttattttaaataatctacctgtaaagtgggttgcttggtccgaggctagcaagggcaattccactgcagaggaagtggcagagaggctttcagatgtccctggagactctgttcagggagttgatactggctcagtagctctggtggggggtgcctggaggccctacctgtcaggaccctcagctgcaggtctgttggagtttactggaggtccactccagaccctgtttgcctgggtatcagcagctgtggctgcagaacagtggatactggtgaaccgcaaatgcttctgcctgatcgttcctctggaagttttgtctcagaggagtgcccggccgtgtgaggtgtcagtccacccctactggggagggcctgccggttaggctacacgggggtttaactattgtctatttagaagagaaaaaccatatatgtgtacatatatatgtactgcatatgtatttcatatacatattcttattaaatattattttatgtatcacatcttgataaaagtaattttttttgttttctgttaagcatagtttccaatgtttaagacttcaagcttctgaacaaaatatcattcttcctcatgacatatgtatatggacaactcacatatatgtttcttaacagtaggatgtgcttaaatcattgttagagagttctttactgatcaatataaagtaggtcccattcctttctgccattctttatattttatccttgtttgcttatttcaaggtacttatcacaattttaaataactttattaactttctatgtactttatttgtcctccctctcacttccaccagaatgtaagctttatgaggcagggcttatgccagacatgttcactattgtattcttgtactcaaaacattgcttggtacatagttggagcctaataaatttcaataaaattaacaaaagttcttttaattcttaatgtactatgtcactgttccaatgagtctgtgagacatatgtatcccattttttctatttgttttattaacatgtaatagtcagagaagccaagtatcatacatgaccagtaaatcag

SEQ ID NO: 479605 - DNA, 1114 bp, Homo sapiens
tcaaagaggaggttgtgatttgggtgccagtggcaccagtgccaggagctgaagacggaacccggactgaggcacatcggctgcagtggcgagtgctggaggcaaggtgaggtgaactagagctgtccccaccgcccgaccgcccatagaggctgagctgtggccttctcagggctgagcggtgtggagcggcgtgggaaaagtgggtatggcagcgatttcccacccccaccccgtgcccccacccccgcaccaccgagctggaactagtcttggacaagatatgagacatgagtgttgaacatcagccagataagtgtgcaaagaagcacttcttatttctggtgattaagtacctcactccgcattttgccagaaggcaagtgattccggattcctgggtcagagaaaccaacgtgggaaaccaaagggtgatgtatctggcaacccctgttgggagtctgacacagtcaggaggcacaggatcagggacccgcttaatgaagtactctggctgcccctttgctgagggagtgcactgcactgggaggaatcccactcatctggactgcctggattcttcagtgcaaacagggaaacttggtagtcgtaggcagtttccagtggagtggctgctgcagagaatctgcacagctctgtgcttgggactgaaggccctggtggcatgggctcacaagggttatctcctgatctgtgggctgcacagattgatggataaagcatgatttcgaggtgaaggtgtttttctctggttttatgatttagtctattgctttttatttttatgtgtcttgcaaatgctattttataaccaattattttaagctgataacaacttaacactgtttgcataaacaaacacacagacacacaaaaagaaaactaatactctatgccttaaatttgtccccccactttttaactttgcattgtttctatttatatcttagtgtactgttgtgtcttgaaaagttattgtagttattattttttattggcttattgttaattctttcttcttaggataaaagtagtttacatactgcagttacagtgttataatagtctgtgtttttctgtgtacttactatta

SEQ ID NO: 479606 - DNA, 775 bp, Homo sapiens
atactactcaggtgatgggcgcaccaaaatctcacaaatcaccactaaaaaacttactcatgtttgcaacccacaacactggggagaggtggtgaggtgcagcagcttcagcagagtgctagcaggtgctggggtgcctgcctccctgtgggtgttcaccacagtgttggaggcaatgcagctgtgggggtcgtggggcccctacttgagactgtggttccaggggcccatggtgagagctggttggtccttgacagttcaactcactcgtactcctgaagctgttgtggttcaaaactcagagaagtttgatcgtctgaagcctttttctctcagctcatcaaagtcattctctgtccagctttgttacattgctggaccctcagctgcaggtctgttggagtttgctggaggtccactccagaccctgtttgcctgggtatcagcagcagaggctgcagaacagcgaatattgctgaacagcgattgttgctgcctgattgttcctctggaagtttcctctcagaggggtacccggccatgtgaggtgtcagtctgcccctgctggggagtgcctcccagttaggctactcgagggtcagaagataaactggtttacatatttaaatcacttgtgatgaattaataaagctcaagtgattttgaacacaacagatggtaagaataagtaaaataaaatattttttattcactatatgtacaatgtgtaatgcaatgttggcagtaagcaaatgtaaataatgaaaaaagaaac

SEQ ID NO: 479607 - DNA, 1216 bp, Homo sapiens
caccacttccctgggagcggaggttcctttggctccctgccactcccagaaaatcatgctgctcaccaatgaagacaaccctcatggcaatgacagtgttaaggcctgccaggccaggaccaaagccggtgatctacgagatataggcatcttccttgacttgatgcccctgaagaaacctgggggctttgacatatccttgaatccagttcactttgaggaatccagcaatctagaagacctgttgcagaaggttcgtgccaaggagaccaggaaatgggcactcagcaggttaaagctgaagctcaacaaagacatagtgatctctgtgggcatttacagtctcgtccagaaggctctcaagcctccttcaataaaactctatcggaaaacaaatgaaccagtgaaaaccaagtcccggaaatttaatattaataccggcagtttgcttctgcctagcgataccaagcggtctcagatctatgggagtcatcagattatactggagaaagaggaaacagaagagctaaaatggtttgatgaaccagctttgatgctcatggttttcaagcccttggtaatgctgaaggagcaccattacccgaggccctccttgttcacgtaccctgaggagtcgccggtgaatgggagttcaaccctgttcagtgctctgctcattaagtgtctggagaaggtggtcatagcattgtgcagatacacaccccgcaggaacatccccccttatttggtggctttggtgtcacaggaagaggagttggatgaccagaaaattcaggtgactactccaggtttccagctggtctttttaccctttgctgatgataaaaggaaggtgccctttactgaaaaagtcatggcaactccagagcaggtggacaacatgaaggctatcattcagaagctctgcttcacatacagaagtgacagctttgagaaccccgtgctgcagcagcacttcgggaacctggagcccttgatcttgtatttgatggaggaacaagcagtggaccttatattacccaaggttgaagaaatgaataaaagactgggctccatggtgaatgagtttaaggaacttgtctactcaccagattataatcctgaagggaaaattaccaagagaaaatgcaataatgaaggttccagaagcaaaaggcccaagcggagtattcagaagaggagctgaagacccaca

SEQ ID NO: 479608 - DNA, 1037 bp, Homo sapiens
agccatgatgtgctgcctgggtggagctgtgagaagaggccaccatcctccagacgctagaatgatagatccgccaacagcttgcactgtgcacctggaaatatggcagctccctggtgcttctccctcatcctacccttttaaaaatttcctgtgttgcccaagtgccaacttggaaaagcacctctttatcctggtgatgatgatgctgataaagataaggagatatgagaaaaagcttccacagttgctgtcttcccacttcatacaacttgggatagaggtcaaaaagggagtctttgaagcagtagaaaccttgggatcatccttgatttctctctttatcttagacttatcatcaaaaaacttttggctctgctttcaaatatatccagacactgactacttttcctctgcttcattgttacttcatggctccaatcaccatcttctcttcctggggctattgcaacaacctttgaactcatttccctgagttcaccctttgcccacttcagaaaatcttcaatgcagcacccgcaatgataaggttaaaacctaatacagattatgtcactgctctgttcttccaattagtattcagagtgaaactcaatgccctaaaaatggccaataaggctctatgtcttctttttctcttatttcatattctaataaatgctccccttttcactgccacttcagaaacactgactaaaatgctgacttacatgttgttttttagaggtttttggaaagtttcctttcactggcagcaataaggtacagttgtgattatttgacaatatctggagttattggcaagaaatgagagctgtaaagggaaatgaaaaagatacctatatttagtgaattatatcatgaatatcatcttaattgaaggaaacaaatattttagcataatataacatcaatataagtgattttgcatatgtaatatgtgttcttgacaaaggcatcaatcctaggtatatgtcaattttcagtcgtggctataataaagattaaagaatagc

SEQ ID NO: 479609 - DNA, 577 bp, Homo sapiens
tacaccatcaatgctaagccagtcaacatgcaaccctgcgttaatctccacctcctgttaacatttaccagcgagcactctagcctgaggtggtgtgtgaaactaagatcagattcaaggaatctccagaaaagtcaaaatgcacatccacagtattttaagaaaaagatccatattatcccgtggcaccaggaagccacacaagaactgcagcttgctgagctagggcatagagagtggcaggttcttcatgaaattccagaaggcattgttatcattggagatgacaactccatgtgtcctattgtccctgaagacctgccagtggaaaatgatgtggagatgaaagttggtgatattgatgatcctgaccctctgaatgctgctaaataccctaaaatgaacagaaaatttccacccaacaattacctagttgaaaatgaccataatgctgaggttgtaatactctgtctcagaatcatagggtaaaattctaggtatatatttcctgcatcattctacaactcttctgagtacgtggaaatccatgcccttgtatgctattttttttcattcc

SEQ ID NO: 479610 - DNA, 685 bp, Homo sapiens
acaagaaagaattcgaggtgaatccatctgcatatgttaaaccatccttgcaaccctggagtaaaactcacttgatcatggtgtattatcattttgatgagctgttggattccgttggtgcagggtgcaagctgaccttgattcaaccattccggagtctggaggacaatggccctcttctcacaactacagtaggcagtgccccaactttgcagactgtttttggcaagaaaagatcttctgtgggcggacacaagggtgccagccaggtggagtgtggtggttctggctctggtgaagggtccacagtggcaatgactgttagtcacttcagtggtacaatcttccagagttctctgctgagaaggccactggggtcatcactggcaaaaactaaggggaccactatcataaaaactgtggacagtctgtggctgccatcaggggctcttgaggttccccaaaacaaaagctgctggagtcagagtatgctactagaaaccacagtgatatctgttgtttagtttataatggtatgttaagttattttcatcatatttagttgtggtaaggacagaattgagtaaattggatcacttcattttgtgctggaatataaaatggatcattttaataaatttttgctgatattttccattatttttattttatttgtttaaaaagg

SEQ ID NO: 479611 - DNA, 467 bp, Homo sapiens
agtgggtgcagcacaccagcatggcacatgtacacgtatgggtgatagtcctggggccagtttcactgactcataagacaaagtattttattcttgactgtgggaagcttcaaaaagcacaaaaaggtgcatcactgaaacctgagagaactcacagacccactaaaggaagcagattggtcctgcaggacctgggagacaccccaaatactcagctgcagcaagacccacccaaggagagtctgagctcatacacgtctagctcggcccccaataatggtcctacccaccccgtaactaaagacaaaaggcatacgttcttgggagttctagggtcctgcccaccgcctgttcctccctatacaaccatagctgatactttctggaaagcgccacctcctggcaggaggccaaccagcacaaaaatagtgccttaaccaacaaagctaagaacttaagtccatttt

SEQ ID NO: 479612 - DNA, 2163 bp, Homo sapiens
aagccataatctttggtggctttcacatgatttcagagaatgtatggagatacctgggtgtccaggcagaagtctgcttcaggggcagaaccctcatgcagaacctctactagggcattgcagagggaaaatgtggggttggagcccccacattgcatccccactggggcactgcctaatggatctgtgagaagagggccactgtcctccagaccccagaatggtagaaccacagaaagcttgcaccatgcacctggaaaagttgcaggcacccaatgccagtctgtgaaaccagccaatgggtctgtatcctgcagagccacagtggggaagctgcccaagaccttggaagcccaccttttgcatcatcgtggcctggatgtgagacatgaagtcaaaggagattgttttaaatcttttagatttaataactgccctgctggattttaagttttcactgaaatcatctgtgttcagggactttctttaggggtggttataaattatgaatctaatttttatagtggttatagagctattcagattgtctatttttcttttttgcttgatatttggtgctttgtgtgttttaagcaattggttctttctaaattgctatattacttgtttaaaattatgaatacgtataagtatccctttatttttatcttaatgacacaagattttaatgatattctctatctaattttttgttattatatctatttgtgttttacaagataatttttctttcatataatgagctttttgtttttttttcaacttttattttagaatcagaggtacttcaatgctaagaatattagctctttttgttattgacctacagatcctgaagactctgttaatcatttcttcagtttattttctttctattgttcaaattggataaattcaattaatctctattcaagctcatcagttctatcttctactacctccgctctaccattgtgaccatactttgaggtttctgttttgttttggtttggttattatatttcaagttgtataattttctttttgttctgtcttacaacttttatttctgtgctagtattttctattttttcctatgggtttttaattgtttgtttaagtatttatatgatggctgcttgaaaaatttgtcagataattccaacatcaaattaatctactgtttacatttccatatgggatattttgccaaatgacaatgagtacggtaagttagacgtaaaaggtagtaaagaagtcaataggggtcttcttgaaatttttgacataatggtctatgagatgtagcacaacctttgtatacaagtagtgggggcttaatcactttcttactctcacaataatagcaataaacacttccaagctcttaaggagtagctttctcttctcttggaaagaaattgcatagtagagaaaacatgataagaggtgaacaggacttatagagggaggtgataaatagcaagaggcgacagatactacctgaacctttcttttatcatgtaatagaaaaatttcttgtatttatgtttgtattcttttatgtggctttgactcttgtttccttttttgattttattagaagaggtggactgaaaaaccaatggatgctgtcacaggcattagttaaaaacacaattgtaaaatatggcaacttgatatatactttttccattgctagggtcaatattctcatgaaaattaaaatgaagtatttaaaaataaattattttaaactttttaaagtttagtttacacttaaataaatataaaaacaaagatccaatcatattttaaattatttgttgggttttctttatttcattgccaatcagttgggttatgcaaaatagcctagaatgggcagtgtggtatttttattcatgtctataactgtcaaggttgtaaaaataggcgatttttagtaaaatcacaagctggagatggcaagttgatccaatagaatggaaacacactgtatatctgtgaagatactttgatttattgctcttagtcaagtttgaaagcatgacctcaagggaagtacgtccttaggtgtaagtacttcttgcaaaagattgatttagcatttacaattaaatatagttttaaaatgaattataagaaaggaatgtatcccat

SEQ ID NO: 479613 - DNA, 678 bp, Homo sapiens
tgattgtgaggcctccccaaccatgcataactgtgagtccattgcacccctttcttttgtacattgcccagtctcagctgtgactgaaagaggccaatgtacagcttgggctgcagcttcagggggtggatgctccaagccttggccacttacacatggtgttgagcctgcaggtgcacagaattcaagaattgagatttgggaaactccgcctagatttcagaagatgcatggaaatgactggatgcccaggcaaatgttctcctcatggagaatctctgctagggccgtgtggaagggaaatgtggggtcagagcccccacacagagtctctacttgggcactgcctagcggagctgtgagaagagggccactgtgctccagaccccagaatggtagacccactggcagtttgcactgtgttcctggaaaagccagaaacgttcaacaccagtctgtgaaagcagctgggaggaaggctgtaccctgcaaagccacaagggtggagcttcccaagatcatgggaacccaccttttgcatcagtgtgaccttgattatctaaagctgatgtactgtgctgccacagtagaacgtttatcatgatccagcccacagacatcttggttacactagtggttagcaaagtacttcatgatctttatgcctaaatgatgccc

SEQ ID NO: 479614 - DNA, 818 bp, Homo sapiens
tccccataaaccaacattctgtaagcatggggcagaagaaaaaaactgaaggaactagctcctcatccacttttaaattgaatagtgtctctaataaaagaaggttgatgaagctgtatcactcctacttctgctgctactgttactactactcctgctggagctactactattactattacattactattactgttgctgctgctgcttctaatactccactactactactactactactactacaagataatatcgcaataaaagacagacggaaagaaagaaagaaagaaagaaagaaagaaagaaagaaagaaagaaagaaagaaagaaagaaagaaagaaagaaagaaaggaaagaaggaaggagaaagaaagaaacaaagaaagaaaagaaagaaagagaaagaaagagagagaaagaaagattgatttagcctttaaaagaaaaaaaacatttaaaaaatacaacttgtttttacttgctaaagacattcttacaagtatagatctggacctaatttctataggttctcttactctcaggtatatatttttcccaaagtcagagagcagatctccaactactttataagcaaaattgtatgaagcaagacaacatatgttcagcaaatgctttagtacttgtggagagggagaaagtgtgcttctctcctggtaatttcaactatagttgaaaacttgctgtcttaccagatgtatgcttgaagaagggaacagtgcaagctttttgtcaactatatttcaactatagttgtaatggtttctaaatatatgatttaaaaattgttattgag

SEQ ID NO: 479615 - DNA, 786 bp, Homo sapiens
gaaaatcgtatattatacaagatggagaagtacttccaggatattatacagctgcaaattttaccctacaggcataaaagagttggtgattactcacaaacaccagtgttatattcaggctgtacagaaagcctagctctggcatcagctgctggggaggcctcaggaaatttacaatcatggcagaaggcaaagtgggagcaggtacttcacatagtgaaagcaggagcaagagagagagagagagtggggagtacttgccatacacatttaaatgaccaaatctcacaagaactcaatatcatgtcgacagcaccaagccatgagaggaatgcttccagcttttgcccattcaatgtggtattggcttataagggtggtaagggcagttccactgcagaaggagtggcagagaagctttcagttgcccctggaggctctgtccaggtagttgccaagttgctactggctcaacagctctggcagggcgtggctgcagaaagaggcaatgccactacccatggctggctgcagttccaagccagtggatcttattttattaggtcccatggaagtggggcctgcaggctgtcgctgctcagcttcctggattcagcctgttttctagggaaaccactgaacttattatattatattgcagttaagtaatatagagcagatcagaaagctcaaaagcaaatttgtacatgactgactttagtatatgttaaagttagcatttcaaattagtgcacaaaggaattgttattcattgggaaatttgac

SEQ ID NO: 479616 - DNA, 602 bp, Homo sapiens
aaccagtcccaatgagatgagccagtggttgcagccaagggtcttttgcttttctcctggggactgcactccagagaggtgtaggagagcaattgctcagtgcagtcagaccaggatggagaatctatgctgtgggcctaagccaggggttctctgcctggtaactaactgtggtggttgggggatgggtcagaccagtgggagatgcactggtctcctctccttgtgtaaaatgcagcttgttggagtggaagaacggaggaaggggtttcttttggagccacaagctgtgcagactgaggttaagggaaaggacttgcctatgagttgcagtctttatggcctagactgcctttcaagtatacttggagacacagacgttgtggccctggatgtcaaagtgtgtagcaagggcaccaaattaacaactatctacacagaaaaaccacctttgtcagaaccaaaaatcagttccccttgttaaagcctcaaaattataaagttaaagtttattattgacatcttatgtcaataataaacttggtctaaaacagcagatttgatgtactgattaatccctggttccttatttagttcatttc

SEQ ID NO: 479617 - DNA, 659 bp, Homo sapiens
tcttcacatcacagatattcttatatgcgataatgaatcttgacgaagactgcagtgctcaaaaggagatggtgctgtccagtagaaatgactcctctctgaacacacaaaaaagtggtaatgtatatcactgggaggtggaggaggcaaaacatagagaacatggaaagtatttctatcctgtcaggttagaaaatcaatgtgaagacaaccaagcacggagattggaccaagaaaatatccagaccagtgctttattagaggaaggagcactgaacctggctaccaggaaactcggttttgattccactttgctacaagttgccttgttctgctccttcttcatctgcaatatggacaacataatattggtaatatttctattgaccatgacttatgagaatcttaaaacacaaatatactcactttccactgaagggtttggcacctagtagggagatccttgaaacagtatccaattactcacaaatctcaacggagattgacattcatattaagaaaaaaacagaagataataaaaaaatatttttgtgtgtgatgttatgattataaaccctattaacttgagggttataagtttgtgtcctttgtcctttatcgggggaactcaccccttcgttcagggtccctgacttccc

SEQ ID NO: 479618 - DNA, 979 bp, Homo sapiens
gcagcttcatgcagccagacccagacaggtggcagacagcttgagctgggctctttatcatcaggtattagattatcataaggagtgtgcaacatagatgcctcgcacacgctgttcacaaaaggatttgagctcctgtgacaatctaaatccgtcatagatctgacaggaggcgttgctcagggagtaatgcccaatccccgctgctcacctcctgctgtgaggccgggtccctaaggggcacagaaatgctttctgaaccatgtcaccactgccggtgaataggaaaggcattggcaatttaagattgtttttcctaccccttcagtgcctctttcagtgatatgagagttatttaccgattacctacacaacaaaagtaccttcataaggaccaaaaatcaggtgcttttgttgtagacttattgaatggctttgaccaaaatgctggtagtgatatagacagcaaattccaggctgaggtggtctcagatagagatgaagaacttgtcaggaactggaataaagctcactcctgctatgcaaagggactggcagcattttgcccctgccctagagatctgtggaactttgaacttgagagagatgatttagggtatctggtagaagaaatttctaagcagaaaagcattaaagatgaagcagagcataaaaacttgaaaaatttgcagcctgacaatataatagaaaagaaaaacccactttccggagagaaattcaagcctgctgcagaaatttgcataagtaacaagaagccaaatgttaattgccaagacaatggggaaaatgtctccagggcaagtcaggggtcttcatggcagaccctcccattacaggcccagaggcctaggagggaaaaattgtttcatgggctggcccagggacccactgttctatgcagcctcaggacatgtcccggctacttcagcttcagttgtggctaaaaggggccaatgta

SEQ ID NO: 479619 - DNA, 812 bp, Homo sapiens
aggttaactttggaatgcccttcaccaagaggaggtgtctattcagatggtttctgggcttagaattttatctttggtttatacaagctatgtgggaggggccacagagctcccattccctctctggggtggccactcttccagaaccctcatgtgctcgtcagttgggaaggtctctgagctctgtccatttgagtttttgtagaagcttcattagcatggctggggaaggggaagcagtcatgtccttcttcacatggcagcagcaaggagaagtacagagtgaaggtggagaaaagccctttataaaaccattagatctttcaggaccctcagctgcaggtctgttggagttttctggtggtccactccagaccctgtttgcctgggtatcagcagcggaggctgcagaacagtgaatattgctgaacagcaaatgttgctgcctgattgttcctctggaagtttcatctcagaggggtacctggccgtgtgagggtttgagggttgaatttatctaaatttttaaggatgcatctcagaaggggtgaatcttggggtatggaagtctggttatccattttaaagagaagacaaaggagaactgtaggatgaaagaggtgtctccctgtccattcctacaatgacttatgaagacaaaatatttgatataagcacttattatctttaaacccattaatcagagctcttttatataaacatcatgaacacaacacatataaatacatagacaaacagaagatccagtagttgtaaaattttttatttgccagtttttaaatgtttcttaa

SEQ ID NO: 479620 - DNA, 1038 bp, Homo sapiens
cagccatgttgctcacacaaagccttgagtacacgggatcatgaatccaaaggaagatctgaaatctgaaaatcgggccagcatggaaagcacagaacaaatgaataagaagtgggaattcaggcagacgaaagttacattggagagtgaggatactggggtaaatagggttctgggtggaagagagagcatctacaaagacctgggacagagaaaaaattgcttgtccatggaattaaaagaatggcagtgtgtctggggtatagggaatgagggggagcttggaaagaggactaatcaaagaacatgttctctgaaaatgcagaaggaggtagactctagagcacttagaaaagaaggaaataacaagttgggatacaggctgccacagaaaagtaaacctctgctgacaaatagcaccattttaattgaagcaaaacatcgaaagaactaataaaagaaaaaaatctactttttattaataagtaagcaccatttattaaacaaaagatatttggacagattttctgacaggaaaattaatattgccaatgttacagaaacaatcacaagccctgtctcattcattaaataattagcaatagttaaaaaggcttttaaagggcaaaaataagatcaggtgaaaattgaaaatgacattttttttgtagaaaaagctttcaacaactgtggatttggtctaagggtatttgctaattgtgctgcgaattcaaccattagcatcactagcttttattcttatgtaggatcaggaacaccaagcaagctggaaatgatattcttttctacatgtaagcaaagccctaaagccatttccttaatccatctcctcctcatacttccaaaagacatttaccctgtacttgtttttaggactgccaaatgggatgttatactgatgcaatttgattgaagtgatgacaactacaagttgatagagtgaaacagtaatctttatcatcaagatatttgtaagagcattgttttaactaatgctgcaggtattttttcaatatc

SEQ ID NO: 479621 - DNA, 559 bp, Homo sapiens
gaaccactttggattttcccttctgctttgaatggaagggtatgcttttctttaaggagtcaagctcaacttgcagaactgataaaaccccgtggggagactgtcctcatacccttcccaatgctgtccctatacagggttttggacctgtgccacacatcagtggcattcccacatgcttctttatgaaactgcagctgagcttctacataaagggcatcaaaggcattcaggaaattgggaacactgaaccagtttttctccattttctttggtttggtaacagcagatccagaatcttaaagataacatgggtcagtagccttcctacacccacatcttcaagactttcagtggacaacccaacagtcacaaagctggagagaccactaacctcaaatacaggagccaatgacacattgccaacagatgaacacatacataagatgcatgcttggccctcattggtggttcaatgtttaacgagtgactctattaaaacaaaaattcataaatgattgatttgatttgtagcatctgccaattttcatgatataaa

SEQ ID NO: 479622 - DNA, 587 bp, Homo sapiens
tatagagatctactctgtgggcgagtcttctcgtcccagtggtgacattggtgggctgagtgtgcttgtccctggaccccggatgttgtactctggtgccagtgttagtaggaccacgttggctgattcttggtcctctaagtggattgctcagatgctaatagtgacagcagtaggcctgatgggtgtgcaggttcttaggcccctgggcagcaggtatggcaagggctatgacagtaccagtggcaggaaaactctctgggtcccgagaagttcatgcagcagctttcttttccaagcatcccgccctccaggaattctctcagggagctcactacatcatgaggccgttgtttctataccgacgagctcttggcgttgcacagccactttgtatgtggaaaccaaacctacctcttctcagtgctacacttggattgtatttttgcattccagagagctacagaataagttgtctctttcactgaatcttcaaaccctggaggcagctctcatgtgctctgttgtcttttttcaccctgctcctttaactattctgtacacaaaatgaattccagatttctcat

SEQ ID NO: 479623 - DNA, 860 bp, Homo sapiens
attagtgccagtgtgagtacttggatgtttcagttgaaggtgctgtatttacttgtcccttccattcctttcccagagctcaagcactgtgctgggagatctgctgctgtcttcagagctggcaggcaggaacatttaagtctgctgaagctgcagccacagctgcctcttcccccaggtgctctgtcccagggaaatgggagttttatctatcagcccctgactggggctgctgcctttctttcagagatgccctgcctagagaggaggaatatagagcggcagtctctctacagtggctttgccgtgctgcagtggacgcccctcccccaaccaagcttgagcaactcaggtcaacttcagactgctgtgctggcagcaagaatttcaagccagtggaccttagcttgttggtctccatgggggtgggatctgctgagcaaaacaacttggctccttggcttcagccctctttccaggggagtgaatggttctgtcttactggcattccaggtgccaatgcggtacaaaaagacactcctgcagctagctcagtgtctgcccaaatggccacccagttttgtgcttgaaacccagggccctggtggtgtaggcatccgagggaatctcctggtttgcaggttgcgaagaccatgggaaaagcatagtatctgggccggagtgcgctgttcctcacggcacggtccctcacggctttccttggcaaggggagggagttccccaagcccttgcactttctgggtgaggcgaagccccactctgcttctgctcgcccttggtgggctgcatccactgtccgaccagtcccaatgagatgaagcaggatcctttatctttga

SEQ ID NO: 479624 - DNA, 1111 bp, Homo sapiens
ctgggtcaaaccagtatactcaatatgcctcctatcaaaacagcacaagagttggagggcttggaagacaggaacatgtgggaaagtttggaatttcctagagacttgttaaatggttttgaccaaaatgctgatagtgatacggacaatgaagtccaagctgaggtggtctcagatggagatggggaacttgttgggaagtggaataaaggtgactcttgctatattttagcaaagcgactggaggcattttgcttctgccctagagatctgtggaactttgaacttgagagagatgacttagggtatctggcagaagaaatttccaaggcagtgcagaaagaaaatgtggggtcagagcccccacacagaatccccactggggtattgcctagtgaagctgtgagaagagggccacagtcctccagaccccagaatgctggatctaccaacagcttacaccatacacctggaaaagccacagacactcaataccagtccatgaaagcagctgggagggaggctgtaccctgcaaagccacaggggcagagttgcccaaggctatggaaatccacctcttacatcagcatgacctggatgtgagacacggagtcaaaggagatcattttggagctttaagatttgactgccctgctggattttggactcgcatggggtctgtagccccttcgttttggccaattccttccacttggaatgggtgtatttacccaatacctgtacccccattgtatctaggaagcccagaaacttgtactgggcaggaggtcaaaggggtaaatctaagagccgggcctgaagtggacatggaagtaagcaaaccctataagacgtacagattgagacaggttcatttccattgctaaagaagatgagtctaagacttagcttaaaaccagtcaatcattttacttccatatattgcagatgacactgctaatggttgtgttgcacacttgtgcaattctggctgaaaagtctaatctacggtctttagtaccaaataaacagattttaaagtgcctgtcacttgtctgaatctcaaagcacttaataatgaaagtttgattctctcacataggttggcat

SEQ ID NO: 479625 - DNA, 1074 bp, Homo sapiens
ttcctcctagttgcatccagagctcaaatgctgtgctgggagaaccactgctctcttcagagctgtcagacagggacgtttaagtctgcagaagttgtctgctgccttttgttcagttatgccctacccacagaggtggagtctcaaggcattttccttctaacaggcctgtctgctacaggtctgctagagtgtgctggaggcccactccagaccctatttgcctgggtatcaccagcagaggctgcagaacagcaaagattgctgcctgttccttcgtctggaagcttcatcacagaggggcaccctccagatgccagccgacgctgtcctgtacgaggtgtctgtccaaccctgctggaaggtgtctcccagtcaggaagcacaggggtcagggacccacttgaggaggcagagtgtcccttagcagagcttgagcactgtgctgggagatctgcttctctcttcagagccagcaggcaggagcatttaagtctgcggaagctgcacccacagccaccccttcccccaagtgctctgtcccagggagaggggagttttatctataaacccctgactgcggctgctgcctttctttctgagatgccctgcccagagaggaggaatctagagaggctacagtggctttgtcaagctgcggtgggctcagcccagtttgaacttcaaggcggctctgtttacactacgaggggaaaaccgcctatgcaagcctcagtcatggcggacgcccctcaccccaccaagctcaagcgtcccaggtcatctttagactgcaatgctggcagcaagaatttcaagccagtggatcctagcttgctggactccataggggtgggatccgctgagctagaccacttggctccctggcttcagccccctttccaggggagtaaatggttctgtctcgctggtgttccaagcaccactggggtatgaaaaaaaactcctgcagctagttcagtgtctgcccaaatggtcactcagttttgtgcttcaaacccagggccctggggggtgtagccagcagagggaatctcctggtctgtgggttgc

SEQ ID NO: 479626 - DNA, 944 bp, Homo sapiens
gcggctttgctaagtgggtggtcttatgagacaagggtggtcttatggcccagatctagccaaagtaccccttttccttgtccccaatgattggtccagggatgagcatatgattaaagtcaggctagccacagtatttctgttgaaattgctgcaaaacacctctggggtggctgacggtcacattctctcactcctgtgcctctatggggagtggggctacaagataataaaattagggttcagttcacttgctgaatcccagtgttcgtcctacctttatgagattgtacctagttcacctggattagactttcggatcttcccaaactctttagaactcataaacaactttttactttgtccacatacagctaatcaaataccgtcttacaaagatttgatatttgaagtcaattgtattttcctaatctccaagtgaaatttgagtgcaaatgacaaatagatcaacagtgaaaaagtatacagttcagtggctttactgttaataagaaaggcagctggtatgacaaattcaactttgtgtgataacctgaattgccacttgtgactaggctatgggcactcaaaagataagaccatataagcttgaccagatcctagtgtttcctcagaacttccccaagaggagctttccctttttgtgctgatacttttccttttcccgatttgtatgcacacagccaacgaagtttgatgttgaacacatgtaaaaaaaaaaacttagaagggaaaaagaaacagataacattttataataggaaaataatctatattctattttgctttgttttttaataaagctcagtaaaataccttcccaggtcttctcacagtttgtacagaaacaacaaggtcatgtccatatggcataattttttaaaagtaaactcaaataataaatcagagttcaattatatttt

SEQ ID NO: 479627 - DNA, 516 bp, Homo sapiens
tgcccctctgggatgaaaattccagaggaaggagcagataacagtctttgctgttctgcagcctccactggtgatacccaggtgaacagggtctggagtggatctccagcaaactccagcagaactgcagaagagaggcctcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatc

SEQ ID NO: 479628 - DNA, 707 bp, Homo sapiens
ggtttatgcatctttggcgggaataccagagaagtgttattatgtgtttcaatgcatcctatcagatggcaccattagaaatgatgttaaccttggaataccttgagaaaaattccccagagagctttatgcatttgcatctgccatgtatcattacctgccgtgtattaccccagacaaaggttatgttgatttctcagatgataagtccctgggccatgcagtttggccagtcttctgtatggctgctgtggtttgctggaggtccattccagaccctagttgcttcgacttttcctgtacctggagatatcaccagtgaaggctgcaaaacagcaagtttggcagcctgcccgttcttctggaagctccatcccagggaaggcattgacctattgctggcctgcattctctggaaggctccaatgtgttactggtgcctggctggaatttcaggccagtgggtcttatcttgtgaggtgccatggggcccacagaatgatgctgcttggttccctggattctggcactaccctagggaagcaaaaatcaagtgagtactcctagtacctggttttaatttcatattgctgagagaagcattgaatagttagaaaaacagtcctgaatcactgacaacacccctcccacacccctggcagcagcctcatggtgcagagagcctctctggacactgagtgagggag

SEQ ID NO: 479629 - DNA, 932 bp, Homo sapiens
tccacttccttcagaggaaaacttgacaagcgagtaagacttggatcttttccgaagagcacaagcccgggcttcagaggatttggagaagttaaggctgcaaggccaaatcacagagggaagcaacatgattaaaacaattgcttttggtcgctatgaccttgatacctggtaccattctccatatcctgaagaatatgcacggctgggacgtctctatatgtgtgaattctgtttaaaatatatgaagagccaaatgatactctgccagcacatggccaaatgtgtgtggaaacacccacttggtgatgagatatatcgcaaaggttcagtctctgtgtttgaagtggatggcaagaaaaacaagatctactgccaaaacctgtgcctgctggccaaactttttctggaccacaagacattatattatgatgtggagcccttcctgttctatgttatgacagaggcggacaacactggctgtcacctgattggatatttttccaaggaaaagaattcattcctcaactacaacgtatcctgtatccttactatgcctcagtacatgagacagggctatggcaagatgcttattgatttcagttatttgctttccaaagttgaagaaaaagttggctccccagaatgtccactctcagatctggggcttataagctgttgcagttactggaaagaagtacttctccgctaactgcaaaaaaaatatcaactagaaactccttctgcctgaaatactttatctttgtgttggaggaaagttaaaatggctcttgaatctccttattcaaaggtgttatttcaatgtattgaccccttagtcttcagctttacttacatctagtgcattattgttaaaagatgattcattctttaatattaattaatatgggagtttgggttaagcaaatatc

SEQ ID NO: 479630 - DNA, 520 bp, Homo sapiens
ttgagttcctccccagaaaacaggtttttctgtggtgggcaaggccatggagctccgaagagattatgacctttgtcttcagctatcagggcgggtagacaaagactaccaggttgccagggaagccggagaaagctggcagtctcaggcttcaccctacttccacgcagcatgcaatcctaaaggctggtctcactcccactgtgcgtcccccaacagcaccaagtctatttccagacagctggtgaccagagctgagaacttgccccagaccacaagcctcctcattgagaaagcaaacagaatcacagtttttcagcatctcaggaagcctgtaggagttattcagttccttcaaagggtctgtggatgctcttggctttcccggtatgttcctgtggtagttcttggagccaaagttcacaatgtgagtctccacacactgctctgtccatctgagagggagctgcaaactagtcttgcctcctatctgttttagcctcttaaacaaaacaattat

SEQ ID NO: 479631 - DNA, 1136 bp, Homo sapiens
tttctcctccttaagcccagcttctgtgtcttccctccatccactctaggatgactaaaattaaaaagattgatcataccaagtgtggcaagtttcagtttaagcagggctttgaaagagcttcagagtttgacctccatgttagaaggggtaggtgtcagagaaacaagaaacagaaatggacagacagtagaagagaaagcagggataaagttaaagacatacctacagcaacaaggaaaagactgaaaaagacactaaaagacagattgacagtgccagatagaggagggaaggaggggagtaacaagcctgtggaagaattaggaggaggaggcctggagggtataagtggagacatgaaggagactgttgctattgtatgttctggaagggatgatgaggtttgcggcacagtggaaagaggaggtagatctgattggctgttgagtcactctggctcggtggaccaaaaagttcatggtttaaatctcagcctcagtaatgtactgagctgtggttagggtctaggcaaataaggccagatgacagctggagaagattgctaattaattaaacctggtctaaggtcaggccaccaactggcaggaacaagatctttttcagttggagaatacggatgagaagaataggaaagatctgaaatgtaagaactttttttgacttctctaacacctcttgttgtttatttgtcttagagcttaagcagttcccctataacagtatcagaattgactcttgaattattattcattgttaaattttgttaggaatgcatttgaaattcaagaacaagcacaggattgtgcacctagcaggctctcaataaagatttaacttacatgagagtaatgagataggaatggaagaattgcacatgtccactccacttgcacttagttgtagtcctaagacacagagcagcatggggtaagggatggtatactttggcacatctatcccagcactagctatttatattatgtatccttaagctgtgttcttactgacacttccacttaattagcaactgctaccagagaaaataaggcaatactgagtgttgtaaaaaatactaaatttacacttttctgcagctacaatcataagtcagt

SEQ ID NO: 479632 - DNA, 578 bp, Homo sapiens
caggtggagctgcctgccagtccggcgccgtacgctggcattcctcagcccttgggtggtcgatgggactgggcaccgtggagcagggggtggtgctcgtcggggaggctcgggccgcactggagcccatggagtgggtgggaggctcaggcatgatgggctgcaggtcccgagccctgccccgtgggaaggcagctaaggcccggcgagaaatcgagcgcagcgccggtgggccagcactgctgggggactcagtacaccctctgcagccactggcccgggtgctaagtcccccattgcccggggccagcagggctggctggctgctccgagtgcggggcccaccgagcccacgcccacccggaactccagctggcccgcaagcgccgcacgcagccccggttcccgctcatgcctctccctccacacctccctgcaagctgagggaagcactctcactctatggaagtgatgctttaagcagccctatggagagatacaggtttccttgaatggaaggctcctgccaacagctgtgtgagaatagcattgaatctggagattgcttcaggcagtac

SEQ ID NO: 479633 - DNA, 679 bp, Homo sapiens
tatatgttctgaaccagcattcaatatatgatgctgtttctccttatagctaggattcatgagtccaggaatcaagtgatggaaataggaatgtcaccacccactattatccctagtgacctactagcaaaatttttacttcctgttcccatgaccttatgttttgctggcttagaggtcttagttccaaagagagaaatgcttccaccaggagacaaaataataattccattgaactgcaagttaacactgccacccagccactttgtattcctcaagcctctcactcaacaggcaaggaaaggagtgactatgctggctgggatgattgatcctgattaccaaggtgaaattggagtactacaccacagtggagaacccagactaatacaagaaccaaatctacgtccaaggcaaggcaacgtagtaaagcaagaaatcatcagaacctggcttgggactgaagtggaagaagaagggctgttcattggcaagaatcaaatctgagtcttatatgggaggcacaagctgatgagagtaggttgggaaggaatatctattggcattttccctccagaaaaaatatttaagcctctgttgaaatattgttcttctttggcctgctattatgaattattattggttttctaatattgagccatccatgcattaatggtac

SEQ ID NO: 479634 - DNA, 1026 bp, Homo sapiens
tggcaccggctggtctatcaaaatgcagggtctgaaaaacacctcaaacaccaattttagatttcctactagtgatcttatctatagcagcaattgggaagggaagggagaagaagaggatgaggatgaagatctttctaaatataaattagatgaagatgaggatgaagatgatgctgatctctcaaaatataatattgacgtcagtgaagaaggcgatagtaataaaaagaaatctaatagaaaaagtcactcaatatctcaatcttcacattcactatcttcatcatgttcattctccctttcaaattcaaggtctaggtccaggttcccttcaagaagttctagttcacagtcaagatcttgtttcagttccagagaacatttaagatcctctgggttgaaatcaagatccagttccaggtcccacaggggctcactaaacaaccctgagcccagggccaacccttacagaacacattactttacccaagcaccacaggtcatcttctggatcattccattctggttcccattcaagttcaaaaaagaaataaggcattaaaatgtatatcttaatgaaatctaatacagtgcatgaagcacatttttaaggaagttggtgtttttgatgtgtaattttaatgacattattacctgatggcctatggtggcattaccacatttcattagctctattccatgccactatgatcttaagcaaaatgcttaagattgtctaacatctatgagttttaccatagtgatgttatcactaggagcaactggggtggttcagaatctcatggcctctggttgtataactcctaaaccataatttctaatcttgtggctaatttgccacttctcttgtctacctgtaagcttgcctcctcttacctaatttgttatttaaatgattatttttacattgttaagggttataccatttacattgtcttctgtgtttttaattttaacaagtcttagtagcaatacctaggcaaaatagatttcaagacaaaa

SEQ ID NO: 479635 - DNA, 825 bp, Homo sapiens
ggtttatgcatctttggcggggataccagagaagtgttattatgtgtttcaatgcatcctatcagatggcaccattagaaatgatgttaaccttggaataccttgagaaaaattccccagagagctttatgcatttgcatctgccatgtatcattacctgccgtgtattaccccagacaaaggttatgttgatttctcagatgataagtccctgggccatgcagtctctggaaggctccaatgtgttactggtgccggctggaatttcaggccagtgggtcttatcttgtgaggtgccatggggcccacagaatgatgctgcttggttccctggattctggcactaccctagggattctgaatatttacttcgcaagattggagtggaaagaaccactccaggcttcagaggcaaaaggaacctggcccagccaattgttctttagtatgttacttcatttgtatgattagtttaattattggatttcatcatctgtaaaatgaggttaaaaattatttcccactaacatttcagttaaaaccttttccagaggctaaaatatgtctgcatacattcagtatatttaacttacacctcagaatcaaatagggatattacagaagcgggactgtgaaaagaatttaggaaggtgatattgtgtaggttgaatttttaaaatagtaattttattagttttcaaaatgtaatgcataaaacatttttatttcaaatttaaatttctgttaagtgctggggaaataaatctaatcagaaaagaaaaaaactcataagaattgaaagtttactgtaaaactatcaagtgg

SEQ ID NO: 479636 - DNA, 1232 bp, Homo sapiens
tctctcgggtcctgcaggagcagtccacttccttcagaggaaaacttgacaagcgagtaagacttggatcttttccgaagagcacaagcccgggcttcagaggatttggagaagttaaggctgcaaggccaaatcacagagggaagcaacatgattaaaacaattgcttttggtcgctatgaccttgatacctggtaccattctccatatcctgaagaatatgcacggctgggacgtctctatatgtgtgaattctgtttaaaatatatgaagagccaaatgatactccgccagcacatggccaaatgtgtgtggaaacacccacttggtgatgagatatatcgcaaaggttcagtctctgtgtttgaagtggatggcaagaaaaacaagatctactgccaaaacctgtgcctgctggccaaactttttctggaccacaagacattatattatgatgtggagcccttcctgttctatgttatgacagaggcggacaacactggctgtcacctgattggatatttttccaaggaaaagaattcattcctcaactacaacgtatcctgtatccttactatgcctcagtacatgagacagggctatggcaagatgcttattgatttcagttatttgctttccaaagttgaagaaaaagttggctccccagaatgtccactctcagatctggggcttataagctgttgcagttactggaaagaagtacttctccgctaactgccccattataacctgctatcttcgggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgagggagctaattttaagcatgttcagtggcagctcccctccagtttcagtgtcactgttaaaatttatccaaaagcaacttcactaggggttttcttaagggaaaaaaaatatcaactagaaactccttctgcctgaaatactttatctttgtgttggaggaaagttaaaatggctcttgaatctccttattcaaaggtgttatttcaatgtattgaccccttagtcttcagctttacttacatctagtgcattattgttaaaagatgattcattctttaatattaattaatatgggagtttgggttaagcaaatatc

SEQ ID NO: 479637 - DNA, 3309 bp, Homo sapiens
cagggagacaaactaagtgaatactgcaataatccaggagacttgctgattggcatagcaagttcaagatgccaattgtgtatctcagtttagaacatggccaggcccatgatgccaactcacataagagtgtttatgtgagtccttatgtgttcagtgagtctcctgaggacagcagaaacttggaaacaggccctcaccagacaccagtctgctggcaccaagatcttggacttcccagtctccagaatgtaataaatgaatttctgttgttcgtaagccactcactctatggtattctgtcctggcaacctgaatggactaagacaggggtttccaacctctgggccacagaccagtactgggaaataggacaaaagtgtcagccatcttctcaggaaatgattatcagaaatgaaacaaaaccagcaaaaattcctggactggtcatttgccatatgagcaaacatagataagaaggaaagcccatcctcggattgccgatcatcataaaatatttttaaagagttgaaaatagcaaaattaatgcattttccgaaacagattgagatggtcagagatggtttgtttactaaaggtgcagagccactaattatctccagtggtttttagcagttgcagatacttagtttgtgtcacctagatgtggctatttgtcaatatactcacagagaaataagacttctttattgctgtggatggtcactacttacaaaaggcaatcagttaacaatcaaagagtgttttatgtattccatctcatttaatggaaatggcattgtttcctttgtgtttcttattcaaaattgcaaacatcagctttggatatgcatctgcaatacacaagataatttgcaccagataatgtggatgtttggttttatttagtcaaattggatctagtaattagtactgttgtaaaatcctgctacgtatggaaaacaatgtatgaggaggggttaaaatatgaggctgttgctttacccttggatctcttgctaatattttgtttgaagagtgatttttactaattttgcaaaattccttgcatgtttggtttaatataataagcacattttaagttgaaattaaaaaatattacaaaatcaaaattgatcacctgtggctatctccttacctctacattttagatgaattatgatgagcttatttgtagactaggatgccacagaactcctagttcttacccaaataagtccatgagataaatgtgaatcaaatggaatgatccaacttgaatcatgcacttatgccccaacttatttggaaaattggtaaatgtgttcataattgtatagcatattcaaagctgagaactcttaagatgacctagttacagaggagaaatttgaagcctacagaaatgatttacccatgataacaactagtttgggacagaactggaactaaaaccacaaattattttctgaattcggaatgttttctactatgttatatctctttaacttcatctgaagatatgggaagcagaaaattttctcttttctttgtactacttatacttttaagaaatacactcataaaaatattttctgaaaaatatgattaggagattactttcctacaattaagtatacaaactcattgcttgtgctgaggaaaataatgtgtgatgacaatttattactcaaatttgattataaacattatttcttcaattataataccattctttggtctaggggacacttttaaatgtctaattcaattttgttaattcaacttaaaattcagtatatgtcagtgtttatgtgtttccctcgtcaaccctattcaactccctttacttccttcctttgacatttcctgattgaagatcctagatgctgcagtgattaagggcttctgaattcacaggatggctaagatagataggcttatcacagattagcagtgaagccagctacacattcttaagattacacttatcacacagcattatgaattttcacatgcctacctctccaagtacattatggcatctagtttgttctcatatcctgttctgattagttattgctacataaaaaatatttcaaaacttaatggtttacaatgacctaaaacaataacaacatagtatttgaagtttatactcagggtatctgctgtttccaaaagtacaaatataatttgcattaagggtactgccttaatgagagattttctgtcatcctctgtgcttatgtggtaaagtcttaatttcacattcatgtgatgtgggcaaatgtaacttaagcctagttctcatctaatgtaatttattttctcggtatattaattaaatttgcagcaacaagaaataggaggacacctgatattaaaaagcaaaaaacacagaatgcatttgcctcattagcatgtgtttttccagcatggctatgcactgcttattaacacactgaaaactctaactgacctgaggtattagcaggtatctggagctatccggtcctgggtttcaaccctggttttgctccttacaagctgtgtgaatatgagcaacctattaatctctctgtgctccaatctatgtaataaggcgaatgaaagtaactataactattatggtattgaatgagaaactctgtgtaggcaagtatcacagcatttggtgtaagtgctgaaatcaacatgaaacaaaggagagaggacagtagcaggagggaatagcaaagtagagtaagggaattactctttcgccgagaattctgagatctcaaatgagtgacaacaattttctcatagtaaaatcttatgtaatattcaatgacatttcctcaatcaagagctttaacaaacaagcaaatgattttatttgataatgaagtcctctcctgttcttctgtgctgccttttcccagtacttttatactgctgagcaatccttcctatgaatctttttacttccagagttatgaatatctgctcaacctgcttctaaaataaacttttgtcaaacttaggatcatgctatgagaattaaaaggtgacagaattatactactatcacttttttgagtaatatttttgaattttagaatgtgccttccagaagcacaatgactgaagtcatttgtctattgataatttatattctgcctacttccccaagaaatttgtcatggtacaatatgccaagacagtgactctaattactggtgagaattttaggtttaactttactcattaattttttcctgaagctctttggatagattctccaggaaactgatgcaggcctgc

SEQ ID NO: 479638 - DNA, 1060 bp, Homo sapiens
agaactctctctcttctctctgtgaggacacagcaagaagatggcagtctgcaagccaggaagagagcccttaacagaacttgatcatgctgtcatcctgatcttggacatcccagcctccagaactgtaagaaataaattggagggggtgtgcctcgctgggggaaaacccacttgtctgagctacccagattcctcagaactaccaggaggaaaggctaagtctgctggtctgcagagactgtggccacccctccccctaggggctcaggcccaaggggatccaggttctgtctctaagcctctggttcgagttattggagttcctgcagggaagccctcacccaatgaggaaggatgggtcaggacatcattagacatcaatagagttgtcagacaccctatacggctgcatatggcagccacagccagccatggtgctggtagcccttcccctcgggagtttggtgggcttaagcagattccaactgagagactgttaagagtctgcacattccagggttgggacgctaggccctatggtgtgggttcgcagcttaaacttctgaagcaactaattgtggtttgggccttcaacacttggccacttctggccatgctttatgagatatgacaatacttgcattccactagagccagaaatattgagtgccattatgcatcatcaatttgatttggtgttatgacaataatgttttagtgatttagaagtgtaatacaaagttcccaataaaaagactgatcattgtagtgccttttcccagcctcactgccagctagaaaaacattgaagcttttcaaataaattctcttccagcctggaatgctttacctgggaaagttttataatctattatagagtttcaagagtaaatctaaaacaaccatgaaagtgcctttacattgcaaagaaagccttgggtaaacttttcatgtgcttccaagttccctttcctcaataaatcaggtaaggtctgtgaaagtttgcaaacatgtaaaggcaaactatattactttgatttcacttttgaatttaaaa

SEQ ID NO: 479639 - DNA, 4088 bp, Homo sapiens
ttaagattaggctcctcctatacctgccatgcataacggttcctctgatggatctggtccaagtaaattgaaaaccttctggaaaggattcaccattctagatgccattaagaacacacatgattcatgggaggaggtgaaaatatcaagagtaacggaagtttgcatgaagtttattctgaccctcatgggtgactttgaggggttcaagacttcagtgaaggaagtcactgcagatgtggtgcaaattgcaagcatatttgtggaagaaatttctaagcagcaaagcattcaagaggtgactcgggtgcttctgaaggcattcaattttataagggcagcagagcataaaagttcagaaaatgtgaagcctgacaatgcaatagaaaagaaaatcccattttctgaggagaaatccaagctggctgaaaacatttgtataagtaaggaggagctgaatgttaatcctcaagacaatggggaaaatgtctccagggcatctgctccaatcattgctgaaaggggtcaacatagagctcaggctgtggcttcaaagggtgcaaacctcaagccttggcagcttccatgtgatgttgagcttgtcagtgcacagcccccacacagagtccctattggggcatcacatagtggagctgttaaaagagggccaccatcctccagaacccagaatggtagatccactgacaacttgcaccgtgcacctggaaaagctgaagacactcagtgccagcccatgaaagcagctgggagggaggctataccctgcaaagccacaggggtggagctgcccaagaccatgggaccccacctcttgcatcagtgtgacctggattgccttgcatatttaaacagctgcttgctccttgcatcctttgggtgattttcatattcccttgaagtatttgggggcagaaatgggaaaggaggtagcagaggcagaagtgaaatataatgctacagggaaagcaaaatgccaatgcgtaatttggagacaagagaaaggagctatattttttaaagtaccctcaatgaaattaaaccatagggaaaatgagttatttcacaaacaaagtaactgccagtgcccattacttaaattggtgctaagaaatagtatgaaaaatgatcttttagcaaatactattctctaccaactttgaatgtatccaaacagtagtctggctgaatgtagtacattgcacagagactaaaaattaatttgacatcaaaagttattaacggctgaatccagctgtaggagttctgcctaggtgagattcattttaaaacccctctttgtcatctgtaaaggaggcaaatgtgtctggttgtagagttgtaggaagacaacataaattttgcagtttcaagactgcttcacaagacatgtgtaggtattcaagcatgcttttctcttgggaatactgcttaaaacaggcagtagaattatggtcatctcaaagactatttaaaagtttttttaaaaaagaagaattggtagaaagggagcctctgtctcctcccttacagtgcaaagaacaatatgcagtgtacagtaagggaagttctactatgatgctttctctgtctcacagtcctccttaagagaactgttatggtgtacttcataagctgcctgggcgctgttttggttaggatctaccatagaccaggaatgcattttccaagcacttatgcataacctggagaatattggaacagtgtgtgaccttgtgtttctcattttctttctttacccccttattagccagtgtcatgtgaagagttgggagtactctatggatgaacagataaaaagacaaattccaaaattgggcttttgaggggtttttgttagtttttgggtttttgtgtatgaagatcagaattctctacacctgttgagttgaattaaacttcataaacattgcagcctttcttgatgttttgcatcacttaattattatttttgtgactttaacttttttggtaaaggaaaaaaatctttacatgccacttcctttttcctttgtaacagttatttgcaggatgggcattggttggatttttcttgaattaatgaaatctgtattgctcatacttgaattgtaaaagtcataaaaataaccatgcttgcacatgaaccatgcaaatatagagttagatattattgttatccaaacatagatatgaatatatatgtgaagtcaatgtatacattatagagaagtctgtgcatataatgcttatagaaggcttctaaagactgtctgattactttattcatatactatttaatgctaacttcttcctagttatttttgctgggtcaaaaaagtatatatttcaatattcataaactttgtatcttcagcctaagaaataaaagtagcaagtatagattttattctatagtactttttttaactcataaacaattttcacatatctatgttagggaaaaatatgctgactaataatttacagttgtgattattttatgagtatgtagttccagattttataagggagaacatgcttttacacccatgtctgatctccttccaattccaaccaacacataaaattaaggctaatcacagaaagcacagttgcggagtcagagaattgcagaggtttgtgcaaagtacataaggcatgcagaaaggatttaagaatacaatcaataccaactgaagtggtattgagaataatctgacagagatggacacaggaaggttaatgtggcttcagtgaaacacttgagtcagataggaatacaagaaagatttcaggtacatctataattggaggaatcagggataagaaaataaatacaaacttaaaagtatgcctttttgacctaaagagaaatatgaagataaacaccaagtatcttttaatgaaaaatatacagtgaatcagtacccagttgtaaactagttttaggcttttcactgtttctctggacaatgatttgcttctatctggaagtattacctgcattaagtgacattgggtaaacaatacaaatactacagatttatgcccattcagttgctctttgctttgtgttgttgttgttgatatgttcgtgcaaatagaaggctttagaattccaaacaataaagttcccagtacttttttggatgtagggagcaataattcttatttggcagttcatttttaaaaatctgtccatatccagttcattccttcaccaattgcacacacttctgtgtgcaatcaactacatagatttgttttgtttcaatatccagtgattagggtttcattttttctgacaatttaaaatctgaattatttgtgccttctttttgtagatattgttttgtaatacatcacctaatttagccttaatatccattcccaatattgtcagagactgaccttaaggaacaatgtaaaacttctctaaattcagtgtattcatgcatttggccaaaagtttacttaaaaggcaaaccaacaaaaattttttactgtctctcaatattatataaaaatctttttcaaaagaaaaattcaaattttattttggcattagtgcattttaaatgctaaagttagtttttaataaaattttataaatctgtccagttttaattagttttaacacaagctctatgttgttcctagttttaaatgaactctgttgttctcacaatactagaagttctggaatcttacattttcttggtcttattaaaactgagaacacccatcctggaagaaaatgaagacagagaaatctggagatttattgcaatcaggctcttatacttttcaatcagtagcctctctagggctgatctcttctattcttgtgcgtttactgttgactcaggatgataaagtttgtcctttgagagttcaatattccttttcggaatgttttgtttttcttaaagggaattgtaaactgttccccataagcatttaaaaaaatggaaaatgccgtgtgtgagtagacttagttgtcctgtaactcttcctatttcatttgcctgtagcattttgggatctaaaaggttttgatatttata

SEQ ID NO: 479640 - DNA, 1462 bp, Homo sapiens
agtgggtgcagcacaccagcatggcacatgtatacatacggcggctggctcccctctggcctagggaaggtcccgaaatgccatccaagtatcaagtcctggaatcaggaactccaagtattcttttgatgctctacccttctgtggccatgcttgtacctaaggtgcaagacaaagtcacctttacttttccctctacttttctcaagcagatggagtttcttcatgcagccagcacagctgccatcaatatcacaacaatcatccatggtaatgattattctcgccactttgtaattgaagcagtagaagttatgtatattgtcattgacacagctagtaaaatgaaaaaagtcaggattcaaacacagatccctttcatttcaaatcccctgtgctttctccactacattataatgatgccctacttgtcatccaataacatgaatcatctcactcctctaaattatctttctttaatttcacctccctcatgacttaattctttgtttactagatcagtctcatttattaccatttcatttgtcaaccatgtttagtttatacctcttgctagatcttttaaaactattcttttactcaaacaaaatggaccaataaactcaccactctattatataccactacacatcacaccacaccaccagaagtgaatataataattggagaaccctgtacaaaaataacttgatacatcttctctgttctcattgtacaataactaaatcgccatattagaattttgtgtcatggaaaagaaaaaaatagtactgatcatctagtttttgtttgctgtaagaactacatgcaaatatgtagaagttgagaaatcagttgctccatatacacaattggacattgaattagctagtaaaattgttatgcatatttatatcatatactcaaaaaacttagttcctatgagattattgaaatttttgaagtgttgactcgagttcatgaaagtatttaacaccaatacagctattctacatgcttattaattttctgatctgcagtaaatattgaagcaaccatcttatttaaagcaatatctatatttctaatactaaagaaacagaattatcatatttatattactcaatataaaagttatttgattatattatgcataatttgtataggggatcttatttttaagacacatgaattactaagattctatttcaaaatgagaaaacaggtatttaatgataagagtgtcgatgtgacactcaaaggagatattcattggagtatctcagttttcaaattttcagattagggatgttcaatcagtaagtataatgcaaatattctaaaatttaaaaaaatctgaaatttgaaacactggtttcaagcatttttgataaggtatactcaacctgtatcagcctttctaatttatatactggctagaatctccagtataatgttgtct

SEQ ID NO: 479641 - DNA, 689 bp, Homo sapiens
tgaaggggtcagggaaatatcctgcctcactgttagccttaaatgacctggcacagttgaattcaggatgaccgagtgggagacagcagcaccagcggtggcacagacccttgacatcaagctttttgggaagtggagcactgatgatgtgcagatcaatgacatttccctgcaggattacattgcagtgacggagaagtatgccaagtacctgcctcacagttcagggtggtatgcccccaaacgcttccacaaagctcagtgcccaattgtggagcccctcactaactccatgatgatgcatggccgcaacaactgcaagaagttcatgactgtgcgcatcgtcaagtatgccttcgagatcatacacctgctcacaggcaagaaccctctgcaagtcctggtgcatcatcaacagtggtccctgggagggctccacacgcattgggcgagccaggactgtgagacgacaggctgtggacgtgtccccactgcgccatgtgaatcaggccatctggctgctgtgcacaggcacttaaatacaaagcgtattgtcatggatgggtgtgatcttctagaaattaaagccaaccagacaagtgctcccttgaatctgttacatggctgttcccttaaagccaatgtttctatctaaaaaatcggtaagagaaagagatagaagcatctta

SEQ ID NO: 479642 - DNA, 1154 bp, Homo sapiens
cagcaggcacacaaatgatttaccctgagttcgcgggcaaagcaattatattcttaatcaaatcaagatgaactcaggaaatagactacataatttcttgttaagaaaaacctatgaaaatacttggtcaacagtaaaaaatacactagtgatgatgataatgatgattgtgatgatgatggtgatgatggtgatgatgatgattgtgatgatgatcgtgatgatgatgatgataattgtgatgatgatggtggtgatggtgatgatgatgatggtaatgattgtgataatgttaatggtaatggtgatgatgatgatgatggtgatagcaatgatcatgatgatggtgataataatgatgatggtgatgtttgtgatgatggtagtaatgatggtgatggtgatcatgggtgatgataattgtgataatgatagtggtgatggtgataataatggtgatggcaataatgatgataatggtgatgatggtgatggtatgatggtgataatgatgatgattgtgatgatggtggtgatggtgatgatggctgatgatgatgattgtgatgatgataatggtgatggtaatgatgacggtgatgatggtgatggtggtgatgatgacggtgatggtgatgatgattgtgatgatgatgatggctatgtaaatgatgataatgattatggtgatgatggcgatgatagtgatggcaatgatggtgatgctgattgtgatgatggtgatggtgatggtgaggatgatgatggggatgaaggtaatgatggtgatggtgatggtgaggatgatgatggggatgaaggtaatgatggtgatggtaatgatgatagtgatggtggtgatggcaatgatgataatgatgattgtgatgatgatggtgatgataattattgtggtgatgacaatgatggtgatggtgataatgatgatagtgatggggatgatggtaattattatgatgatggcaataaggacagtgatgatgacaatgatgataatgtgatgaccaacagtcagacagcctatatttaggataaaagctgagctcacagattagcagacttccatagttaattctttacctgagggtgggtcacaaagcaaggtccctttctatgcaaggcagagggaagtc

SEQ ID NO: 479643 - DNA, 884 bp, Homo sapiens
cagagcagtgaagatgagacctggagctctggctgcaccatttacaaacttggggtcttggcaagggtggtggggaacgggtcccacataacagcccatgttgagagctgatgaacctgggcacctagccttgcaggaacaatggcaagcctttagcctgatcgggagtggcaataggcgcctcactggatcaggagcacagtggacaccctgccagatccagagggatggaagtcagcggcaggtctgcgacggcagcaaacagcagtggtgggaggggacccgaagaagaagagataatggagaggaagacataacagaaataacaatgaccaaatttacacaatttgtgctagacatcaaatcagcgacccaggaatcccagagaaaaaccaatccggataaatatgataacataaactgcagaaaagacaaaaacaccaaaacaccaaatgcagtcaaggatatagaacaacagaaactctcactcattgctggtggaaatgcaaaatggcacagccaagttggaagacaggttggcagtttcttacaaagctaaacatattcttcctatatgatccagtaatagtgttccttggtatttaaccaagtgaattgaaaagtaatgttcacacaaaaacctgcacatggatgtttttagcagctttatgcataattgccaaagcttggaagcaactaaggtgtctttcagaataactcatgtacagtgaatattattgcttttttttcacctatgatggagtaacaaggaaaaaatttaccctctgtatttgtgtcctattgctgctgtaacaaataaccacaaacttagtggcttaaaacaatgcacattcatcatgtcacggttctggaaatcagaagtc

SEQ ID NO: 479644 - DNA, 689 bp, Homo sapiens
accccttgcacttcctgggtgaggcaatgcctcagcctgcttcggctcaccctccgtgggctgcacccattgtccaaccagtcccagtaactgtaaaacagcctcagacaggtccttcaggaggtattccagaagaaagtatcattatcataagacatgacagatccatgtgtattgctcctgaagactttccagtggtacaagatgtacagataagtatcaaagccagagaagcctgcatagataggggccagatgaccgacatagggaaaaatgagtatcaaaaaccaaaagttgaccaccaatttaaatttctcaaggactgcaataaaattaccattaaaagcacaatattccagagcaaaatgaagccatgtgtatttgcatgtgtgtgtgtgagtggaggtggaggagttggggaaaagaaagggggaattggtagtgaccatgatggcccagagaagagtgatggagctaatgtcttgatgcgagtttctttggattcatcttatttggtgtcctttgagcttgctggttatgaatttctatttcattccccaagtttgtgacgttttcagtcatttcttacttgaataagctttctgtgtctcctctcttccttgatctctagaaatgaatatattggtccattacatggtgctctataagtctcttaagcaatcttcact

SEQ ID NO: 479645 - DNA, 984 bp, Homo sapiens
tctcctgtcttctgtgttgctcacgctgggagctcttccctttgacttcagctatgagtgggagcaccctgaaaccctcaccagaagaagatgctggcaccatgcttcttgtacagcctgtagaactgcaactcttgggctcctggagtccaatttctgttctgatggaggagtacacctcttggggccaaagtcctgtcataaaatccattagtgatctttcttcgccccatccagaggggagccaatcaggttaccagaggctcaagaatctgagaatgaatagcagtgaagtacctcctgatcctcaaaggtgtccagtctttcggaacgcagattcaaccacggcagtcaagtcactgcattctcttccctgcaagaagcaaactctggggcatatgttgttccaagagaaaagcacattttgtatttttacagagggacaggacagggtaaccctagctgcagatccccggcccagccctctagcagcccaggagctgcaaggggagatggagttagccctaaggggactgcagagagccagggagtgggcatactgagggtggaggttggatcttgcacctttttgtgtgactcctgatacctgccagattggctaggctggctgtgatctggatgggtggaggttggatcacgcacctttttgtgtgactcctgatacctgccagattggctaggctggctgtgatctggatgggtggagtcagccacatgtcttgcttagtgcccacccagctgcagcaagaagtggctgtgtatgtcagcatataaaactccaagtcaaaaggtcaaactgtgcacttgatctctcaagttgcctgcttggccctcttccaagtgtactttactccctttcattcctgctgtaaagctttttaataaacttttaccactgctaaaaaaaaaaaaaaagagagagagagagagaagtggctgcagactaagcggacttcgaagtgg

SEQ ID NO: 479646 - DNA, 550 bp, Homo sapiens
tgtgaatgaatgaatgtgtgtgtgagtgaatgtgtgagtttcatggctccccacatgcctttagaggatagaggctgtgttatacagttaataaatcccagcgaggccaggcagccccctcccctcctccaatcccaggatcagacttcttatcctagaccattcagtgccactcaagcaactcctccctttcagtggaatcctggtaccctaaagggccagcacagagccctatctgaaggttcccagcagaaagagcaagtgggagcagaaacacaggccacattaccttcactaagccctgtgctctggcacagagatgcagaccagaggaaagaatacttctactttatctgcccagatgagccactttacgaagtaataaagctcctgtatgaacctgaccagggtacagtcactaaggcctctgtttgtgaatttgaaaaggagtggaaggaacaggttaagccttgaaactctatttcacctcagaaacagagagaaatctgactcttattcttgtgggaggcctcacagctctcattctccc

SEQ ID NO: 479647 - DNA, 822 bp, Homo sapiens
gtcctgtctagacagggtcagcccagccctgtctgaggggcaagactgccctgcagaattcaagtttgacagctccccttggcctaaagtctcctatgggagcaagtcaagcttagggggatgactgtccctggctccactgggacagtggttctccacttcagatgctcccgcaccaaacactctgggctccacatcagctggcttgctgcccctactacttctctaagcagctttccctgccaactcaagtgtctgtggtggttgaggggtctcctcctgccagggttccagaggcccatggcaagagtgggtttctccttgccagttcaactcatccagtcccctggagccattgagggccaagaacaagtcctgatgtgcagtagccccgtgcaggattcccaactttctcccccttcaccccagcttttgtgtcttccctctgtccactgttgttgccttctctctgaagatctgttaggagcacaccagtcttctaggttccacagtgagagctgttccacctggctgcatctagttggccatcttgccctcactcagcttgggaattcttgtgtgagggtaaggtaaccatatgagttaaagttcatttagctcatgtgtgagtgaatatatgagcatatttgtgtgtgagagtaaatgtgagcataatcatgtgagtgtgtgagcaaggtttgtgagtaaacatgagagagagtgcatgtatgtgagcctgtttgcagcattagagacttgtacagtttgtgaaggaaagtacttgagagttcagctgctgaataaatatctggaaagttgtgt

SEQ ID NO: 479648 - DNA, 1491 bp, Homo sapiens
cggtattctgtgagattgttttggtttgatagaagaacatggactacctggtagtgccagacagggctattaatgacccagacccttcaaaaatgcaggtttgggtcaccccacaagataaagagccacaaccagctgaagtgcttgctaaaggcaaagggaatacagaaggggtagcagaagaagggggttataaagaccagctaggaccatgtgacaaggtacatgtgcacaatgtgcagtctctggcattgctagaaaatcactgctttcaccatctttcagcagcacaggacaggtccattttaaattatggcacagagaaaaccagaatggaccctccttgcagacagccaaaaacaaaagaagggtctgatccagtcatacttaatttcttctcccaaagctcaccaagctcttcaatcatccttcctaaggaaggaaagttgggagagagattaggagcgttactctgaaatcagtttccttcaacagtgaagcaagcaaaattttcttaaaaagaaaatctaagagtttatattaataaggtaaaaaattcaattaatatttctgaaaaaaatacattgaattttaaaaattattgttgcttaatatctgacaccggtgccttttcatgtaaaaaatgtgaattccatattaaaatatcaagtgtatttcaatgaaatgttataaaataaaatgatattttctttaaaaatatttgaggacttggtccatttcacttaaattattaaatttgtgtgcataatggtgttgataatattttattatccttaacaaccatagggttagtagtgatgtctcctgttttatttctgttattgataatttgtgacttttctttctctctccccttttcttggttaccctggttaatgtcttatcaaatctattaatcttttcaaagaaacacctttagattttactaatttattctatttttccctgtttttagctttgtggatttctgctctagtatttattttctttctactgctcattttagatttaatctgctctactttctctagattcctaaggtgaaaagttaggttactgattttagtagtgggaatggggtagaaatgtgtatactttgtcttatccagaaatggaaaacttattaacttttaacagctttcatttatgaatgtttaaaatgttttatgatgttactatactgtggtacctagttatattttctaaaatatatgcatcattattgttgtttgtcgttgcctgagtgtccacaaaacagagcctgatacaagagtttgcatgcaaatagtttatttgccaagtggttttaggaaaatagttcagagataggtcctcttgtctcactcaataagtcacttctaatactgctacttcatttgaccttctcaccaattcctcagtactctggcaagaaagtttgagtgggctgtcatggtcaaggcttaaagatgacaccctagcagcgttatt

SEQ ID NO: 479649 - DNA, 642 bp, Homo sapiens
tctgccagtgctggagctatgatgcaggccctcaggaggtacctggaggctgtactgcaagcaggtggggctagactggggccccaagagaggccagtaggccaagggatgctcaggttggactggcctcgtctgatgggcaagaccaccctgcagcattcagatgccagccacaaatggggtacccagactaccaacatttctatccagctaactacaaattcaggagtttccacatcccatcctctcagatttgataatttgctagaactattcacaggattcaggaaaacactttacttatatttactgatttattataaagagtacaattcaggaacagccaaatggaatagatgcataagagccgtgaccaaggaaactgcaaagaagctggaaacctatcagaaagtgcctcctcgcatctagacattctaatctcttcattagaaaaaaaaaacagttatattgctaactttggagaaatattaatggggaattttcagagtgaaaatatatttgcccactctgaaaaaaaaaaaaagtaaaggggtgggaggtatatcagctaccatgccacaattatctggattatttgtttcctacttttttttcttaaacagatgaactgagctgtggcct

SEQ ID NO: 479650 - DNA, 475 bp, Homo sapiens
caattaaggaatgtttttgtatctcttcagtgcctctttcagcgatatgaggttaaaacctggtcccccagtggtgtgtgggggcattggctatggtaggcaggagcagagtgagcccaaggcccctggcagaatgctcaagtgggggaagcagtggttgcactgtggccctgctgttggggaggggatgtggggacgcagggactattgggccccagagcaggatgcagtctgctgggggcttgtttctcaaaatggtgccttgctgcagctgcttaagacttgggaagaagatgggaaaatgtggggaagtttggaacttcccggagacttgttgaatgcctttgaccaaaatgctgatagtgataaggacaatgaagtccaggctgaggttgtctcaaatggagatgaggaacttgttgggaactgaagtagaggtcactcttgctatgttttagcaaagagattggtgaca

SEQ ID NO: 479651 - DNA, 653 bp, Homo sapiens
tctgcagcttcattcttgaagtcaccatttgtccctgtatcaattgcaacagaagcaaagttagctgcaaagatgcttgcttttggttaccagagtttcctcctctgtactcaaaccaaactaacgagcccaacgggtagtaaattaaacatagaaaatacagtatttgcaggaagcaaaacctgtgtatacagagggccaacttttcatatatgtgggttctacagagcagtgactgtgggacttgaatatgcaagaatttgggaatatgtgggggtcctggaaccaatccttggagatactgagggacaactgtatttatgccagtttcatggcattactggcctgcatcttgtcaaggagaataagaagcctagatattatgtactcggatgtttgactaaggcaaagtatccattctggcctgaaagtcagttcttcctctttatcctccttcctttcttttcctccctcttccttactctctcccatccccctactttaaaaataagacaatacagcaaagtccgataatgaactacaaatggtttaggagggaacaaccattttaacttttttcaaaatgctttctgggatattaactcttactgcttttcctaaaactatgtaggcagtatagagttgtagcagtt

SEQ ID NO: 479652 - DNA, 534 bp, Homo sapiens
ctgagatgcaaactctagaaactctagtggaaaatattaataaatgtcactaaataaatttaaaaattctacacagaacaaatatataaaaggggaaattctgggaaatattttgcaatacatgacagataaaagtttgataatttattatgaatcagttcaaggggtacatgtgcagttttattatatgggtaaattctgtgttgtgggggttcagtgtacagataattttgtgacccagaaagatgctacccacatggatttcccagaatttagtgaagagagtcagaatggagaaagtgaaggagctttgggcttggtgataaaaagacaagtttctggaaagatcaagggagagcaaagctttattgagaatgtgactcagtgtgatacaagcttctggcatatacccaaggaaaagtatcaatgtgctaatctccacagcaaatcatgagataatggacatcttgcaaaagaatataaggtgacttgaggattataaagaactactgcagaaaggagggggaaagcaaa

SEQ ID NO: 479653 - DNA, 568 bp, Homo sapiens
ggttactattgctctgtagtataatttgaagtcagtcattatatgcctttgcctgtttgtaatcctcagagcctctcagctcaggcactggcccagggagaaacaaccaatgaaggaagaagtagcagcctagtggataagcagagagccagaggagtcccaagcagctgtgaatctttaaatttaggagttctgggcaaagatgtccttgcattattttcgttcctaaatgagcagaacagaacttcctctccagtgctgggctttgtgaagaacttcagcttgtggctgcaccacaactcatgcagtggcacccacaacatgtaccaggaatacctggactcagccactgggggtgctgtcacccagtactacagagaaatgggtgcccagcaatgtggttgggcccactggatccagattgtgaagatacagtcattgcctattcagtgcaatcgtcatcagcccacccagagttaatcacattacctctcataagcccatagaatcttagactcactgagagtataaaagcacatgttaatgcctagtgttccattattggaac

SEQ ID NO: 479654 - DNA, 664 bp, Homo sapiens
ttccacttaagggctcgctgattttgggaagcccgctctcgcccctaaagccagctgagtggccctctgcatgtacagctcccagtgcctctctctgtcatagcgctggtcctaccatactgtcatgaatgtgactgtatatggagatgaggaaatttgggcacataagagacagcaggggcatgcaggcacagagggcagcaagagggcagccatctacaagccaaggagagcagcctcagaggaaaccaactctgccagcaccttgatcttggacatctaccctccagaactggaagccaagaccctgggactggttgataggactctggtttcattctgggaactgcatcattacccacagatgtgtgaagcaatggcttgtttgaaaattggaatcctagcccagtggagtcagtcccctctctgggcccccacagcccagttatggttattaataactggtggttctctcatccctagttccagcagcccagcaggacctcatcctcttacagtctgctgcccttttgctacagctggccaagcagatgatcctttagcttgcatttctagctatctctggggttttttgtgcccagcccttgacgtggctctgccagcctttgtgattctaggggagaggaaaggtggatgaatcagg

SEQ ID NO: 479655 - DNA, 971 bp, Homo sapiens
ccatggacatctttgatatgtttttttggaggaggaggaaggatgcacagagaaaggagaggtaaaaatgttgtacatcagctctcagtaaccctagaagacttatataatagtgcaacaagaaaactggctctgcaaaagaatgcaatttgtgacaaatgtgaagatagaggaggtaagaaaggaggagtagagtactgtcccaattgccgaggtactggaatgcaaataagaattcatcagataggacctggaaaggttcagcaaattcagtctgtgtgcgtggagtgccagggccatggggagcagatcagtcctaaagatagatgtgaaagctgcaatggaaggaagatacttcgagagaagaagattctagaatttcatattgacaaaggcatgaaatatggccagaagataacattccatggtgaaggataccaagaaccaggactggagggagaagatattatcattgtgttagatcagaaggacgatgctgtttttactcgacaaggagaagaccttttcatgtgtcagattgtcaagcatggagatatcaagtgtgtaataaatgaaggaatgccaatttatcctaggccatatgaaaagggtcgcctaatcattgaattcaaggtaaacttgcctgagaatgactttctctctcctgataaactgtctttgctggaaaaactcctacccaagaggaaggaagtggaagaaactgatgagatggatcaagtagaactggtggactttgatccaaatcaggaaagatggcaccattacaatggagaagcatatgaggatgatgaacatcatcccagaggtggtgttcgcatttataggccaaaccttgtaattgacttcagctatgtatgtggacaagcttagactgaaatgctaggtatgtgtattggcttcagtgtatgacccttcattgttaagctatgaaagtaaaactctgtatttaa

SEQ ID NO: 479656 - DNA, 880 bp, Homo sapiens
tgcccgcatcagtcaaggatgagacagagctgaccatgcaccagtctgtggagagcgacatccatgggctccacaagatcattgatgacaccaatgtcactcagctgcagctagaggcagaggtcaaggctctcaaggaggagttgctcttcatgaagaagaaccacgaagaggaagtaaaaggcctacaatcccagattgccagctctgggttgtccatggagctggctcgggagaaccaagaggagctggacaagtacgggtctcagcagactgaggagagcaccacaatggtcaccacacagtccgccgaggttggagctgctgagatggcgctcacggaactgagacatacagtccagtccttggagattgacctggactcaatgagaaatctgaaggcaagcttggagagcagcctgaggaaagtggaggcccgctatgccctacagatggagcagatcaacgggatcctgctccacctggagtcggagctggcacagatccgggcagagggacagtgccaggcccaggagtacaaggccctgctgaacatcaaggtcaagctggaggctaagatcgccacctactgccacctgctggaagatggcaaggacttcaatcttggtgatgccctggacaccagcaattccatgcaaaccattcaaaagaccaccatctgccggatagtggatcataaagtgatgtcagacattaagccagcagaagcaggaagaagatgtaagggaaaatctttgtgaccttgggttaggcaaagaacttttggatataccaccaaaagcttgatccataaaaaagaaaaattggtaaattggactttattaaaaggtaaaacttttgctctgtgagagatactgtt

SEQ ID NO: 479657 - DNA, 750 bp, Homo sapiens
gaaaaagatgcactgtgttgatcttgtggctctatgtacctcctagaaggaattacagcagagccagccacacccctagatcatagaaggtgcatgcagccacatacttggtgtgataccagccttccccttactcaaattcacctgccctccagctgtgtttgccggaaattctcctttgggttaaagcccaatctccagaaggtcccgaccccatcttctgtttctctggctgcctttcaccagacagggaagaaaaaaaaatcagctttgaaaggaaaaacaggaaatcagatcttgatttcagaagatttcaactgcttccacaaattgaatttcccacctggagtcaaattctctatttataacaaagatatcatctgcccagaaatctgtccttgtccaccatgcctagacagattgatcttgccaaagcacaactggtaccatgacattctcctgctcaggagcctcagtgactgcccaatacctgcagcagaaaatccacattcttctgctagtgtccatctctcactactcccttcagagaactgctcaccccagccaggtgcaaggaagggatcatgccccacaggttacatcaaagatctaaacaactctatgaagtgtttttatcctcaattgtagatgaggaaactgaggcacagagaagcaaaacttgcctaagggtcctactggcatgttttcaacctactacctgcagcttatctcttcatcatagtcttaaca

SEQ ID NO: 479658 - DNA, 1310 bp, Homo sapiens
ggccgaataggaagagctccagtctacagctcccagagtgagcgacgcagaagaggggagatttctgcatttccaactgaggtaccgggttcatctcactagggagtgtcagaaagtgggtgcaggacagtgggtgcagcacactgagcatgagccaaagcagggcgaggcatcgcctcacctgggaagcacaaggggtcagtgaattccctttcctagtcaaagaaaggggtgacagacggtacctggaaaatcgggtcactaccaccctaatactgtgcttttccaatggtcttagcaaacggcacaccaggagattatatcccatgcatggcttggagggtcctacgcccacgaagcctcactcactgctagaacaccagtctgaaatcaaactgcaaggtggcagcaaggctgggggaggggtgcccgccattgccaaggcttgagtaggcaaacaaagtggccaggaagcttgaactgggtggagtccaccgcagctcaaggagacctgcctgcatctgtagactccacctctgggggcagggcactgcaaaacaaaatgcagcagaaacctctgcagacttaaatgtccctgtctggcagctttgaagagagtagtggttctcccagcacgcagctggagatctaagaatggacagactgcctcctcaagtgggtccctgacccctgagtagcctaactgggaggcaccctccagtaggggcagactgacacctcacatgcccgggtactcctctgagacaaaacttccagaggaacgaccaggcagcaacatttgctgttcaccaatatccactgttctgcagcctccgctgctgatacccaggcaaacagggtctggagtggacctccagaaaattccaacagacttgcagctgagggtcctgactgttagaaggaaaactaacaaacagaaaggatatccacaccaaaaccccatctgtacatcaccatcatcaaagaccaaagcaatggaacaaagctggacggagaatgactttgacgagttgagagaagaaggcttcagacgatcaaactactccgagctaaaggaggaagttcgaacccatggcaaagaagttaaaaaccttgaaaaaaacttagatgaacagctaactagaataaccaatgcagagaagtccttaaaggagctgatggagctgaaaaccacggaacgagaactacatgacaaatgcacaagcctcagtagccgatgcgatcaactggaagaaagggtatcagtgatggaagatcaaatgaatgaaatgaagtgacaagagaagttt

SEQ ID NO: 479659 - DNA, 1196 bp, Homo sapiens
tctgagacggcaatgcctgtgtggtcatgctgccaggttgccacagaatggctgactttgtatgtgcccagattaaaaatgatatcctgctctcagtcccacatctgggaaaatgcctgcaacttttcctggtgtctttcccttgcagagtctctaagcctctcctcaacttacctccaggtcttgggagaaacaaagtgttctcccttggtcttggttgctcagattcccagtggaaagaatgaacattcctcctacttggcagttaatattttcgactttcagaacacttttggaatacggcttgactttaaaacttttaccattaaaatatttacaacgcatgtaataggctcagaagaaagccataatcaggatatctctaaccctggcatagttcatgccttgggatatttgaccaagatgggaagaaccagagaggaaaatggatataatcatagaggggtggaccagtaaagaaatgtggcccctcgtctgtgccagttccttacctgaaaccagagaaggctagattgcagttggtgttttagctgtggataaaactttaacccagagttcctgggactcttaatgtttgctgagaatgatgatttccacatggacacaggaagggtaatatcacactccggggcctgttgtggggtggggggaggggggagggaaagcattaggagatatacctaatgtaaatgacgagttaatgggtgcagcacaccaacatggcacatgtatacatatgtaacaaacctgcacattgtgcacatgtaccctaaaacttaaagtataataataataaaataaatcaatctatgtttctattttaacaccaaataattatgttaacaaagaccacagacagcagttgcttttgcttatccttaatcacttccctaagtataaagattttggtaattcaactttaaggctatctattcctattgtgaaaaaggaccccctccccacatattcccatgtgtcaatgagggaacataaggctgatgtggtaaagactatgatgacctggtacatttcaagatgttttatggtacttaaaaccaaagggatctgaaaagggagcctggtgatagaggaggtttaaaccaaaaagactctgggttgaacgtgaccagtaattgctcaacctgcctggtttgtcaaagatcagatggttgtag

SEQ ID NO: 479660 - DNA, 536 bp, Homo sapiens
aaggttattctccctctctcgcctctcgccaagtttatgcactcttcccctgtggaccatctctttcgacaaatccagcaaaaccccacccccatcctggaaaatttcttcttcaatcgggccagccaattttccatttctccttgcctacggagctcatgcaaacttccctacgctagccggctggccctgtgcaaccttcactaccacctcccgccaaccccctccgcacctactttactgttagtggtcctcaatgccaactgccaggtgcttccaaccagctgggtacggcaggcagcaacacggggtggccccttggtggaaggacaccacctggtcaagtctttcctttctggttggatccctggcacctccagtctggcctttagcatggcactagcccccggaccctgggccttagctgaccagcagggctgtccatggatgagaccatttgatcaagccacgggacccttcacttacattggggtgttaaggagccagcagtcagagtgaggggagctcattcagga

SEQ ID NO: 479661 - DNA, 722 bp, Homo sapiens
gtttaccagtgaaattgagtaggagtggttggtggagatctgatggtttaaaagtgtgttgcactttcctgcttgctctttctctctctcctgctccgccatggtaagatgtgcttgctttcccttcgccttctgccatgattgtgagtttcctgaggcctcccagtcatgcttcctgttaagcctgtggagctgtgagtcaattaaatgtcttttcttcataaattacctagtctcaggtagatctttacagcagtgtgaaaacagactaatacagtccaatgtttttgcaggaaattatagcagttacctacttctagagatgaaagagaaaggttatcaacttcctgtcttatttccttgtccacatggagaaagaacgatcaattttaatacagtaagagtctaccaaaaatgttttacttccttaagaatgaggagcagggaaaaatatgaaccatgggtcaaaattgtaagaaggcagatttcaggctatataaaccttcaactttagagggtaatgttaaactgtttttcaaagtggttgcagaaattattactttcagactcaatgtgtaagtcatatggtgaatatacatcatctctaacattaggtttgtcagactttttaattttttgttagtgtaatatgtatgaattggtatctcattgcagtattgatttgcatttttcacaatcaccattgatattaaactctcttc

SEQ ID NO: 479662 - DNA, 3140 bp, Homo sapiens
cagcagcggctgcgttagaggcgggtggcggcgcgggtgtttacgtcaggtcgcagggtgtcgctggcagcatggcggactacctcatcagcggcggcacccgctaccagcccgaggatgggctcaccgcacagcagctctttgccagcgctgacgacctcacctacaacgatttcctgattctcgcaggattcatagacttcctagctggtgaggtggaactgacctcagccctgacccggaagatcacgctgaagacgccactgatctcctttcccacggacactgtgatagaggccgacatggccatcgcgatggctctgatgggaggtattggtttcattcaccacaactgcaccccagagttccaggccaacaaggtgcagaaggtcaagaagtttgaacagggcttcatcacagaccctgtggtactgagccccttgcacactgtgggtgatgtgctggaggccaagatgcggcatggcttctctggcatccccattactgagaccggcaccatcggcagcaagctggtgggcatcctcacctcccgagacatcgacttccttgctgagaaggaccacacaccctcctcagtgagcaagaaagggaagctgcctgttgtcaatgatcatgatgagctggtggccatcatcgcccgcacggacctgaagaagaaccgagactaccctctggcctccaaggattcccacaagcagctgctgtgcggggcagttgtgggcacctgtgaagatgacaaattccgcctgggcctgctcacccaggcgggcgtcgatgtcatagtcttggactcgtcccaagggaactcggtgtatcagattgccatggtgcgttacatcaaacagaagtacccccacctccaggtgattgggaggaatgtggtgacagcagcccaggccaagaacctgattgacgctggtgtggatgggctgcacgtgggcatgggctgcggctccatctgcatcaccctggaaatgatggcctgtggtcggacccacggcactgctgtgtacaaggtggccgagtatgcctggcgttttggtgtgcccatcatagctgatggtggcatccagaccgtggggcacgtggtcaaggccctggcccttggagcctccacagtgatgatgggctccctgctggccaccaccacggaggcctccggtgaatacttcttctcagacggggtgccgctcaagaagtatcagggcatgggctctgtggatgccatggagaagagcagtagcagccagaaacgatacttcagcgaggcggataaggtgaagttctcgcagggtatcttgggctccatccaggacaaagggtccattcagaagttcgtgccctacctcatagcgggcatccagcacagttgccaggatatcggggcccgaagcctggctgtccttcggtccatgatgtactcaggagagctcaagtttgagaaggggaccgtgtcggcccagatcgagggtggcgttcatggcctgcactcttacgagaggtggctgtactgaggagagtggtggaggccgaggtggttgaaggggcgtgccccgctttccccctttgggcacagcctccctccttaactgagtgatccacagatttacactatgggttccccagctcctttccagggagagaggacgggaggccctgagggtactgttgcccctcgctgggcatctcccacaaagtcaggaccgctccctgggccaggctgccctgggaagcccagcccagccagccaggctctcaggccctgcgcctgcctcaggtctttcttgctgcagcctgctccagcccggcccccaccccaggggcaggccgcccctcctggcttctcctgtaggacacctccctgccccccagctccccaagaaatggcactctcctggccctgcctctggcccttcccaggctgctgccccctcagccatgtggcacttctgagctcctgacctaggccagcgggaggtctctgcccgcttctccggcactgggctccaattgagtcctgctcctcaggccactcccctgtccctggccctggggaggacactgccctggtcatggccacctgcccatcgttcctgactcaccaccgtccccaggtgtgccattcctgccctctcctcagctgcagtttaaggctttaactttgcacactttgggatcacagttgcgacattgtgggtattaaataattggaataaatcaagcagatctcaacgcctccaaaaaaaaaaaatctagaataggcaaattcatagagacaaagccaaatagaagttactaaagagacaaagccgaataaaacttaccaaaggctagggagaggggagaatggggagttaatgcttaatgggtaccgagtttctgtttgggtttatgaagttttggaagcaggtagtgtgaaggttgcacaacattgtgaatgtacttaatgcaattgaattgtatgctgaaaatggttaaaatggcaaattttctgtggtatatatgttttactacaatttcaaaaaattaataatttaatataccaaatgccagagacttgtaccgtttaaatgggtgaattataccttaataaagctgttaaaaataaaattgtaaaacataattgtacagtttagttacctttgttgtaaatcaaatttccatatacgcaaagatttgtttctggaccctctattatgccatgctggtttatttttatttcaattattttcagttgtatatactgtcagtttataagtcttaatacagagtagagcaagtctcaatcttcaagcatgtcacagttcttgggactttgaattccacaaactttcagtatggaatttccataaacttttaatttgtcaagttccacaaacagacaaataaaaacaccttttcagattttgattatgattgcattgaatctgaagatcaatttgggaagtatttatatctctatagtattgaaccttccaattctggaacatggtatatttctctctctctcttttttttttttttttgtttatttttgaatatttctctcagtaatgtttaatagttttctgcaggacagcttgtgctttttttaaaaaaagtcattcctgagtagttga

SEQ ID NO: 479663 - DNA, 698 bp, Homo sapiens
ttacagactgaagtctggttgtcttccatttgagccttcattcttttctggcctacacaccagagcctatttttatttcatcgatgatgctgaagagagtgtttctaattcaggcatggagccatccctattggagtcaacaggtgtccagcacgcacgacaacatgttcatcaacaaacatgttcaccaaaaagctgcactatgggtaatggcctcaagctggcttttatcccagtgcccacccatagcagaacgcgagaagaaactgcggtgtccacacaatgagatattacacagcagcaatgagaataaacaatctacagctacacataacaacccagagggatctcataaacataatattgagtggaagaagccagatagaaaaacgcacagtggcgggggactgtggctcacgcctgtaatctcagcacttttggaggccaaggcgggcagatcacctgaggcattacatttggtttataattatgtcaattccaaagtcaaatctatactctgagaatactcaaatagaacttccatttgtttccctcatgcctgttcttttcttttcccaaagctattttttaaagcctttattatttcattttttaaacaaagaagatatgcatatatactttaagtcaaactgtgcaccttccttcaccttgtttttcagttaatgattaataatcag

SEQ ID NO: 479664 - DNA, 535 bp, Homo sapiens
aacaaccctctccagcccaggacatgccagcgcttaagtgtcttaccctcatggcttcaagatggctctaacagctcaagacactcggtcctaatcccatgttcaatgacaggaaacggggtggaaaaggtcagagtatttttcctcatgcaactttctcatcagagaaaaaatatccttccccaaatttatctaacagaatcctacttttatctcattggcaatatctggggcacatagctgcccttagtggcaaaggagactgggaaagtatccgttttttcagcttctatagtggaaaggcagccagggagaggcagcaggaatttgtgacataccacaaaactgccccaaccccttgggaacttgatttccattcacttgtggagatgagtcccctgcacttgccagacacccatgccaagtgggcagtggggcaaaaaatggagggtcattccatgaatgcgggcacaactgaaagatttccaggctttagatatcggtacattttataaggtcatgaaactaaatcttc

SEQ ID NO: 479665 - DNA, 730 bp, Homo sapiens
caggtcttcaatacgtaatcatcacatcaggatccctgaggaatcgccacactgacttccacaatggttgaactagttaacagtcccaccaacagtgggaccctgcattctttgggcccctcatcattactcaaggcccctagatctactggccccctcagtcctcctagtccctcaaccaccaccaactcctcctctcctagcttagctcccccattcctgctcacaggagccagccaactgttactggaaaggggtcccgatccagatcccaagagtgggttcctggatctcacacaagaaggaattggggaagggaagccggaagttgttcatcatgggtggggaagagaatctacaaatggcaaaagtcacacagatatcaaactagaaaagactcattccctaatcctggaattgaagctgggccaccgttgtaaaatggtgaagcctttgatgctgagctacagcattgggcagtttccattgcccttcccagaaggagcttagagcagccaattttgaacttgcaaaggcttttaacttctcaagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctac

SEQ ID NO: 479666 - DNA, 1852 bp, Homo sapiens
ccaggcctgtgataagaggggatctgtgcctgcttatgttgaaggaaaggaaagagaaaagttatgcttcattgcttgaaatatttggtgatgggacaaagaggtctcctttctgtcgtcattaccatttctccatatgaaactgataacagaaggctgaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgctaggcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaagatcagagtcgatctgagttagatttgagtgagtcatttacagaagactcagaggatactgtaagcataagaagcaagtctgtccctggggctttagacaaggtgatgatgagttgagagtaaagagaggatatacaatcatctcttcctgttagtcttcacagtcaacacataaaaaccgaaagaataacttagaaaatataatgggtaatcatgttaatgagtgaaggttatgtctaagaaaacacatgttggagatttcaatttctggctaaagtcttatcacttaatctaaacctgggaaatgagagatcctaacattttccttagccaaatattattagaaatatctgattacatatttatatcaacattgctatatctcaagttaccaccaataaattcacttctaaactgagacaaaattatgtgaaaattaatgtttcagtgaactcatttctagaatgagaaggttaaattagattattgtaaaggttatttcccagtctaatattctgatattcagatttctgtaattgctataataaaatacggactccttggaagaaatagaacacaaatgtaaaatggtattgatagtttttccaaagcacactaggaaacttagagttctaaaatgaaataatattttctatagtacaaaaaactgggaaaatactttaaaatctacctccaaaagagagatgggcagtgagattaaattatttcaaagtttactcatgttcaacctttaaagaattactaattccaacattattaaactattaaactattcgtgatcttagaaaaccattgaaatcttttcattcattgtatgcagccagtataatcttgacactcagacttgatttttaaaatagtttgaaaaataaaactacaagtcaaactagtttacgaatatacatgcaaaactttaaatataatatca

SEQ ID NO: 479667 - DNA, 2424 bp, Homo sapiens
cctctttgtctttcagcaagacacagttgtcgatgttctgagattccacccctggaagcccacagcttcttgctgacccaagttataagcaagagtgggctgggcggttccaaccaagaccaccctcctgatgtggctcgcattggctggtgtcgtttatgtgcacagccacatccccacgtttccccagacctgtcctgctcctcttcaagacccttaatattaatccagagagagaagtcgggctgctgaacagcctaggcaagttgggaagctggcaggctctagacacgaaggagcccctgaataacaaccgacccactcctgggcctgtggtgggggtcagcaagaccctgcagaagcataactcaacagtgacccagcaccaggcccacacctacttaggcatgtcactaaagccatatgatgactgctttgggctcctaaagcatccaacagaacagagtcccagagtcagtgtcccatcctcccctctgctggctcctgggacacaagaagggacacaggagctgtcggatctggcagcctctggagacagtaaatgaccagtctttgcctgtgcctgttctgcagcaatgagcagccaccacacccgctgctgccaccactgccattatgtatgtgtgcactgagcacttaccacatgccaaactctccagagccttgattccacagcgaagaagacatcactggcagagaagatggccaactaaacaagcgcttatgtgtggacagctcccagcacccacccccaatctgtggctggcacaggacctgcacatctcccgggggcagccatcatgggacattgatgcctgggggagggacaagctgatggagtcactgttctgcagctgggggaagagaagggtgagttgccttagctagatggaaagttgaaagtatctctgattggttgctttctgcaaccaataggagtgtaactttgtaacttcactttagcctctgatcagttgctttccacaaccaatcagatggactccaagtgaagtcttcttttgcatagaagtgtaactttgtaacttcactttagcctctgattggttgctttccacaaccaatcagatgcttgcatagggtgtaacctgtataacttcacttcagcttgtgattacaggccactacttcatttacatagggtgcacaacaagtaaccaatgagaaacctctagagggtatttaaatcccagaaaattctgtaaaggggctcttgagcccctgtggtcggcctgctcccactttgtggggtgttctttcgttttcaataaatctctgcttttgttgcttcattctatccttgctttgtttgtgtgttttgtccaattctttgttcaaaacaccaagaacgtggacaccctccaccagtaacacagccatcaccaccattcatctccagaactcttttcatcttgtaaaactgaaactgtgtgcctgttaaacactaactcccgattcccccatcccctgcccccattccctggcaactgccagtctactttctgcctctatgattttgactcctcttagtactttatagagacaggctgtcttttaaggaagatttttggaaactgacacgccatgcttccatatgtcccattggccagaacttagtcacatgacaacaggtagctgggaaattagtctttttcctggtggccactagggaagatattcagggacaggtagcaaagacaaatagctcagtcttacccaactatgggggttcttcaatgtaaatgctctgtaaagagctcttaggcaaagaaaagaactaaaaattaaagagccttatttttaattttagctattgatttttttttttttgcctatggctgattctttcaactctgaatgcaaagcatttgtacatatttcccctctctttctctccattgccttcttttgttacatctttgattgaatatatatatatatatactctgttacttgcagccaaaggcatttctcactgatacaggttctttgatcttccatccttccactaccaaactccttctgagagagggccacacaagctgggccctgcttttcagatgtctagtccctcttaatcccttgccaccaacctactccttcaccaggtcatagtcactttatttttttaaaacccaatggctgttgttcatatcttccttgtccactttgagtttagagttttttactgaaactcgttttccctttggtttctaggaccttggattgtatagctgactttctgtcttctgactactacttctacattttgtatacggggagcctcttcattttgcctcctcattgtaggtactttccctgcccaaagccttaacctcagtccttttatgattcaccatcactactaccacccacatcatctcc

SEQ ID NO: 479668 - DNA, 3596 bp, Homo sapiens
gcacgttgctggggaacgtgctgcttccacgtttccagcaataacaaggcacatttgctgctgcaggttcattaacgaggcctgcgggaatgaggattggcttgtccaccgtgttcactggacggtaggaaaaaagaaaagtcagaaaagggagagcgatgttcaagttcatgctcaactgtggctacttctctgaacccaagaggccaccagcccctagctgccttggccattgctggggtggggtgtgctaagatgtagcttttctttatttctccccaactgcagcattaactgggatcttgagcccccgtttctgctgatggtcgacaacttaaacttgccaagtcaaggttttctggagggcaggctcttggaggttctgcaatgggaatgcaccttccctgcaactccacggctcttggtggagaccaaggcagactgttccactccagtgggctgcgtgttctgacacaggtgagcaggggcttctggaagcacacgggagaggcacctaccccaatagggcctgctgtgtcggcttgggttgacgccttttctagaggaggtgacatctgagcaggatggtgaatgacgagtaggagttgaccagaataggagggggtggtgaagaggctggagcatgagggaagtggacatcaggaaatgcctagattttggtgtgtggcggtgggcgggtacggggctaagaatatataccaggtggctgtggaaagagagagcactgagctgccatttaagaatttggctaccctgaagctgccatgttggagagagatgcccaagaacttctggaactgcttcttggtgcccggtggtcttggtgaccttgagcacgttgaagcgtaccatcttgctcaggggccagcactcgcccactgtgatgatgtcgctgatctggatgtccctgaagcagggggacaggtttacggacatgttcttgtggtgcttctcaaggtggttgtacttgcaggtgtagtggagatagtctcggcagatgacagtcctctgcatcttcatcttggtcaccatgccaaagaggatccgccctcgaatggaggcattaccagtgaaggggcatttcttgtcaatgtaggtgccctcaatcgcctcttcaggtgtcttgaagcccagattgatgttctgtagtactgcaggagcttcttgccagtttctcccagcaggagcttcttcttgttttgaaagatggtcggctgcttttggtaggctcactccgtctgtaattcatactcagatctaagccgggggttatttcaatttatatgctctagaaggcctcccagggcctgcagaattcatcctctaaaccagaatcacccctctcacaccccagacacctttcagcgaggatcattctccaagacccaaggggctattgtctttacacgaggctagtggcttgtttcaggaagaacagtttgagagttggtcgccttcccacatgaaactgaatcatatttgtatgtaccaccaaagctgcttttacattcaatttcctcatgtgtggaaccagcggtgggttcttaattgactgcctgagggcaggctttaggaggctttgtgattatgtgtaaagttctgtggaaaagaattctctcccctcccctcccttcctcttctctctttcccccttctctcctttcctcttttcccttctcctctgcctgcttttccatccctctccccttctcctctccttccccaccctcctcttcccccctttccattttgttccccttctccattctctcccttttttcttcccccctctcccctgcccttttctgtctcctctcctttctccccttccctttttctctcttccccctcctctccctctcccgcccctcccccacatactgttttgctgtcctcagggtgacggtgacttaggccagccctggggatgggtgggagagcagctgagaatccaaaggcaggagagtgcacaaaaaagagatatggcactccccacccccagcttaatagcactcatcatgatatgtaattatgcatttgtttgtgtatctatttgtttaatgagggcagagacaatgtctattttgttcaccactaaatccctgcacatcactcaacccagagcttaacatgtggtagatgctcaacgtaaattctgttgaaggaatgaatgtaacatcattagagctttctaatctttcaccctttggggtggttcaaaaacatgaccccaaagtttcctgacactccttccaatgagaagcggggtccttctctccttgaatctggatacgctggtgacagcttcaactaagagaatgaaagggctaggtcataaaaggccacacagcttctgccctgaagccctgaatagctgtcatgtaagaactctgactaccctcagccggccatgctgagaggaggcccaattaatatgaagggacaacacataggtgcagagatccatagtcccaactgagcccagtctccaagtcatttcagcctaagtaccagatgtgtgaatgaagaagcttctggatgattccagcccccagctcttttcaagtcttctcaactgagaccccagacattgtggagcagagagatccacaatgctttggcccgtccaaattcctgacttatggaaacttcgagcataataaaaccgttgttaagctgctaaattttggagtaatttgttatgcagaaataattggaagaccttgattgtgagtttattaattctgcatttatttgaaagtcatttatcaagttcctactatgtgccaggtgatggttacacagtagcaaacaagggaaagatccctaccttccgggaacttacaatctaggggctgctgttgtaactgtatcttgcaaaagcctacatgttgctttttaacaataatgagtaggtttttctgaaaccacttccagatggtgtggggggaggggtgcttccggagccttctgtgttttgtagtagtcgccttcccagatttattgagtagctcagctgaaccaaggtctgagcattcaattaggtcttgttattcatccgttcaccaaatatttagtgagccatgtgccaggcacatttctagctgctgatacagctgtgaacaagacagatgaagcccttgcccttcgtggagctcacattttaataaatagtttggaggcggacaaagagaaaataaacagagaaacacgaacctggagcatttggctcacaacttagagttgactcatcttcagtttgacgtccctcctgctacgagttcctggctaactgacatctcttctcctcaagcagatgctaactttgagccctaccactgctgcacttttactctggctcctgtggatggctttgtgggctttgttaggttgccctagaatccattagaatggctaaaattaaaaagacagaggcaagggtgctcgggaacaggaactctcatgcattgccagtaggagtggaaaatggccactctggagaagagtttctgataaacctaaatacctatgtacctgtgaccaagcaattccactcttgggcattgaaataaaaa

SEQ ID NO: 479669 - DNA, 1104 bp, Homo sapiens
ggcttccgcatgctggagaggtggtgtatggggttgcggcttggcctgttttctgaaacctgcaaggtagcaccctgaaggtagcttgtaaccctccactctcacaccaagtgaacaaggtggagaacatatgaccttttatgatccacccaaaaatcttgcagtatcactctaccaaattctattggccgaaacagtcacaagctggcttagattcaacctaggaggggaatcagacgccccttctccactggtgggctatcaagctcatgatacagaagagcagttaaaccctgtgctaactcacagagatctgctttgtatagactttaaaggacttgatgagaaaggtgaaggactatttcaccagcctctggacttagtaattgagtttctggcactactttttgcttcaacagcctctaacgggcccatctggtggctagcatctgaggcgtactgtattccctccattcctttccacccagagagccagttaaacatttaccagcattatcactggttagatcccacagcgcgcagctgagggggcactgccaatgaccgcatcctctccccaagggggctgagactgcaccttcgtcgtgaacaggtgcagatcccctgcagatgtcaccttctttgtgaggcctttaccaacctcgaactcccctgtgtgctcccacccacccactgggtcctccactgaagcatctgtcacttacttgtttagctacagtttcccccttagggcatttcttcaacaaatatttactgaccacccatcatgtgcctggcacaagcacagggatgtgatgatgggcatgggagcttggcttctaccctcacgggacaaccagtctgcagggaagcctggtaattaaataggcaatggcaagaaactgacatgtacagtcccagagattgtttagggcaccacagggacacatggcaaagacaaccaatctcttctgggatgggggtgtccggtagggcttcctggaaaaagtaactttttaccttgaagcttctaaggtgatttcattacgtggggagttcatttcgtggggaggggctgggaaggtggggaagaaaacgacattc

SEQ ID NO: 479670 - DNA, 963 bp, Homo sapiens
ttacatcctgataaacccatcgttaaaaatattcacactgcctggcccatgttacatggatggatggatggatggatggatggatggatggatggtcagatgatggatgcatagatggatggtttggataatggatggatgaatgaatgcatgcatgggtgtatgatcagatgatggatggatggatggatggatagatggatggatggataaatggatgattggatgtttagagagtggatggatgcatacatgcatgcatgggtggatggatggatggatatcacctgccccaccccggagagtatcctcactggcccagaccctcccactggcagcatcaagagatgcaaggggaattttcaggagctgctgatggctgcattgctaatgtggctgagaagagtacctgcaaatgtcgagccacttatttctgttcattgatttcaatttgctgtgcagtcatctcctgggctcccattggcccaagcactcagagccctcttcaaggcactgctgagaggagctctggagttcctggggcaggccagtccttcatcgcagggcacagcccagagctccacggaagcaacttcaaccttcatgacggcagggaccttgtcatgcctttcttgtccagccccatatccccagaacccagaatggcgattgatcgggatccccagaagcagatcctgagatggaaattcacgtgcgagtatttgattaagggcatgctcccagtgggagatccagcagacaccagcacaggctctgcccacagcaaccagcaggcgagcaagaggctaacacaaatgcacaggcatatttaaagctgtcagtcttgttacttcttctgacttcccattgaccacaagtcacatagctcagcagtattaatgacacagtgaagttcactctgcctcctctgtcaggtgtacctgcaaagtcacattggcatgg

SEQ ID NO: 479671 - DNA, 913 bp, Homo sapiens
gacaccttcccacatgcctagactgcaaaagggaggcagagggaccctcgactcatcactgctgaaggttcctgagctggggaacatgaagctggccccatcctccttcagagaatgtcctgttggagcaggcaaagccacatggcacgcagtgggtctgtgcttggtgacctgcaggaagcaggaacgggttcaacaggggatcctgtccacggacttttgctggacacaggctcagtcacgtgggctgcattacagcgacctttacaccagcatccagaaatcagctgcagctctttcacattggaggattgaagtgaaatttatgtgcgatgtgtgggtggaagtgaagcagcagccattcctatactctcacagttgggaggaaggctggcaggcgctgtcacagctcacacgtgttgtcactgatctgtggactcaccttgctggtgtgggtggcagcagggcccacagcccctccagtgcctgccagagctcctccttcggcttctcggagttctggggctggcgtgtgtgtggctacatggtggatggcactggcctagcctgcagaacgggaaagcagaagaatggaagagtggagcgttgatagtcactacatttttcttttctgtaaaatacggaacttgaaccatattatctttaatgtttctttctatcgtaatactcagcattttattgacctcatttagtggtctccctctaaagcatacctttagagcctcccctgcccattcaaggtattttcctaaacaaagactatttcctccctgaaaggaactccattaccagacactcagataatcacctcactctgctacactgctatttaaggaggagggtagaggcagagctgcacatcagggaattcacacggggggctacttggcag

SEQ ID NO: 479672 - DNA, 4515 bp, Homo sapiens
gccccccgcgttagtgaagaatgactcaggggaagcaaaacgggtcccatttcaaaagttttcatggacccagagggttccttctctttcctctcttgctacttcatcagttgatatttgtgattaacctgctccatgaaatatgggagctcttactctggaatgcaggagaagattttagcagattatatccccctcgagtgggggatgaaggggtctgctcaaagtcatcacagtgcctttcacccttgattctacaaggacaaatttcaggcatccaaaatctctccaacatggccaggaaaaattgcaggaacacggtggtgtgcttctactgggatggctgttatggggatgttaggagcgggcgtttttgtgtctattgtgacaccccctccacaccatcttttaaaacttccactgtggcttttcttggcttaggccttgctcttcctgccacgagtttgaaattgctgcatgaagatccacctggctttaggaagctgcagtgctgtgtagcacatttattcccagtcaacgcttcgagcaactggagcacagagtttaaatgactttccctaagctgctgtaggaatgtggagcggaacaagcaaggggaccgtggacctggattctccactttgggaggccgcctgctgactccagtctcccgttccccttcccttccacctgcccgtcccacaccacaccccaccaccccctgccacctgcagctctagtgggtaacaggaggtcagagattctccttccccagtgcctcttcatgtctgggctgttcctggtgacagggaagaggcatcttgctaaatcccacaccatccgtccacaagtctggcaattttcacaagagacctagtggtctcagcccacttttcagcaacatttaatagcacaagactgttgtgcagcctcaaactactgggaagagaagtgtttgcaaatctgtggtttggagaaagctgcactcaaaacaacaattcagatcttaatttacagcccgcagattttcagggaagaggatttctggtaagatagaaattattggggctttatcccaaagtctagttcatttcctgacttttaactcttttgctgctgtctcttcaagccactgccttggctggcaaaaacaatgcacaaatgattgaggtcattcattaattcaacaaacatctacgaaacaaagtccatttatgggcattgttctaggtgtaggtgctgagaatgacaaatgaataagacttgggtccctgaccttgaggaatggtgagcctgctggggagagatgaccattatcaacacaggtgcatgctatatagcatgacagggacaacaaaagaagtagggagggggaccgttggctgcaaactagtttaaggaccaaattccagccctaagactcactttccttggcctgcagagcattaaaaaaatgtatccaacatttaaacatggaaagaactgacaaaataagtcatgatttctggcttctcttgaaacatttgaagatcaggcaattctgggcctgtgtttggagacaacagtagcacaactgatgccgagtagcggctgccccctttcgatgggactcgcaatctccagctggacgcagtgcccagacgcccaggacgtgcctgtataccctttctcactagttgtaggcatttgagtgtgcaactcttggctttgagaacagtggaagggcagagatgggatcagctacttcactggcttgggtgaattgggtgtctttgtgttgctgtcagggcaagcgaaaccgacatggccacaggcttctctgtgatctggtctctttttttctgactgtgtttccagtagcagctcctggccaccctaagcttctgtctcatacaacgacttgcacttatgggaatgggccctgctgttttatgcctctgggctgtgcagtccgctctggtaactgctagccaaatgtgcatagtttggtttaaattaaaatgaatagaaattaactaaaattaaaaatttcacttctcagataccctagccacattttaagtgcttactagtaccattttggatggtaaagatatagtacattttcatcatcgtagaaagttctagtggacagcactgctttgcggttttgcttaaactgctgctctcctttggatgaaatctaacacctggactttgagcaaccgtccttttaagagactgtttaagcatcccctttacttgaagcctttggagacatttccttctgggtgaacttgtctgcatccacctctctgtccctgatatttttccttcacacaatcacacagcacaaagaacacctagattttgtatctgcgagcttcttgtgtgtgggaactgtgtcattcatggcttgtttgtaccagaacttagcccagaggtagttctgttggcacatgatagatgctcagtaaatgtttggggcagggttgctggggctcagactcagtggcccccaaaggaacacatgatgttccagacctgtcagtgaagcgaggatgccggagaactctttttacaagctcagcctcgggtagcatgcacattcacggcaatttccagctcgagcgagctgttactgcaaacctctaagaagtcagtgtctcgcaacatcgagcaatgagcagccagccttgtggggatgaactcggagctcttgtttatcaactcgtcttttttttttccccttcccttctctgtttcctagtctgtctcatgggctcattcctgccaacccgttgaccctcactccccagcaaacacaggtaatctatatcatccgtgtttacacctcaaggtatctgggcttttcaggccaaagaattatgacagatagtaccgaatagaaacatctattaaaaataagaattcataattaaaaatgatgggaagtggtaggatgtgccctgtaaccctgcttcatgggagcaagggttgagttattttctttgtgggaaggaattccagtgttgggttccagaactgtgtcagagaagggtgacagtgatggtggctgtgacataaagccagagaaagcttgaaaggtgtgtgtgtgtgttggggtgggggggtggggatgagctctgtatgcttgggcagactttggggctcttcatcttgaaactgcaattttctcaaatttggctagagataaaaggtaatagacatttctgttaaaatgcaatatatgttgtctttgattgggttccctggaaatggactttgagatggagatatgtatgctgaaggatcttttttattaaacagctttattgaaatatgatttacatactacagaatttatctgttttaacatacagttcaaagatttttagtaaatttactgagtcatgcaaccatcactacaatccaactttagaacatttccattgctccaagaagatccctcatgcccattagcagtcactacccattttcaatcccagccccatgcaaacattaatctactttctgtttctatacacttgccttttctgggtgcttcatgtaaatggaattataaggtatgtaatctttgtgtctggattcgtttattaggcatgatgttgtagcatgtattattagtacttcatgcctttttatagctgaataatactccattctgtgaatataccacattttgtttatccatccatctgttgatggacgtttggatagtttccactttttggctattgtgaatagtactgctaagaacattcatgtacaagtctttgtgtagttgtatgttctcattcctcaggggtatatacctagctgtggaattgctggatcatatgataaatttatgtttagctttttaagaaactgccagattgttttccaaagtaagtgcaccattttacattcccactagcaattccagttcctccatatactcactaatgcttgttactgtctatctttttgattctagccatcctagtgggtgtgaagtggtatctcactgtggttttaatttacatttccctggtgactaaatgatgttgagcatcttatgtgccttttggccatttgtatatattctttgatgaaatagctattcaaattttgtgcccatctttaaaaattgggttgtctcctcattattgaattgtaagggtttaaatgtatatatttctagatacaagacctctatcagatacgtgatttgcaaatattttctcccagtttgtggcttgtcttttcactttcttagtgatgtcttttgaagtgcaaaagttttaaaatttgatataatccaatgtattagtttttcattttatggattgtacctttggtgtcataactaagaactttacctaatccaaggtcacaaagattttctcatgctttcttcaaaagttttataattttgcccttaaatttaggtctatgattcattttgagctaatttttgtgtgtagtgaaggataaggatctaaattcatgtttttgcatatggctatccaa

SEQ ID NO: 479673 - DNA, 446 bp, Homo sapiens
gggcaagccagtgcccactcatgcagggaagccttccctatgcttttgccttctgtcccctgccgctgctaccaagagtaatgtgcgcatctaccaagaacctaagccagccagcacgtgtaatcagccttcgcctacgagaggtcaaagatgaaagctatggacaaagttgtggggaagtggctagggacacaagcttccacattcccggtctgactcctttcccttcagctggtccctcttgtctctctcccagccaccttgcctccatgcccttccctccacatttggtatcctctgctgactttgaggcccagctggaggctgcactgagcagcatccctaggcatagatactgcacagtttcccctgccctgactgacagctggctggctctgcttccccaatgccaaggatggctgtgacaacctggtgggcagacacac

SEQ ID NO: 479674 - DNA, 766 bp, Homo sapiens
tcttctcctgccgtgagcccgccccacctctcagcctttgtgtggtcagttttcctctgcctagaattgatttgagatggtcacctcctcctgccagtggggccggtggtcattactgatggaattgcaattggtccccctaccaccttgtcccagttcccagcccctgggtgcagttaccatgtgtcagtcactaagtgctttacctatgctaactcagccctcacaacaacctgtgagagatgttgcttttaaccactctgacctgctgcctcttcaatgtgttgctgacatatcactgatcttccaggtccagggtgctttgaattccgcctatgtccccagtgcttcaagtcgggatctaaattcctcctcctgccagactgaacttagaatctaccagggagataccaaatttataaagaggctttccacgaataaaccgactcaggtgtctgcaaggggtcaatattggctagagccagggtggtccatctggacaggttgtggagagggaggaggaggaggtcatggcaatgcttctggggtgaaccacaatggtgcagctttgcttcttgccctctggtgggaggggctgggggacagccaccatccccagctctggatgctgcctgctctcacctgaacccctgagagtaggtcctggcatctgtctatggccttctggctatctgtctcctcagcagctctcttctctcccttgatcatcccctctgtttctgtttctctgaatcactcactctcc

SEQ ID NO: 479675 - DNA, 619 bp, Homo sapiens
agacccgactatcaggattataattgacctactgctgctctgaaatccgtcagctcattgaagccatgccccccaccagctgctctcagccaaacattgcacttccaatgagaatgcctgtttcctcacaacatcaccaatggagtatgttgtcaaaccttgagattcgttttgcccctgaatggctctttatatcgctgggcaaatcaggcttcaactgcctgagagcagtcatccaactaagaaatgtagatattggaaatgaaagccttcagggagctagaaagcatgaacatggcgaagagattgaagaggttatgggtagagcactggcggcaactactttaatgagtgactacccattccacactcacaggaggtcagcaccgtacaaaagagacatgcctaaagctgataataaaagactaaatagtaccctaaatctaagtttagatagccatctagagttgaggccagctgctccactgcaaagaatatgaactggaaattaaaaaaaaaaaacagaccctacccttcccttctcttagtatatactatgggagaactcagggagagtccgtgactctatatctgtaaagtaagccgttgtgacccttca

SEQ ID NO: 479676 - DNA, 539 bp, Homo sapiens
ttgcccagcagagcagagagagagaaagtggaaagactaacatggaagacaaaagtatagggagaggatatagagaatgggagcatgtaaccctatgttggtcgagagccattgctatgcctggtttcaagcacggactcagtcaacactgggttctgaagattttactggggacgaggaagtccatgcatcaaccatacgcttcattccaggaatggccccctgatatttcatgtcttgaggctagtcaggtcactaaaagatcacaaggacaacagtttttcactgagaactgggctaggaataggaaaattggcaataggccagttgtccctagaataaatcagagatgttcccttaaatatgagtttctgaaaagacagtggaacccctgtggcctctccaacaacctgggtcaggtcttgggcaattggttcaccgctggacctgctgcagggtaacgtgaaggtcatgcttctcattgctgaaggacaagctgcacaaaggggtcgtttcagaagtaaaactaattaactacc

SEQ ID NO: 479677 - DNA, 546 bp, Homo sapiens
ctgcaatagttatcatcatgcctaatgcccctggattcctgcagactgttacacgactctgttgactctgagtcaccggcacctgctgctgaaacagaaatctacctggaaaactgtcgctcacctaacagagttgagaaggatgttatgtcttatgttcttaagcacttcaaaaaaaaggcatttcacttccttctggtttccatggtttctgatgagaaatttgctgatattcaaattgttattatcatgtcattggatatggacaaccccagaaggttatcaaggaaactacctcttggtcacagtggttcacttcagctgaggcaatccctgaagaagcttagagctaagggctgtctgccatcagtgctcctagcaccggagacaacaagaacctcattgaagagggatctggacagtgcaccagagtggccagaacacctggatgtgcagtgagagagctaggcagcctaagcagtaggaagtacctaagatagtaggcaactaatcactcattcatgtactcattcacaaatatttatc

SEQ ID NO: 479678 - DNA, 980 bp, Homo sapiens
ttctctctccactacttctggcggcttctccctttctcctgtgttatttcatggaccagcaccttcagatgcgcccccaagctctgactgaggaattggcagcttcttctgacacaagtgagctcagcggctctccccacatcgcagaggtgatgaattgccttggagtcatcatgcctctctcttttgagtggggtccagaacaggagaaggctctgcaacaggtccaggctgctgtgcaagctgctctgccacttgggccatatgacccagtagatccaatggtgcttgaggtgtcagtggcagatagggttgctgtttggagcctttggcaggctcccataggtgaatcacagcggaggtctctaggattttggagcaaggccctgccatcttctgcaaataactactctccttttgagagacagttcttggcctgttactgggatttggtggaaactgaacgtttgactatgggtcatcaagtcaccatgagacctgaactgcctatcatgaactgggtgctttctgacccatctagccacaaagtgggtcatgcacagcagcattccatcatcaaatggaagtggtatataagtgatcgggctcaagcaggtcctgaaagcacaagtttgcagaatgaaaaagttctcaagctctttttcacaactatgtgaatatacttaacactactgaacagtatacttaacaatggttaaggtggtaaaattatgctatgtggtttttactacaatattttttaaaagacatattttactaaagattaatgaggtatacttgacaaataaaagttgtatatatttaaggaagccttccagaaagcttactcatgccccttccaagtcaatacctgccccttgtaattactactgtaacttctatgactattgattagttttatctgtccttgaatttcatattaatggaataatataataatgtctactctttttcatact

SEQ ID NO: 479679 - DNA, 499 bp, Homo sapiens
tccaccactccctggctttggacagcttcagtcattggctatgagatgctggggctggggcactttggactggggactcagttcctgttagttgaggacaatcctccagagaaggctgcagctgagcaggaatgtccacatgtgctcacgagcccgagaagtctgtacctgcagatgagtgatgagctcgtgaatgtacctgctcctccaacagcagttgcctccagaatgagtccagtgactcctcatctcctgtactatgattgggcactgagtcacactcccaaccccaccctggccctctatggcactccccaactggcgttcctgcaagctttccaaaccagggtacagagacctgtagtgggtgtctatacagggcagttggttcatgtggccaggtctacttggggatgtgaatggaagtttacttcttctgggaactttgattgttaatattgttggatttatcactctttagtgaaacaagttacttcct

SEQ ID NO: 479680 - DNA, 2126 bp, Homo sapiens
tctggctttgttctgcgatgttcagatgtgtccggagtttcttccttctggtgggttcatggtctcgctgacttcaggagtgaagctgcagaccttcgtggtgagtgttgcagctcttaaaggtggtgcgtctggagttgttcattccttccggtgggttcgtgttctcaatggcctcaggagtgaagctgcagaccttcgcggtgcctctgaaggagtgaagagcctacctggctgccttctgccactgagtaaaggatcaggaagcacagggtctgggcagttctctgccattaagtggaggaaactgctggccccactgatgatactgctggctggtgtagggtgtgggtggattgtccaactcaggacccactattgctcctgctatgaatacattgggtttgctgctattgttgggtgtggggcaggagatggattgagctctaatgctacaacctgacagcatcatacacagaataaaggatactgtatctcacctttgaggaaaatgaagataatatgaacagaactgtgttacatggctcaaacatatccctataattactaagaaggttattgatgtcaaagatgcatgattagtttaaatacaattgtttaataagggaaaaggatatttccaaattaataatttgttttatataaaatacagttttaaatatgtatatataattttattagaaaattaaatattctaagtagatctttcactcttctatttctttagaagtttatgaattcaaaatgaccaaaaactgttcttaaagattttttttcatttggataattggaggttatgttatatttgatatggacttatgtatagtgattttggtacttcagatgcccagaaagtgacagttgtgaacccatcacccagatttataaaatattaggttcttgtcacatttaccatataattcataaaagaaatagagcgcacagtgaaagtcctttgtgtacctcacttccatcgcattccctcattccttcccctagatatgggttatgtatcatttccatgcacgtctaatgagattaccacatagatatatacctgaaaacaatacatggaattaattgctctgtgaggttttaaaattacgtaaatggtaccatgctatacatataattttgcattactgatatatttggactaatttttatcagattatttcatgttttctgcttttgttatccttccaaccctctgatggattggaaaaaattcccttttgtttcctcccactgctagtttagaagatatatgctgcatttctattttttttttactaattatccttacattttcaacatgaaaatttaattataaatgttttatcaaagtctaaaagtatttaatatctttattcttctcccccaaacctttagctaccacctgataaccttctcatgttacttgttgtctagaattttagttccatccttttttaaccacacagtttatagctcttactttttaaatggtcacttgttaattaattttatcaacctatattattattatgtatttctttgctcatcgtgatttctggtagcccactcctctctgaattcacttttttacttattgaaacatatactttaattgttcatttagtgaacatcaatgggtcttttatatttgaaaatacctttatttgtcttcatctgtaaatgatattttagctgaaaatgaaaatctaggttgacaatgatttttcccttagcagtttgaagatttcactgtctctggcatctattgtagatgagaaatctgctttaagtttactactgtttttttttgaagataatttatctttttcattctagtagcttttaaaattttctctttatccataatgttctaaaatttcaatacaatttgtctaaaatttggatttatttttattcataccatttagagttggtgtgtcttttaatctgagtacttactaaccttatataattgccataatcctggaaaattctgttcctttgttttaaactccaattagttgtatgttgaagccttctctcagtcttgcttttaactggtctttcattttataactaggaatacaatgtactctttgtactctttt

SEQ ID NO: 479681 - DNA, 614 bp, Homo sapiens
aagagcgagggagggctgctagcacgttgtcacctcgcaataggttggtgcaaaagtaatggcggttttcaccattaaaaaagaatacaccttgcagaggaaagaggtctggggacatgagttcagttggaggaccctggttggggaacccaggaaacaggcagttgtaaaagatctaaagccagctgctggatgctatcactgggccgtgggaaaagaggaaacagtgagggttggacagccactgggagcacacagtttggcaactcacacagagctgtgcaccccagtcagctgtggaattagaagtatgaccgacaggatgtgtgacagggcacaagacatatgtactacaggatgtaagtttgccaaagtgcaagagaacaaggagatactatactatcactgggaagccaaaaatgaagggaacttggaaaaaagtcctcagaaaataagctggcatagaattattcaaactgacagaagtgaggaggcttaaaagaagagttgaggagggttacggggagttggatgggggatactgtcagaaaaaagggaagaaatctttctggatagtcagcatcctgagcattagagtgcacttgatacctgaa

SEQ ID NO: 479682 - DNA, 662 bp, Homo sapiens
agtcacctgagggaatctcctggtctatgggtaagagttcaacatcattttttgaatatgaatatccaggtttcccagcatgctttgttgaaaagactgtctttacctcactaaatggtctaagcatccttgtcaaaactcatttgaccataccatctcataaagaaagcaaagatttatttctgggatacctattctgtttcattggtctatatatctatcttataccagtaccacactgctttgattactatagctttgtacaccttgactctattagcccacttccttctggcctccaagtttctgatgaaaaatctgctcacagtattactgaggattccttgtatctgatgaatcacttctctcttgttgctttcaagattccccttttgtctttgtctttcaaaagtttgattataacgtgtctcattgaatcacggtaacttggggactgtatttcatttttttagagtatatagaaatggtagtttttaaatttcatcttacaaatgttcattgctaatatgtggaaacatgattgactttctatttcatcaatgtattcttaacctctcctaaaatcactcattttttaaggagttctgaattgttttgttttgttttttattctttcaggttttttatgtaaaccacaatgt

SEQ ID NO: 479683 - DNA, 577 bp, Homo sapiens
attggtgtttgtcaaggatttggagagggagtgggaagagtgttggcagtatgtatgaaaaaaaaaaagtagtctccctggaagccagtgagggaggagggaagcaggatagacaaaggggagaagccaagcaagggttgatttcaggccacgtcctcacagcctcagctgatgcagaagtggagctctgggtttttcttcttttgtaccagtcagtcattgataagggcccccttggaagacataaattcccaggcacttctgactccccgtggcagcaagcaaagaagctccaggaacccctgggcaatctccagagtctttactgtgtgtcatcagaaacaagagcccatataagccaggaaggggctagtaaaaaagatcataggtctagagggagtaccgagagcacacaagatgggtacaaaaaatacactggaatgatatttaacaaatttgtgattttcattgagaggtaggagagggaacaggcttttatctttctataatattttatttatttatttattttgaaaaggtgatgcccaaatcataaatacaaaaaatagccaattcc

SEQ ID NO: 479684 - DNA, 597 bp, Homo sapiens
aacattctctctctctctctctctctctctctccctctctctcccgacactgtggtgggagtgacccgattttccaggtgccatctgtcaccccttcccttggctaggaaaggaagttccctgaccccttgtacttcccgggtgaagcgatgcctcgccctgctttggctcatactcggtgggctgcacccactgtcctgcccccactgtccgacgagccccatgcttccaaatgtggactacaaaaagttcctgagtatttttacaagagcaaattcgatgtcattgatggtgtaagatcttctgcaagaaatcagtggcttagacacctgctgttactgcatcctcctagaattgagtatcagaaatgccaaaagcgtttcagcatttcaacttcccaagtgctgctagtttctgaaatatcttgcaaatggccgccccagctcttgctggtgtgtgcacgtgcacacacaggcacactcacgtgctttcctacaccaggtgctgctccaacaaaactcaatcctcatcccagcttaagtctggagggctgagatgattgttttaaggaggctgttgccaggacagaattttcca

SEQ ID NO: 479685 - DNA, 1436 bp, Homo sapiens
ttcaaggaaccagagtcagctgtcttcttacccctcacacattagaaaagcatttgaaatgctccgaagtggactccttggagcagatactttcaacctggtccatagagtcctagagtggcagctctcagggagtggttcccagacacagcagcatcagcatcatcagaacctgttagaagtgcaagttctcaggcccaaggctatggctgccatagataattattcttccaatggatttgggcaaagtaaattgaaaaccttctggaaaggattcaccattctagatgttcttaagaacatttgtgacacacgggaggaggtaaaaatatcaatactaacaggagtttggaagaagttgattccagccctcatggatgactttgaggggttcaagacttcagtggaggaagtcactgcagatgtgatggaaatagcaagagaactggaattagacctggagcctgaagatgatttgaatgtgggatacagcttagggtgttagtggctttaggctaaggtttgttacatatgtatacatgtgccacgttggtgtactgcacccattaactcgtcatttagcattagcagcccttcagggaagaagcagttattctgagaaggtttgggaactgaagatgaccaattcccaaaccttacagaaaactagtgctaagacagcaggtttagcactggttgtacaaggttgaaacactagatgctgaattttccctcagtcagtctaatttctaggcaaataatctggtccctcatgaaatttgttgtggcaatcaaagatgtctccagacattgcaaaatgtcccccctggggtcggggagaaagaaggggggcaatgtaaaagaagtccaaggctgttttggtggctgcacaatataactaatatcttaggttctgtctatgttttgtgactgtatcatccttaatgtgcagctgttaatcttgaggttacgtcctggtgggaagagggctgctgcagctccagccatgtttcaggcaagaaaaaggagatggatgaataattatgtattcaaattgctgcaaaatgaaggtgacatttttgtagactattttcccagtttatcaatgatcttaatggtgaaaaaatgcaatccaggggaagaaactgtcagagtaggagagacaagaatatttcaacctagattttgtccattgcatgccctagaatcagaaattccctttgttctattaatacagggaagaaaaaaatatgcattgaacaagaagtcacctttacagttttcagatccagggaacgaggggaaggtcaagtggagcaaacacactggttatggtttggtaggttgcaggaaacctgtgttgatgaaaagaatcaaactctgtaaaatatttgaagagatttattctgagccaaatatgagtgaccgtggcctgc

SEQ ID NO: 479686 - DNA, 759 bp, Homo sapiens
tgccttttcttcccatatcttttggtttaaaattgtgtgggacttccccatttgctctctctctctctctctctctctttctctctctctctctctctctctctttctctctctctctctctctctctttctctctctctctctctctctctctctcctctgttagcagtggtcagatattatgagaatattatgtctgccctggggatttgaaattggtatcggcaatttggaaagggtacagaatgtgataaaggtcttaggaaataggtgcaccgagcaagggttaaaggtccaacactggacgtgccccattaaaacccagtactgggcaggcccctatgaccccagactccaggctttacctgagattgagcttcccaaggtctgtcacaggaaccaactaggatcctgcagccccaggcatcagatgagctgcactaccaccaggctgacaccagtagccccaggctcagtataccaaaacctgtgggacagagaaaaagtagttctgagagggaagtgtataccaataattgcttacattaaaaatgaagaaatagtttactacgaatttaaagggtacatgaatatttgggaaatttgactataaccactgtagggataagtcagctattctgattagtaggaaggagtcacattctcagtgctacaaaattgtcctactttaagttattcactgtgggaggaagatacctttcttccaaggttgaataatacatatagtctgtgctgcct

SEQ ID NO: 479687 - DNA, 643 bp, Homo sapiens
caaggcatgaacgtcccatggctccaccccgttctcctggtgcacaggcgggtcagagattatctggggaccctccaccttatctgccacctgcatctatcactttgagggaaccctcatgccttttcttcccatgcctgacagcattctccaacctggcggggagctctggagcaacaattgcttatcatactgtcctgatttgggccaaaatggtcaggcctttatgcctgccactgacccagccaccagatgtgggctgccctcagaagtatgcgactttgataaagcatggctgcggaggctttgggaaacctacaatcatggcagaagaggaagtaaacaggtccttctcgacatggcagcagcagggagaagtgtcaagcaaaagggggaaagccccttatgaaaccttcagatctcgtgagaacgcactatcacgagaaaagcagcatggggataaccaccccatgattcaattacttcccacaggatccctcccacaacacgtgaggattatgggaactacaattcaagttccttgaggtataaagttaggttgtttatttgagatctttctgcttttttaagttttagggtacatgtgcacaatgtgcagattagttacatatgtatacatgtg

SEQ ID NO: 479688 - DNA, 643 bp, Homo sapiens
taggtgtgtagtaggctataccatttaggtttgtggctctaatgttcaggctcaattggagtcccgagggtattttaacacctaaagcctctgactataaatgtgtccctcgggtattctcagttatttcagggaagtgtcagttgctcattgtacaagaagcaattatccccacgcagaaaatagttcaaagaaagaaaggaagaaacctagttagtgaaacaaaggaccgaaagaagaaagcttacaaggaaatgaaaattaaaaagtacattgcaaaaagtgcaatgatatatatttactatttattttatattcaaaagataaatacagatatagtggcatatagttatagtcatctatctctacatttgcatccatatttttatcccacccacatatgcgtacatatccagatccacatttctgtccttatctgtgtctatttcgcttttatacaaatgatatactcactgactcataaagtcataagtaatatggtacacatgttattcatgaatatgcctgacaaatagtaggacatgtgtacttattgttcttatgcccatgggccaatcagtcttatgtccatgtccatatgtcttacgtccatgggccaatcagtccatgaaaaacaaaataa

SEQ ID NO: 479689 - DNA, 3273 bp, Homo sapiens
accggaagcagtgccgtggagaacagacctgacggggcgaggccagaggacgctatggcaggcctgaggtacagtgtaaaagtctatgtcctgaacgaagacgaggaatggaacaatctaggcaccggtcaggtctcatccacctatgacgagcagttccagggcatgtcgctgcttgttcggtcagattcagatgggtcggtcatcctgcggtcacagatacctccagacaggccctatgggaaataccaagagacactaattgtttggtatgaagctgagaaccagggtttggtgctaaaattccaggacccagccggctgccaggatatttggaaagaaatttgccaagctcaaggtaaggatccgtctatccaaaccacagtgaacatttcagatgaaccagaggaagactttaatgaaatgtcagtaattagtaatatggttgtgctgcctgactgtgaactcaatacacttgatcaaattgctgacatagttacctcagttttctcgtcacctgttacggatagggaaagactggctgagatcttgaaaaatgaggcttatattccaaaactactgcaactgttccacacttgtgaaaatctagagaatactgaaggtttacaccatttgtatgaaattattaagggaattttgttcctcaacgaggcatgtctgtttgagataatgttttctgacgagtgtatcatggatgtggtgggatgccttgagtatgaccctgctttggatcagccaaaaaggcatagggacttcttgaccaacgatgcgaagttcaaggaagttataccaataactaactctgaacttaggcaaaaaatacatcagacatacagattacagtacatttatgacattcttttgcctgtgccttccatatttgaagataattttctttctacacttacaacttttattttctccaacaaggctgagatagcattacagcctcaaagcaaggatgcactatttgaaacgttgatacagttgggagttcttcctgctcttaaaatcgtaatgatcagggatgatttgcaagtaaggtcagctgctgcagttatatgtgcttatctagtggagtacagtccatccaggatccgagaatttataatttcagaagctcacgtgtgcaaagatagtgaccttttcattaatgtaataattaaacaaatgatctgtgatactgatcctgagttaggaggtgctgttcatttgatggtagttctgcatactctacttgatccacgcaacatgctgacaacacctgagaaaagtgaaagaagtgaatttctacatttcttctacaaacattgcatgcataaatttacagcaccacttttggctgccacctcagaacacaactgtgaggaggatgatatagctggatatgacaaaagcaaaaattgccccaatgataatcaaacagcacaactgcttgctttgatattagagctacttacattttgtatacaacatcatacattctacataagaagctatatcttgaacaaagacttgctaagaaaggccttgatattgatgaattcaaagcatactcacctgattttgtgtgttcttcgctttatgagaaggatgatttgccttaatgatgaagcttataataattacatcatcaagggaaatctttttgagccagttgtaaatgctcttctagataatggaactcggtacaatatgttgaattcagctattcttgagctatttgaatacataagagtggaaaatatcaagcctcttgtttcacatatagttgaaaagttttataacacacttgaatcgattgaatatgttcagacattcaaaggattgaagattaaatatgaaaaagagagagacagacaaagtcaaatacaaaagaatttacattctgtactgcaaaatatagtagttttcagaggtaccatagaagaaattgggctggaagaagaaatatgttttatggaagatgcaggagaagtagttatgccaccactggaagatgacgatgaatttatggagaccaaaagaacccaagaaggagaagcagttatgccaccactggaagatgacgataaatttacggagaccaaaagaacccaccaagaaggagaagcagttatgccaccactggaagatgacgatgaatttatggagactaaaagaaaccaagaacatgaaggcaaggtagactctcccaaaagaacatcttctggtgacttcaaattctcttcatcttattctgcttgtgctgctattggaacaggtagcccaagtggtagcagtgtggttcgtttagtggatcatccagatgatgaagaagaaaaagaggaagatgaagaagaaaaagaggaagataaagaagatgaaacatcccccaagaagaaacctcatcttagctcctaaaatctatatggggcaccctcaaaatgtggctcaacaaaaattctataaacgtccataagctaaaaagactgattccacaagctttttcatgtgaacttataatgataaatcacagatataacgagttaagagggtttaattctgtaaaaacaaaatttctcataatcttaaaaaaaaacagtaaccagaacctgggtgataaactttttagcaagaaagtcttaatttgtgtcacgatttgggggaggaaaccatctttgggaaggaaagtcttagtttggaatggggaagaaccaggtcgataatgttaatgtagttttgttctagaggtatatattagaaataataacagttcagttaaaagcctacaaattacttgtataatggtactagccatggtattctttccttcagttacctttttaacacaaaagtttatgtttatatgaaaaacaaagttaactataaaaaatgttagtctcttcagacatttctataaagatataacaaaatttaagcttataagtaattggaaggaagtagctttcagagtgtactttcattcattaaaaaagcaagctggatttacaatgtgtggttatttgtttttattaaaacaatagaaatgtattctctcactgttctggaggctggaagtccaaaatcaaggtgtcagcaaggccatgacccctcagacactggatagcatccttccttgccttttcctagcttccttccatgggtggccatggattcttggaggtgattggcttgtaggtgtattagtccaaactttgcctgtgtggtcacatggcattcttcttgtgtctatgtggttgtttatataac

SEQ ID NO: 479690 - DNA, 1602 bp, Homo sapiens
aaatacactgcctttctagaagaagaggagcagaaacctaactgttgacaagggtatgtcatggctaattcgaaaaaccctgttgaaattgaaattatggtgttcagttcaacgctaaatatgccagatgttggagataacaaggtgaataaatcaatggcttgctcttctctgataaaggcggttgagttctgtgaagtagtgagaggtatccaaagaagacagtgccattatctctaccctcaaagagctaacgatgtctggaaccaaaggagaagaagtgacagcaaacatgaccacagaagaaaagtcttcaaatgttcccaacagatagaaatgataaatgctctgagtcagtggtccccaacgtttttggcaccagagaacggttttgtagaagacaatttttctacggactgggtagaggggtggtttcaagatgaaactcttccatctctgatcatcaagcattaaattctcataaggagcacacaacctacatcctttgcgtgtgcagttcacaatagggttcacgcttctatgagaatctaatgctgccactgatctgacagaaggcggagctcaggcagtaatgctccctggccactcacctcctgctgtgtggcctggttcctaacaggccacagacaggtaccagtacatgacccagagattgaggactcctgttgtaggtgatggacacccccaaataccctgacttgatcattacacagtctatgcatataacaaaatatcttgtgtagcctatacatatgtatcaattattatgtgtccacgaaaataaaataaaatctttgcacagagggaaaatgactgtataaatgaagtaaaatatatttatcaaagttctggatcacattgttatttttagaataaaatgtacttaagcaattaggggggaaaacctgttcagtgaataaagttgaatgaggaaaaatacaaacagatattcaaaacttcaaaataagtgtataaaacaattattttaaccacattactgattaattcgcgtgtgaattatattatgagccaagaaaagcctgtatcattttagtagaatattctaacagtaagtgactctatctcttaaaaatactgagcacacatggatatttgaaaggatatttttgaagctgcttaaaattaatggacattaaactccctcatgctttgtttcatcaataaaactgtggagctcattaacaaaaaccagaaacttagctctctgaatcaggaaatttataaagtgtagccactagtgcatatctatgagtttctgagttaactaaaaattaaatattattgaaaaaaagaaaagcaagctcttcataaattattaatttatacttttactagtcttcatattagaatgattcaggttttctcacctgatatataacttctatcccctcctattttaccttagttaaatggtttaattttaaaataagcattttccttcatttattatgttcctgtccatatagaaacctgttctataattttatcatatttttaataatttcctttttcagatgtgtttatgccctttgctcattttttaatggggtcattaataat

SEQ ID NO: 479691 - DNA, 1247 bp, Homo sapiens
agcagggaaatgaggggactgaaatgaggggtcacgggatcacctgcctttttggctgctgcacctgaacagagtcatcatgcctcgaggtcagaagagtaaactccgtgccagggaaaaacgccgtcaggcccgaggagggctggaagatttgatagatgctctggacattttagaagaggaggaagaatctcccccctctgcctctgcttgtttgaaggatgttttccagagttcacttgatggggcatccaacaatccccatggacttcgggaagcccaatccaccagcacatctgctacagctgcttcacacacaagacatcccgaaggagtcaacgaccaaatggaagaaaggccaatatgcacacaagatctagaagccactgatagctttcccagaggccctgtagatgagaaagtaattatattggtgcattacttgctgtacaagtaccaaatgaaagagcccattacaaaggcagatatgctgagaaatgtaacccaaatgtccaagagccagttccctgtaatcctgagcagagcttctgagcacctggagctgatctttggtcttgacctgaaggaagtggagcctaataagcacatctatgtccttgtcaacaaactagatctaggctgtgatgcaaagctgagtgatgaaacaggcgtgcccaagactggcctgctgatgactgtcctgggtattatcttcacaaatggcaattgtgtcgctgaggaggaagtctggaaagtgtttaacacgatggggttatatgacggaattgagcacttcatgtttggggagcccaggaagctccttaccaaagatttggtgaaagaaaattacctggagtaccagcaagtgcccaacagtgatcctccacgctatcaattcctatggggcccaagagcccatgctgaaaccagcaagatgaaagttcttgagtttttggccaaggtaaatgatacagctcccagtgaattctcaaactggtatacagaggctttacaagatgaggaagagagagccagagccagagttgcaccaaggctcgcgttagtgccacagccggtgcacgttccaaggttaagtccagcaagtcctcccaactgcagtaaagtctgagggagattcttcatttgtgtttgaaaagaaatgcacattctgagctgtgggaggtcagggtgggactggagacaacacagtgaataatatgtttgtgttaatgttctatgtgatggct

SEQ ID NO: 479692 - DNA, 925 bp, Homo sapiens
tgcagttcctgctgcgcaagtacaacatgaaggagcccataacaaagcataacatgctaaagtatgtcatcaaaaaggacaaggcacacttccatgagatcctcaagaaaacctctgaggtcatggtgctggcctttggcattgatgtgaaggaagtccatccaaccaggcactactatacccttatcagcaaattgaatcgcacctgtgaggcaaggctgagtggtgaggagatcatgcccaagactggcctcctgatgactatcctgtgtgtgatctttatgaagggcaactgtgccactgaggaagatatcttgcaggtgcttaataaagaaccactatttctatggggagcccaagaagctcatcacccaaaatttcgtgtaaaggaaagacacctggagcaccggcaggtactcaacagtgatcctgtgcggtatgaatttctgcggggtcccagagcccatgcagaaaccagtaagatgagaatccttgagtttttggccaagatccatgatactgtccccagttcctttccatctttgtatgaagaagctttgcgagatgaagaagagagagtccgaggcagatttgcagctatgcttcctactagtgccagggccagtgcacgttccagggtcaattccagcagcttcacccctagagaagtctgaagcactttcctcactttgaagagaacactcaatcttttaattagtgggggaccctggcggtgttagagggaacatagtacgtattatatctgtattcctgttctacgtgagtaacttgtacacttatcttttgttttcgttgaaagttttcaaatgttatttattttataaaaaggttaattagctttagaatctagctgtatgaataatattggttacatatttaatgttgtttatgacactttagagtt

SEQ ID NO: 479693 - DNA, 779 bp, Homo sapiens
tctgtttcaactctagcttgtaggcagcaggagcagagactttggcaacgacaatggctgaaagcctttcacttgttattgggaactccaccccagagaaatgcggagccactgctaattggaatgatcagctggggatggagtggcacattacaggtctaagcgaggagtccctacattgtgaagagcaggggagtgggaagctcatgggtgagacactctggcctcctgtctgcaggacagctgcagcatgctggaggtgcaagcaaagtaatcagggtctttactccccagcccaagggcagcaagggcatgtaccatggcaatggtcaaggcagaggggctgccaagtacatcaagggcaggtgtcaatacaacggcaatggcagagagcctgttggttgtctctgggaattctaccccaaagaaacacagagcttccagtgactgaagtaatcagaaggactgtcactgtgccccttgttataatggatgagacaaaatggatagaaaataaagaatgatagctattctgaagaattctggcacttcatatgattgatcccaaaagcaacctggagtgtgttgtttagaacaagattataaatatctttcatcttcacattttttatactagaaaagatgtttaaggaatcctagtcatgataggatattgtatgtcacttccaaaaatgtgtgaacatacttacttttacaaatatgtttatgtgttcaaaataattatcttcccttttctcagtaaagattaacagccttga

SEQ ID NO: 479694 - DNA, 1887 bp, Homo sapiens
ctgggtagaatgagttacttcctgtcttactgcaaagctcatggcggcgcgctgctcaccggctaccaggccctgcgcgccgagggcttcctgtgcgacgtgacactggagaccgagggcagcgaattcccggcgcacaggtcgctcctggcgtgctccagtgactacttcagggccctgttcaagagccacacccaggaatcccgggcgcgcgtgatccacctgcacgtgccatcggcagccggcctgcagcgcctgctggacttcatctacactgcctggctgtcgctttccatggacactgtagaggacactctggaggccgccagctacctgcaggtcactgaggccctggggctctgtgggcgctacttggagcgccagctggctccagagaactgctgcttcgccgccaacgtggcagcgcgctttggcctggctcacacgctggacgcggccgagcgctgcatcgtgagccacttgcaggagctgctggcgcggggcgcgggccccgcgggactcctggagctcaaccctacatcgctgagggctgtactgggtgcccccgacgtggcgcgggtgcccgaggcccggctactgggcctggcgttagcttggttgcggcaggagcccacaactgagcgcctggcacactgtacagagttgctggagcgtgtccgctttggcctggttcccgccgacgtactgcggcgcgtgtactcgggctctggcctcgtgctgcccgcccgggtcaagggcctcatcatccaggccctcaactaccacacgacgccctcccgccagccgctcatgcagggcgagcagaccagcatccggagcccccagacccgcatcttgttggtgggggggcgcagggcacgggaggtggtgattgaggaggtcgcggccccgcagagggcagctaggggccaggtcgccgccccagagcccgaggaagaagaggaagagttggaggaagaggaggaggaggaggagtgggagctcacccagaacgtggtggccttcgatgtgtacaatcaccgctggcgcagccttacgcagctacccacaccactgctggggcacagcgtgtgcaccgcgggcaacttcctgtttgtcctgggtggggagagcccttccggcagtgcatcctctcccctggccgacgactcgcgggtggtcacggcccaagtgcaccgttacgacccgcgcttccacgcttggacggaagtgcccgccatgcgggaagcgcgggcccacttctggtgcggcgcggtgggcgagaggctcctggccgtcgggggcctgggtgcgggcggtgaggtgctggcctcggtggagatgtacgacctgcgtcgggaccgctggacggcggctggggcactaccgcgggctctgcacgggcggacgagcagcctccgggacttatacgtcctgggccctgaggagcaggtttggagcaagaaggcacccatgggcaccgcacgtttcgggcaccacatggcagtgctgcgcggcgctgtgtttgcttttctggggcgatacgagcccttctctgagatcgagcgctacgaccccggcgccgaccagtggactcggttgcggccgctgccctacgaccgcttctgctatgggctggccgtggtcgaggagacagcgttgctgctgggcggcctcaagtggcgggactcgcgccaggtgcctacccgcaacgtagtgggctacgacctcgacctggaccgttgggaggacatcggctgcgcgttgccctgggcctggagcggcctgcggtgcgcagtgctgcagctggccgagggtggggacgacgagagggagggagaggttggagaggcgctagatttggtgctgggctgaatgggtcagtcc

SEQ ID NO: 479695 - DNA, 579 bp, Homo sapiens
ggctttaccaaaatgaccctgaagacaaagcgcaatcaaaacaatggctactgaaagggggaagtggtccagtcaaagcaaaaggagacccggggtggctctggaccctaagaataaactgcttcttttccacagaagtgaccatgtctgggatggaaatgcagggaaagacaaagatgaactttttacattttacaaacaaaaaggcaattcatttcatttagttgtgcaagagatgagattcaggaaggtgcacatcaaaatgctagagcaagaatccctcaccttgattattgaaaaatcaattagctcttataatcacttgggagctgtttgccagtcttgctccctctttcaaaaagcacccaacacaacaagaaatgatgtatggtggtcttcctgcattctgatactgtcagtaggaatgggatggagtcatttgggaagttgtgatatccttttaaatggagacgtctatcaaggaagagagttgatagttcagtatgggacagctttctaaaggtcaccctgtttaacatgcgtgagttgtaatagctgggaattaaggtggcctgaagc

SEQ ID NO: 479696 - DNA, 774 bp, Homo sapiens
gtctagatatcccttcaactctaagctacacagtagagaaacccgggaccgggatcatggcagctgagacttggaacgtggccgaagcagaggccccgcagccccagaagcgctactaccggcaatgtgctcaatccaaccccatggcagaccacacgctgcgctatcctgtgaagccagaggaaatggactggtctgagctatacccagagttcttcgctccactcactcaaaatcagagccacgatgacccaaaggataagaaagaaaagagagctcaggcccaagcggagtctgcagacataggctgtggctatggtggcctgttagtggaactatcaccactgttcccagacacactgattctgggtctggagatccaggtgaaggtctcagactatgtacaagaccggatttgggccctacgcgccatcctggagataaagcacaagcgccaaatcatcagtcccactctgctagcaaaatatgcctacgtgctgagagttggggggttggtatatacgataacccatgtgctggagctacacgactggatgtgcactcattttgaagagcacccgctgtttgagcgtatgcctgtggaggacctgagtgaagactccattgtgggacatctaggtacctcaactgaggaggggaagaaagttctacgtaatggagggaagaatttcccagccatctttcgaagaatacaagatcccgtcctccaggcagtgaccccccaaaccagcctgcctggtcactgactgctta

SEQ ID NO: 479697 - DNA, 1042 bp, Homo sapiens
caaacatggtatctcactggggacatttttggcagccacaactgaagtgggaggagccgtgtgctcctggcattgagtgggtagaggccagggctgctgctgaacatcctacagtgcacaggacagctccctccccactcctacctcccgggacaatgaacatttcggcccaaaatatcagtacaatagtgctgaagacctgtgaagatgttgctttacgtgacaaaagagattttgcagatgtgattagattagggatcctaagatcgtggggagatgatcctgggtggccccagtgggcccagtgtcgtcacaaggatcattataaaagggaggcaggagggtcagagtcagagaagattggcaatggaagcagagatcagagagggagatttgaagctgctacactgctggccttgaagatggaggatagggccataagcgaacaaatgcaagtggcctctagaagctggaagaggccaggaaacagaatctctccactagcctatggaaggaacacagccctgctggcacttgattttagcccattcacacccagtttagacttctaccctccagaaaaggaaaaggatgaatatgtgttgttttaagccgctaagtacagcagccattggaaacgaacagagccttggctcattgattcatccgattcctatttacggagccctccgtctgcaccaggcagaatgcaaggcccgagggtcagccacgctcgggagtgactgtgtccctctgctgagtccctcttacagtccatggggaagacagtcatgaaacaggtcttcccaatcaagagtggggaatccctgatgagagaagtgttgagtgatgtggaaaaataccgctaggggttgaattatgtactcccaaattcatatgttgaagtctcaactccccagtacctcagaatgtgactatatttggagataagttctttaaagaagtggttatgttttcacatcaggccgctagggtggggccctagtcccatctgactggtgtccctatgaaaaaaaaaaaa

SEQ ID NO: 479698 - DNA, 1551 bp, Homo sapiens
ctgggagactggggttcctggcatttagtggggaacgaggtagcctgtgctggttccatgcacacatctgaccaaagatcgcagggctcggttcagagacacagactgtgtgttcttcacagcagaaagcagtagctctgcaagctcctgggttggtccccaccatcccgattcccatgggccacgcagagggccaggtgctcgcctgcagctgtgcaggttgcgccgcaggaggggagccctgaattgggagctggagctttccttgaggtgacttcatgacctgccgtcctcccctccatagacatgacctggaatgtcactcgctgcccaggggctgagggaaaagctctcttgggctgtaacgctggaagaagacctagctgaaatcacggatggaagccgggctgggtatcctttggcattcacgccccggggctccatgtcctgtgagaggggatctggctcccggggtctatggcaagaccatcgtccccagaacgtgcagaagcaggccgagctgaaggggagggcagagaatcggattccccagggcacagtgaagctggtaccacgcacccacgaggacgcccctaccatagacttccaggctgctccaaagctcgctcagcgcccactgcccctgggccgccacccccgcctccgggaggaagggccccaggccggtagctctgcagccgcgggcgcagtcagagccgctctgctctcacagcgctgcggtgccgcggggccctgtcccagctgcctccttccgcgggctcagctgtctccacgaaaacccacgactgttccgagtggcatctggaacagtgagtcctttccgttggattggcccagatgcatcagaggaatcgctctctatggcggctatagctttatgaaatggacttcttcaacaataagacttgaaaggggagatgatccgtggagccatgggctgcagaatgcatgttgtgctcgcaggcctgaaaacaatgtgaatctccctggagctctccctcagagctcttgggtgaccaggtgccttgtcaatgggtagtagcatttgaaaaggaatcttttttctgagcagtacttctcaacagtgggcttaaaacactcggtaaaccagtaaaccatgctctagacagacgtgctgtcatccgggctttgttccatttctagagcacaggcagagtagatttagcatcattcttaagggccttaggatttttggaacggcaaatgagtgtcggcttcaatttaaagtcaccagctgcattagcccctgacaagaggcagcctgtcctttgaagctgtgaagcctctccagggtggtgattgctgaaggctgggttggctatggcaatttcttaaaataacacagcaaggaagtttgctgcatcaattggctctacctttcacaaaagatttctctgtagcatgcgatgctttttgatagcattttactcacattagaacttctttcaaaagtagagtcaatcttttcaagccctgttactggtttatcaactaggttgacataatatt

SEQ ID NO: 479699 - DNA, 2599 bp, Homo sapiens
gttcacggtggtatggctgtagattgttcacgatgtttctggccctgagcagtacaaggttggtgtactttctggagttcaatgatcgcattcacgaagttccttccatccaataccctcttctacctccaggaagattccagatacctgacctagcattacatttccaaaataatgggatgatttatccagagtactcccgaataaatagcgtgaatgttcccggtcctgcttgcaagcataagctaccagtgagcttgtttcaggctgtgagaatgaagaaggacagccggaagcaatggtgttcttctcagctggatcccgatgtgtcgaatggctgggccattgagtgcttcaacaatacgcagcttaagcggaacaaagcattcaggaagttccttctatccaacaatgaaacaggccccaacctgggcccaatcgcatctactctgtacttcagagaccagacaagattgggagcgttcacggtgctggaacccgatgtggtccgtgtgcagcctgacactcgaaactcattcatcttcctttctaagtcctttcacatggagtccaacccttgggcagaaccccagattttcttcagtacttcacatgttctctcgttggcctgttccagatccctcttcatgttgcagcacaccaaggctttggattcctccagcactattcgattacatgagacaagcttcttgatctgagccaccaatttcctgagtgaaggtccaggacccaaacagctgggagagaaggccgttgccaaatgccttctgtgtgatcagtttcaacccactgagcatcgtctcgcttgcagctggtcgtcccatgatttcggaaacgtaatggtaaatcagctgtctggaatctgctcagaggtagaagaggttgttggaaaccaagtcttttgattagcctaaaccatatcataaaggggcaatacggatgcttctagtcgaatggctgggatagtgactgcttcaataatattcagtttgagtgaaatgatagccttcacgaagttcctcccatccaagtactgaagaggccgtaccctgggcgcaatctcgtgtactctgtacttcagtgaccagatgagattggagcgttcactgtgctatggccgtagattatgtacgacgtttctggtagcttctcttctgccattttaatgctttctctttttgtatcatattcagggtcgtatggtcatagattattcatgatgtttcagataacttcttttacttcagtaacaggttttttgaacggagtaatagtattcacaaagttccttgtgtccatgcactatacagggcagatactgcttagcttctgatatccgaagaaatcgtgcctatttcgggtggtatggccagggattattcacgaagtttctgttagcttctgcctatttaacactttctttttttctgtcactttcagagtgatatggccatagattattcacgacgtttctgataggttctcccattttaatgctttctctttttctgtcatctgtcaaacactgcataaaataaataaagtcaagtccacaacagaagacactgttaaaggcgctgagcagtacaagcttgctgtaatcagcagtggttgtcagagctggtagacttttttcattacagctgtatttactgagttattccctgttgatctagtgaataagatgtgggtgaagccatcttttgtcccggccacaataactctgtatccttaggcactttctgtttgcctcacactgaaatgcaatcgtttgttaaaaggctgttctcttctgttgtcaataaatttccttttgctgacagttactgctgtaacagatgtctgtatgttggttgtcccactggctgttaatgcatccatgaatgtagatgtagctttcctgttaacgagtaggcctgtggccatggctgcacttacggggccatgcacctgaggcactagcaggtgtatccaggcttgctccccatcctggcctgctcagtaccagggcccaataaagctttgtctggcttttccgctgccactttgggtactaccattcctcctgaccctgctctgtggggtccagttttttggagctctcactctgaaagccattcactgcgtcctgcttaatggggctcttaggcatgaggatcttgatacctgacttcactaggtccattttcatctggctgcagagagacggagctgtgttcttcctgaactgctggctggcagcaaacagctggctgtttttggattcgtgatctctcccaatcactggtgccttaggagaggacttagaaaagctgctgtttgtggatctggagatttgtttcctagcattgttgggagaggacctgtttgttctggtcaatgtgctctctttctgcctttccgtgtggtgtctgttgaagtcgtggatgtattcctgacagttcacgaggtgctgctctggttcccaagtgtcgtcctcgctgttgtagccttttcactgaaccaaatactctgtcttccctttttaatttttccttttgtcaacaatcttttcaatctaacctgccttagttggcat

SEQ ID NO: 479700 - DNA, 4510 bp, Homo sapiens
gttcacggtggtatggctgtagattgttcacgatgtttctggccctgagcagtacaaggttggtgtactttctggagttcaatgatcgcattcacgaagttccttccatccaataccctcttctacctccaggaagattccagatacctgacctagcattacatttccgaaataatgggatgatttatccagagtactcccgaataaatagcgtgaatgttcccggtcctgcttgcaagcataagctaccagtgagcttgtttcaggctgtgagaatgaagaaggacagccggaagcaatggtgttcttctcagctggatcccgatgtgtcgaatggctgggccattgagtgcttcaacaatacgcagcttaagctgaacaaagcattcaggaagttccttctatccaacaatgaaacaggcccgaacctgggcccaattgcatctactctgtacttcagagaccaggcaagattgggagccctaaaccataacacaaggaggcaatacggatgctcctggtcgaatggctgggccattgagtgcttcaacaatacgcagcttaagcggaacaaagcattcaggaagttccttctatccaacaatgaaacaggccccaacctgggcccaatcgcatctactctgtacttcagagaccagacaatattgggagcgttcacggtggccctgagcagtacaaggttggtgtactttctggagttcaatgatcgcattcacgaagttccttccatccaataccctcttctacctccaggaagattccagatacctgacctagcattacatttccgaaataatgggatgatttatccagagtactcccgaataaatagcgtgaatgttcccggtcctgcttgcaagcataagctaccagtgagcttgtttcaggctgtgagaatgaagaaggacagccggaagcaatggtgttcttctcagctggatcccgatgtggtcagtgtgcagcctgacactcgaaacctaaaccatatcacaaagaggcaatacggatgctcctggtcgaatggctgggccattgagtgcttcaacaatacgcagcttaagcggaacaaagcattcaggaagttccttctatccaacaatgaaacaggccccaacctgggcccagtcgcatctactctgtacttcagagaccagacaagattgggagcgttcacggtgtcgaatggctgggccattgagtgcttcaacaatacgcagcttaagcggaacaaagcattcaggaagttccttctatccaacaatgaaacaggcccgaacctgggcccaatcgcatctactctgtacttcagagaccagacaagattgggagcgttcatggtggccctgagcagtacaaggttggtgtactttctggagttcaatgatcgcattcacgaagttccttccatccaataccctcttctacctccaggaagattccagatacctgacctagcattacatttccaaaataatgggatgatttatccagagtactcccgaataaatagcgtgaatgttcccggtcctgcttgcaagcataagctaccagtgagcttgtttcaggctgtgagaatgaagaaggacagccggaagcaatggtgttcttctcagctggatcccgatgtgtcgaatggctgggccattgagtgcttcaacaatacgcagcttaagcggaacaaagcattcaggaagttccttctatccaacaatgaaacaggccccaacctgggcccaatcgcatctactctgtacttcagagaccagacaagattgggagcgttcacggtgagtgatatggccatagattattcacgacgtttctgataggttctcccattttaatgctttctctttttctgtcatctgtcaaacactgcataaaataaataaagtcaagtccacaacagaagacactgttaaaggcgctgagcagtacaagcttgctgtaatcagcagtggttgtcagagctggtagacttttttcattacagctgtatttactgagttattccctgttgatctagtgaataagatgtgggtgaagccatcttttgtcccggccacaataactctgtatccttaggcactttctgtttgcctcacactgaaatgcaatcgtttgttaaaaggctgttctcttctgttgtcaataaatttccttttgctgacagttactgctgtaacagatgtctgtatgttggttgtcccactggctgttaatgcatccatgaatgtagatgtagctttcctgttaacgagtaggcctgtggccatggctgcacttacggggccatgcacctgaggcactagcaggtgtatccaggcttgctccccatcctggcctgctcagtaccagggcccaataaagctttgtctggcttttccgctgccactttgggtactaccattcctcctgaccctgctctgtggggtccagttttttggagctctcactctgaaagccattcactgcgtcctgcttaatggggctcttaggcatgaggatcttgatacctgacttcactaggtccattttcatctggctgcagagagacggagctgtgttcttcctgaactgctggctggcagcaaacagctggctgtttttggattcgtgatctctcccaatcactggtgccttaggagaggacttagaaaagctgctgtttgtggatctggagatttgtttcctagcattgttgggagaggacctgtttgttctggtcaatgtaagcttgctgtaatcagcagtggttgtcagagctggtagacttttttcattacagctgtatttactgagttattccctgttgatctagtgaataagatgtgggtgaagccatcttttgtcccggccacaataactctgtatccttaggcactttctgtttgcctcacactgaaatgcaatcgtttgttaaaaggctgttctcttctgttgtcaataaatttccttttgctgacagttactgctgtaacagatgtctgtatgttggttgtcccactggctgttaatgcatccatgaatgtagatgtagctttcctgttaacgagtaggcctgtggccatggctgcacttacggggccatgcacctgaggcactagcaggtgtatccaggcttgctccccatcctggcctgctcagtaccagggcccaataaagctttgtctggcttttccgctgccactttgggtactaccattcctcctgaccctgctctgtggggtccagttttttggagctctcactctgaaagccattcactgcgtcctgcttaatggggctcttaggcatgaggatcttgatacctgacttcactaggtccattttcatctggctgcagagagacggagctgtgttcttcctgaactgctggctggcagcaaacagctggctgtttttggattcgtgatctctcccaatcactggtgccttaggagaggacttagaaaagctgctgtttgtggatctggagatttgtttcctagcattgttgggagaggacctgtttgttctggtcaatgtgctctctttctgcctttccgtgtggtgtctgttgaagtcgtggatgtattcctgacagttcacgaggtgctgctctggttcccaagtgtcgtcctcgctgttgtagccttttcactgaaccaaatactctgtcttccctttttaatttttccttttgtcaacaatcttttcaatctaacctgccttagttggcatagaccaatgtaattcagttcgctcctcctcaaatttaaacaattcattctagcacagggcttagcaaatgataggtgcttaggaagtgtttgttgacagaatagttgtgatctcagttctggctccatgcctctagctcagcggttctcaactgagggtattttgaccctcgtccctcagagaatactcgacaatatctgtagacatcgctgattgtcacagctgtggggagtaggggaggtactactggcatatagaggatggagtcaaggatgctgcttaacatcctacatgcgcaggacagccctcacagcaaatagtaagctggcccccagtgtctgcagtgccaagggtgagaaatcctgtcctggctggtctccatgcaagccatacctgaggggtcccacccctgctgcctcctctggtcacgaggttggaggttcctgtagctcaggccagtgcagcatcttccattcccttgacccctttataagagttttcctgtggctcctcgggtgaggtttggggtatcagttagtgctctcaacaatggccacctgcatgcgcggggagtgacggggttggccctgagcacaggtggagagctgggctgtgggtgatttgaatgagccctgcatgctctgaaggtctgggttgcctcaaagctctacctggtttttcagagaaattgttctcccgttcacagaagccttcctctgctacccagcttgtaacagcctgcccatcccctcatcccttgtctgag

SEQ ID NO: 479701 - DNA, 1832 bp, Homo sapiens
tttggttccaaatggtggtgacttcagagagttgatgatctcagaatgcttttgaatttgcacagcgaagccttcaagtcctgccttggcagtttcaacagaagcataaaggattcaaggaaccacagacatgatggtggagacatttgtggtggtgattttcctggcaaagccctgggggagccggctggcttggaagaaaccacatttggaaggctctgtgttggagaaatactgagctatgtcaccgatttctcggatatgggaaacagaacacacaagctctgctttttacaacttggatttgtatgtgggttctcagacagctctccaaacctacttaagagggagatggcttctgtgtttcgactagcagactcatttgttggtgatggcattaatgacccatcttcagaggatgagcagaaagcctacgttctcaccatcactgtgtacaattggacttgtccgaagctgcagcctggactggcccatggctgtcagaatcatttaggctgctgcggagatggctatggtgttggtgcttttgccatagacatcaccattcgtgcattgctttgtacattgataatacgaagcagcatcaccggcatctttgagaagcttctggaaggtgtgagggacttgtagaagaatataactagaaaaaggaatgttataggagaagatacattggctctaagatgaaaaatataattaatatgcaaaatattcacagtcaatgtttggatcctttaaagaccatgaataaaaaattatttaatttgatccactgaataatctgctggaagggctgagaccttggcgaaaatttgttcatagtagagttgagtctttttctgggtaatctgtgtttggtgtatacatgtatgtgtgcattccagttacaatggctgtgtaacaaatcatcccaaaatatagtggcttaagagaaaacaaaggcagtcatttcttatctctcagggattgtgagggtcaagtatttggaagtgacttagtggggtggttctggttctgagtgtctcaggaggttgcagtcagccatcagcccaggctgtgttcatctgaaggcttgactgggactggaggatctgcttccaagtgcctccacagtggctccctctgtgactggcaggctgttctatttatgtggacctctcctcctgctgctcgagtgtcctcacaacatggcagccagcgttttcagagtgggtgatccaaaagccaaggtgaaagtgttgatgccttttaggacttagccttggaaatcaaacactgttgtttctactggatgtgtgagaccagtcctggttgatgtgggagtggacaactcaagggcatgaattccagttggtgaagatcattgagggccacattggaggctggctaccctcatgtgtaggcgtcagtcatatgctgttacctacatttgagaacgtgcttagtaaatatactgatttccccacaatctagtgggcaggacatacataagcatatggcacaaaagaattaaggttttaaaaaagtgagttcagaaaccacccattcaggaatcatgaatgtgatcagcttttgaacaaaagagtggttttaaagccatgtccttgtgtaatggataaaagatttaaaaactttgtagatgcaatcatacttaggctttgaattacgctcctccccttcgcttggctacaagtcatgtatactcgagcacctaacaactaactataatggtaattcaagtaaacaggtcacatttacctaaatgtattggatacagagcacatttgtatgtgctatggtttgatagtgaa

SEQ ID NO: 479702 - DNA, 697 bp, Homo sapiens
cgcaagcataaaagaaagaaatctcaccctcacaagtattaatacacaacaggatgaaagaaacacacactttggggaagcttgcagaaacaaagtactaagcatgatgattaaggatacaagccggggacaagagtgggaaggagacagagcgtgggatgctggtgagaacattgggtcacagcaccagccctgcctggactgtgtttatctgggtcattttcattatgagaagaagaaattacagcgacccttgaacaacacaggtctgaattgcactagtccacttatacgtaatttttcttcagcctctgtcacccctgagacaagaccagcgcctcctcttcctcctcctcttcagcccactcaacaagaagatgacgagggtgaagaccttcgggatgatccacatccacttcgtgaatacaaagtatattttctcttccttaggattttcttcatgacaatttcttttctctggtttactgtatttcctttaacatcttcctgggaagaacatcgagcttacagtcagaaagtctggtgtgagtcctgtttctgccactccacggccaacacagacgtaccacagtttctttaccacccatctgtcaaggaacactaggagctgtttgtagtttgggaccattatgaataaagctgctatgaatattcgatgcaggtcttaggaactaac

SEQ ID NO: 479703 - DNA, 1327 bp, Homo sapiens
ctcacatgtgtgggtgtgcacatgcatgcagtaatgactgagagccatgtgtccataaatacagagcccgttgtgagaaggggcaagtatgaataaaggtttagatcagtgtcagtgaagatttttggttaagaaccagataattcatagttttatgtttgtgggccaccctttctctgttgaaatgtctcaattctgccattacagcaaaaacttggcaattgcaccgaacaaggggagagtggttgatgattctgatgagctgcaaaattttacggaattccagagagaacctgaaaagtggtatctaaactcagaagaagaccgtgtgaatgatgctctatttaaaaatgttttaaaaatagcaggcaattttgaccctcttggaggatttgctactactggacgtcctcctgggatattcagggcctacatgagggtggagggcaggaggagggtgaggattgaaaaactatcaactgggtactatgctgactacctggatgatgaaatcatctggacagcaaatccccgtgacacacaatttacccgtgtaacatacctgcacatgtacccctgaacctaaaaatttggaaagaaaaaaaagacaatatgggttaatattttcttcctacgatttctccctctggatggttccaccatctcacctgctgcttaaggtggaaatgtggtgtctctgttcctctccgtctcagtgtctctctgaggcattccagcccctccatgcccaccgcccatggccgtgcctgggtttagcctttcccttcctgggatattgccagggtatcttgtgttttccatgcctcagggcctatcctgtccagtccctccatgctggtcaggtcagagtgacatctgtcacatgcacacctgatgatgaaattcctttatctaatcagtctttaatgacttgtcattctctcagcagtgtttcccaacccagatccctttcagaaccctgaaccctggacttccgagatcatcaccgacatctgagaactgctgcttatgatctttccttttggaaactcaccaccacctttgacactttaaactcctttaggtttgacctagcatttcccatggacttggctgatcttgcctcttctgcatgtcagctggccccaacttgctctttggccttcttttctgtaactcccctgattatatttttggttgatggtgatttggaaatttaatttcctgaaaatgtcatgttcccttctgcccttggactttcacccattgtttttacctctgaatgaaatgctcttcattctccttggctcctggaaaattccctctc

SEQ ID NO: 479704 - DNA, 907 bp, Homo sapiens
tccaagtaccccctagaggttttccattggccacttggtgttcaccttatgtaaatgaagtggtggcttgcaatcagtctgattgcagagagcaaccagcgctgggggctctgggtagcaataacctcctctctgtgcagaagtcccacattacatgcaactgctttgttgacatttcgtatccacaactgtgaagaaaaacactttggaaactgtcatgaagatagtaccttagagaagggggactacaaaatgacggctgatgacgggggctcattccaggccaactggggccaggccaaaggaaggcaagggcagacgaggcataggtggcatcggcagcctgagcagtggtggctccagaagagcccatctccaacagggctctggaacacggatgacatgatagggcccatccaagattatgcctacccaagcaagaacttccaggccaaattcttccaaatttcctgacccatagaaaccatgagaaataataaatgattattgtttttctaacccactaagttttagaataacatgttactgatacagaagcctgagcgacagagcaagactcccgtctcaaaaaaaaagtatatatatatatatacacttatatatatatacttttatatatatacacatatatatatacttttatatatatacacttatatatatacttttatatatatacttatatatatacttttatatatacttatatatacttttatatgtatatacttatacttttatatgtatatttatacttttatatatatttatatatacttttatatatacttatatatgtattgtatacttttatatatatatttttaaagacatcagcaacattgtctgattttacttatttatttgttattatatattttttcat

SEQ ID NO: 479705 - DNA, 2729 bp, Homo sapiens
cttaaaagggctaggaatttctttttcggggagctcggctcttaagactaaatgacttcagacactgaaggcttaacacagtgactggcatatcatagggatgcccaatacataccagctgtgaggcttatcaccactgttcttcctggcatggccctgtaagctcatcttcggctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcgaagtgtgtttctaaaaaatgctgggcacatggcgtagagtttgtagagaggaaagacttaattcacagcttcctctacatctactatgtacactggagtatctcaactgctgacctacccgtagcacgaatctctgctggtacctacttcaccatgaaggtctccaaaaccaaaccaccggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaatccagctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccctgtgaacctctcttgcctggctgcaaaattttaagacaccaaagacaaaattacattatgctctgagtgattacttacaagtacatcagaatatttacttacatagaaaagcactggaaaggaggaacacaaaatatgaaagacaattgatatggtactgaaatttttcttttttaactgttagatatttgtgcaataaataaaaaaggagggaaaaccacatcagagcaataggcaaggaggtggcaaactagataagtctccttggagaacaaaaaatatatttaaaatacaatagccctactacaactgatttatggctcaggtgactaaacacaatttgaagcagtaacaacactcataagctgaaaataaaatacttttagcccttttattcttcttgcctctttcccaaagaatatgccaatgaagctgttcttgatgtcacaatattcatatatcgcagaatttctgcatttaaactaccttgcctactgaaaataagataatcatttcatctctaggaaccagtaaccaaaaaaaaaatgtccttagagaatacatttttatttgtttgtttatttagagacggagtctcattctgtctcccaggccggagtgcagtggcttgatctcggctcactgcaacctccacctcccaggttcaagcaattctcctgcctcagcctcccgagtagctgggactacaggcacgtgccaccatgcccggctacattttttgtatttttagtagagatggggtttcaccatgttagccaggatggtcttgatctcctgacctcatggtccgcccacctcggcctcccaaagtgctgggattataggtgtgagccaccacgcccagctgagaataaaatttttaagtgggtattacaaaattcaggttttattattcagggaagtagatggattgagactcaaaactttgggaactagtttcttttaacttttgaaaactacagatttattaggctaggcagcaactacaattaggtataaataaacagaaatcatttcaaattcaggggtcattaatgctgctacatgctgactcttattttcagtagttgcgggttaaaagtagacatttcctggaacatatatttaatagtatttaagactgttaatactgttt

SEQ ID NO: 479706 - DNA, 744 bp, Homo sapiens
tgggcggtcgatgggactgggcgccgtggagcagggggtggtgctcgtcggggaggctggggccgcacaggagcccatggagtgggtgggaggctcaggcatggcgggctgcaggtcccgagccctgccccgcgggaaggcagctaaggcccagcgagaaatccagcacagcgccggtgggccggcactgctgggggacccagtacaccctccacagccactggccactggcctgggtgctaagtccctcattgcccggggccggcagggccggccggctgctccgagtgcggggcccgccaagcccacgcccacccagaactccagctggcccgcaagcgctgcgcgcagccccggttcctgctcgcgcctctccctccacacctccctgcaagctgagggacctggttctggtcttggccagcccagaaaggggctccctcagtgcagcggcgggcggaaggactcctcaagtgccgccaaagtgggaacccaagcagaggaggcgccgagagcaagcgagggctctgaggactgccagcacgctgcggctgcctttgcaatctttgaactggaaacagatattattcatgctgatagggaagagagttgcctgcttagtggtgacgaaaattaatagtccaagcattcttccatcctgcattttccatgctggcattttgacttaaaaaaaaatattgctgcagctgtttgcatattctggaagtgtgtgtgcctgtgtgc

SEQ ID NO: 479707 - DNA, 577 bp, Homo sapiens
ctctctctctttacctcccaccatccacttaagatgtgacttgctcctccttgccttctgccatgattgtgaggcctccccagccatgtggaactaaacatgaaattgaaaaaatgttcacacaaaaaagcaccttcataagaaccaaaaaatcaggccacaagcactgcaatccttgggcaattcctattgctttgctgggcttggagcaagtggactggatgggaatgcaatctagtaagacaccagctggggtagccaagggagtgcttgtgctacccctctcccaaccccaaggggcccagcttgcaactctgggagagactccatccctctgcttgaggagaggagaggtaaaggccgtactccaccttgggcatttagtgagactcagaggtgtactggattcaaatgtgacccagcacattcttagctgtggtggctatgggaagagactcatgctttagaaaaaagaaagggaaaagtaaggagatatggtcctgcagcttaggtaccagctcagctacagtcaggtagaacatcaagtaggctctggggtccctgattctaggccttg

SEQ ID NO: 479708 - DNA, 1485 bp, Homo sapiens
aggtgaccacaagaaaccaaagggcaagatgtctgcttatgccttctttgcgcagacatgcagagaagaacataagaagaaaaacccagaggtccctgtcaattttgtagaattttccaagaagtgctctgagaagcggaagaccatgtctgggaaagagaagaccaaatttgatgaaatggcaaaggtggataaagtacactatgatcaggaaatgaaggataatggaccagttgagggaggcaagaagaaggaccctaatgccctcaaaaggccactgtctggattcttcctgttctgttcagaattccaccccaagatcaaatccacaaatcctggcatctctattggagacatggcaaaaaagctgggtgagatgtggattaactatagtgacagggaaaagcagccttacatcactaaggcagcagacctgaaggagaagtatgagaaggatgttgctgactataagtctaaaggaaagtttgatagtgcaaagggtcccactaaaattgcctggaaaaaggtgaaagagaaagacaaagaagatgaggaggaagaagaggaggaggaagagaagaaggaggagggggaataaaaaaactgtttatctgtcatcttatgaatgccttagagtaggggagtgtcataattgacatatctcttatttgagaagtgtctgttgccctcattaagtttaattacaaaatttgattatgatcatattgtagtctctcgaagtgctctagaaattgtcagtggtttacatgaagtggttggatgtccggagcatcctgaaactgtatcaaagttgtacatatttcaaacagtttaaaaatgaaaagtcactctggtattctccctactctgtgtacattgcagttggagtgacaaggcatttaaagatgtttctggcagtttttttatttttaaggtggtattaagtctatggttattggctagaaatgctgagttatcaactgcatatatctataatttgtaaaaaagaaaaaacaaccccgacaaactcttcatgctccttgcttggcattgaggctgtgggggaagacgccttttggaggggctgtagctcagggtgtgctgctggaaggagacatgcagaatatcagagagtcttgcatacacattcataagaccacttctctaaaacttcccactgttcctaagtaaccacccggaaccaacaggatggcacttcaaccactcaaagccttttcaaagggtcccgctcaaagccttttcaaagggtctctgatattacctatcactgaaatgaagcaaagcttaaaggactcctgactctttcagcctccttcttctcatcttttaccaagagtgtcttgtgaccctaaaattcagagttagcagtggtcaaggctagtgaaggtctttgaagtctttcttatgaggccagaaaaaggaaaatataaaatgaggcttctaactagatctgtaaacaactta

SEQ ID NO: 479709 - DNA, 535 bp, Homo sapiens
gcttttttcagagggtctgtgggtcctctcggctttcctggttttctgctttttcatattaatgagaactcatctgagatggtggaaggacaggctctgaccacaaatggtcagagaaatggaaagcaatggttgacttcagcaagaatatgtggggaaactccatgtggctggggaagcctcacaatcatggtgggaggcaaggaggagcaagtcccgtcttacatggatggcagcaggcaaagagagaatgaggaagatgcaaaagcagaaacccctgataaaaccatcagatctcgtgagacttattcactgccacgagaacagtatagaggaaactgcccccatgattcaattatctcccactgggtccctcccaaaacatacgggaattatgggagtacaattcaacatgagatttgggtgggtacacagagccaaaccatatcattctgcccctggcccctgccaaaaaaccaatcctgccttcccaacagtcccccaaagtcttaactcatttcagtgttaacttaac

SEQ ID NO: 479710 - DNA, 463 bp, Homo sapiens
gcttgcatcactgtggcctagataatgttgaataccggccccttatctcttctggcttatagggtttctgctgagaagtctgctgctcgtatgaagggcttccctttggctgctgtggtttgctggaaacctaccccagaccctgttcacctgggtccttcccacacctggaggtgtcaccagtggaggctgcagaacagcaaagctgacagcctgctccttcctcgggcaactctgttccagtggggcaccaacctgatgccagtgggaatgctcctgtctggcctagtaaggcagtctggtcacagtgtaccacagctgctgtactgtgctgtggggaattcctcctgggtacaaaccacccagtctcccctgcactggcaggggaaaatggcagactggagttgcagtggtggctgccgcccctcccgcaaggagctcagtcctcttaggcaataggcag

SEQ ID NO: 479711 - DNA, 556 bp, Homo sapiens
cgtgcttttttctgtttgacctggaaagtagctagcaactcaacaaggagaaaggacagctaggtattatgaagataccatgctgtgagctgcctcaggggagacctaagtggcaagaaactaaggaagacccacagccaacggtcaaagaggaactgatacctgaaaacaacaatgatggtcaatccaccaacagcttgcaccatgcacctggaaaagccatagacactcaatgccagcccatgaaagcaaacaggactagggctgtaccttgcaaagccagaggggcagagctgctcaagaccataggaacctacctcttgcatcagtgtgacctggatgaatcacatagaatcaggattctcacagaatgttttcattgtaaatgtacctattacaaaatcaggggactttattttccttgccaactgtttttgcaagctctcaaatgtgctggtacttctattgctccattactaacataatagattttaaaaatatttttatttgcatttttcagagtgctccaaagaatctatatagttcattaagttag

SEQ ID NO: 479712 - DNA, 725 bp, Homo sapiens
tctacagaccaggtaactcctcaaatgaagcaagcttccttgtggtgggttagaacatgctccgttagctcagagaagtttgttattaccaaccttctgaagcctacttctgttagctcgtcaaagtcattctccatccagctttcttgggttgctgatgaggagctgcgatcctttggaggaagaggcactctggtttttaaaattttcaaattttcttctctggtttcttcccatctttgtggttttatctacctttggtctttgatgttggtgacctaccaatggggttttggcgtggatgtcctttttgttgatgttgatgctattcctttctgtttgttagttttccttctaacagtcaggtccctcagctgcaggtctgttggagtttgctggaggtccactccagaccctgtttgcctgggtatcaccattggaggctgtagaacagcaaatattgcagaacagcaaatattactgcctgttccttcctctggaagcttcgtcccagagaggcacccacccgtatgaggtgtcagtcggtccctactcagaggtgtctcccagttaggctacacgggggtcagggacccacttgaggaggcagtctgtccgttctcagagctcaaacaccatgctgggagaaccactgctctcttcagagctgtcagacagggacgtttaagtctgcagaaatttctgctgccttttgttcagctgtg

SEQ ID NO: 479713 - DNA, 738 bp, Homo sapiens
agaaaggggctcccacagtgcagcggcgggcagaagggctcctcaagtgctgccaaagtgggagcccaggcagaggaggcaccgagagtgagcgagggctgtgagtactgccagcacgctgtcacctctcagtatgcttgttctgggtcttagccagtctattgtagatccaaatcttactcagaaatgttcggatctcctcttctgcagtgcagttacctttcatgaagcttatacccaggagcatcatcaagataccacttttaggcaatgctttatcaccactcagactcctgttgctggggacatccagttcactgaaaagagcattgacatgactgctggggtcaacttcttcaattcaaggccaaagaccagctccatgcactcagagattctcctgaggatctcagggaaatggtccttgcactttttgttaataacgttcagcaatgctgcttttgtcatgggatctttaattttacacttctccagcagaaattgtattaccaaacttcccttcctgaatagaaggtctctgtgtgagctccagtggtggctcttgctggagaggttcttggcttttcctcattttggttcttggcatgttcatcagatcttgtgcatgaaacatctacagaataagtgatgatgaagggggctctctgagactcctggggaatgtcagtagcaagagagctctgaagagcactctccaaaacaggagaaaaggaggag

SEQ ID NO: 479714 - DNA, 905 bp, Homo sapiens
gagaaactgtaaatatgaaacctcataataagacatcactggcttgtacaacgcgaaaatttatagatattctcaaatcggctcctggaggtgttcttagcttaagccaggtagcagcaaaactggcagtgcacagacgaagaatatatgacatcatcagtgtcttacaaggagtcaaactaattgaaaaaacatctaagaaccatattcagtggattggacctgattttaattctggagcaacacccgaagaaaagaagctagaggaggaagtttccaaattatcagcaacagaagatgccttggataagttaattgaagattgttctcagcaactgtgtgagttaacaaatgacaaagaattgggaaaactagcatatgtgacgcttgaagacattcacaacttggaacgcttccaggaacagaccgtttttgtcgctaaattgccagtagaaatcacactggaaattccaatttctgaagactctttctcattacgtttaagtaacaacgacggacctgttgacgcctatttgtgtctatcgaagaaggattacgaagctaactacacgtctgagagtgccgggacttcatctgagagcactgggacttcatctgagagcagacatccagaacaccctgaagaagaagaaaatcctcagcaaggtgaagaattgcttgacatgagcaactgataacatttgagaattcagggattatgtcatatatcacaaaagaaattgccttacactggttcatgtttgcagttactgttgtatattggatccaaatgtgatgtctttgtatatatctgtgtgtattaatacttttattttatcatttgtaccatatttttactgtacattttctatatttagatatgtttaaatacacaaatatttacc

SEQ ID NO: 479715 - DNA, 894 bp, Homo sapiens
cctgcagcagagaggcctgactgttagaaggaaaactaacaaacagaaaggaacggtatcaacatcaacaaaaaggacgtccactcagagaccccatctgaaggtcaccaacatcaaagaccaaaggtagataaatccacgaagatgtggagaaaccagcgcaaaaaggctgaaaattccaaaaaccagaacacctcttctcctccaaaggatcacaactcctcaccatcaagggaacaaaactggacggagaatgaaaggtgggtaataacaaactcctccaagctaaaggagcacgttctaacccaacgcaaggaagctaaggaccttgaaaaagggttcgatgaattgctaactaggataaccagtttagagaagaacatggatgacctgatggagctgaaaaaaacagcacgagaacttcgtgaagcatacacaagtatcaatagccgaatcaatcaagtggaagaaaggatatcagagattgaagatcaactcaatgaaataaagcgagaagacaagattagagaaaaaagggtgaaaagaaacgaacaaagtctccaagaaatatgggactatgtgaaaagaccaaacctacgtttgattggtgtacctgaaggtgacggggagaatggaaccaagttggaagacactcttcaggatattatccaagagaacttccccaacctagcaagacaggccaacattcaaattcgggaaatacagagaacaccacaaagatattcctcaagaagagcaaacccaagacacataatcgtcagattcaccaaggttgaaatgaaggaaaaaaatgttaaagcacagccagagagaaaggccgggttacccacaaagggaatcccatcagactaacagcggatctctctgaagaaa

SEQ ID NO: 479716 - DNA, 639 bp, Homo sapiens
ctggtttgatttgagtcttttctggttttttcttgaaaacaaacctcaacaaatttaaataatgaaaatcatacagagtgtgttcttggaccataatggaatcaaactaaaaattcgtaacagaaaggtagctgaaaaagaaccaagcacttggaaagtaaataacagtttcccgtataatccagatgtcaaaagggatgttgtggagcccaaaggatttggtgcgggaacatctgtagtggagcatagctccagtgctagcagatggtgccaaaccagtagagtgctgcagcagaggggacccacagtcaagcaccagcctacccaagcccttccccaactgtggcctccctcatgccactttgcctgcatgcactcacccagggtgaataaagagccactaggaccactaacactccagctgtgcaagaacatcaccatctctttccagaaagttttcaaactgaaactctgtactcattagagaataacttcccatttcctctcctctcactcagatgctggcaaacacaaatcaactttctgtctttatgaatttgactacactagattttccagtttatttgcatagaggtgtttatagtattctctgatggtagtttgtatttctgtaggatc

SEQ ID NO: 479717 - DNA, 1533 bp, Homo sapiens
cctctgtctaagcagtcccaatgatatgagccaggacttccaggactatgttgaaagcagtggtaaaattgcacatccttgtcatgttccagatcttagaggaaaggctttcactatttccccattcagtaagaagctagctgtggaggacctacagccttttaccagggtaactctgcactggggaaaggggaatgatcagaccttttggggactagtggacactagctctgagctgacattgactccaaatgacccaaaacatcattacggtcctccaattaaagtaggggcttatggaggtcaggtaattaatggagtttttgctcatatccaacttagagtgaatccaatgggtcattggactcgtcctctggtcattttcccagtgccagaacgtaaaatcagcatagacatactgagcagctggcagaaccacattggctccctgattggcagataccacatcaaggacttgaaagatgcaggggttgtgattcccaccacatcctcattcaactctcctatttggcccatgcagaagacagatggatcttggagaatgacagtgggttatcgtaagcttaaccaagtggtgactccaattgcagctgctgtaccagatgtggtttcaatgcttgagcaaattaacccgtcacctgccagccctttcatcacccaatgggtccatgaacaaagtggctatggtgacagggatggaggttacacatgggctcagcaacatagacttccactcaccaagaatgacctggctatggccaccccgagtgcccaatttcccagcagcgagaccaacactgagcccttgacatggcgtcatcctcgtggtgatcagccagctacttggtggagggttgattatattgcacctcttccatcatggaaagggcagcggtttttcttcaccagaatagacacttactccggatataagtttatctatcctgcacccaatgcttctgccaaaaataccatctggtgtctcttagtattaccatgtcctgtgattaaggtcaatgggaaacaacaacagcccaatcctagcaggactacaaatggcccagacccctcaggaatggtttgggtcactccaccaagtaaaaaaccacgaactgctgaggtgcttgctgaagacaaaggaaatacagaatgggtggtagaagaaagtagtcatcaatatcagctatgaccgtgtaaccagttgcagaaatgaggactgtaattatcatgactattttctccttattttgttacgaacgtgtttgtacatgtatatacttattctaagaaaataccttcatttaatttcctttctttttctgttatcatgtgacataagatttattgacttcctatcagaatttaagtgttgttaactttatgtaatagcattcaggttaaggactggtgtgtttccagttgtacaaagaatagctgtattatgttaggcataattatgacctttttaatgtatttatttgaagattatgtatgatttcaggaggtgtgtat

SEQ ID NO: 479718 - DNA, 676 bp, Homo sapiens
tagcaacttcaaagattgaaggaaaatcagcccacaaagatgagaaagagcaattgccagaagtttgacatttcaaaaagccagagtgtcttctttcctccaaacgaccacactagttccccagcagtgtttcttaaagagatggaaatgactgaaatgacagaaatagcattcagaatattgataggaacaaagatcatcaagattcaggagaacattgaaacccaattcaagaaagctaagaatcacaataaaatgatacaggagctgacagacaaaatagccaattctccaagatcagatgaaagaaaaaatctgttaaaggcagctggagagaaacgccaggcccctcttctgcaggtctgctgcagtttgctggaggtccactccagaccctatttgcctgggtatcaccagtggaggctgcaaaacagcaaagattgctgcctgcttcttcctctggaagcttcgccccagaggagcaccagcctgatgccagctggagctctcctgtatgaggtgtctgatgacccctgttgggagagtctttctctctgtctgagccacctacagcagggactggaatgacacaaccactcctgtggccaccatcactaggactggactggatcagacctgaaatcagcatagcaccaggtcttactcaaggcctgcc

SEQ ID NO: 479719 - DNA, 1444 bp, Homo sapiens
cagggtagtatttttccacctttcttgttcaggatctgttttctcaacatgctgatccactttaagtaatgtaatgatgtgtgagaatgtgggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtcaagggaagtcgcagatcttggatggccgttacatatattattggcaatgcaaagagtcggtttacatccagacaccatactctcttttaaaaatgactgcatcaaataagtcttgtgaaaagcaaagaaaataataaaattgtgtttttatcttaaactagtaacagaagcaatcagttgctgaatggtctgtcactttatatt

SEQ ID NO: 479720 - DNA, 626 bp, Homo sapiens
gatcaaagttttgcctgagcatggactacagttctgacaattttctgcatctccacgtaggatgtgcaggcttccccttccccttctgccatgattgtaagcttcctgagaccatccaggctatgcttcccatacaggctgtggaactgaagctgccaaatagttcctatgatgatgtttctctaagaatgatgttttggacagcttcaaaccctctgctccctcccttggctgttggttttcacagtgattatatagctgttgagttttatgacaactttggacctgaagaaaaagtggtggaaatagaacaagcatcccttcaagtttacctgggaccccagagcactttggcctgtagtggtgtggattgccgagagactcaagttctccgccctgggatgggtgaatcccctctagctaggtctggtccagatgctccctctgtgagtgggcactggctgagcccagcacggctttgctctctggtatggcagggtagcactgagttcaatgtgaagttccccagtcactgccttcttcttctcccaagtgtacagactctctgggctgcacagctgctgccaggatacgggggaggggtggcatcggcgatttaagactga

SEQ ID NO: 479721 - DNA, 1377 bp, Homo sapiens
gaggagtcgtctcagggtagcacctgcggcggggggtggcgggggagggggatactcagcccatctacccggcacactcctcagagagctgacaccgggtgctccatgtccatgttcttgaaggggatcagccatttattttcacttctaaacaaacagcgatagcacagaatctcaccttatgtgagttctcataagatctgatggtttaaaagtgtggcactttcctctctctctctctctctctctctctctctctctctctctctctctgtctccctcctgccactatcattactgcttctctctctctctctctctctctctctctctctctctctctctctctctctctctctcccccctctctcttctctctcctctctctctctctctctctctctctcctctctctctctcctctctctctctctctctccacaatgtttcatacactctatgatgttcacacttttacgggatctttggggtgtcacttttctggccggaaacctctgtggcctgtggcacctttgcttgagtttttcttgggcccactgggctcattccacccactcgacctggcaggctgcgctcagctcatgctaccggcctggatcacacgcctgccatgggagactgcatggagcagcgaggggtgtgtgagcaagtgtgttgtccaaccactgcacagtcagaaatgccggctgctgcagcgggtggggagctccaggtgccagcatgggtgccagctctccactgggctgccacttgaccaggtgcgccacggcttccacagttggcaccagggaacgctgtggtgccttgaagcttggagacgccaggaactgcagtgcctcaaagacagagtcacagccctggctcagcaagtcaacccgacaagtgttcagctatcagcagagagggtagctcctctctgcagctggtcatcccatcatctgcacagctctcagcagagaggaggccctagagagtgggtggctcctctctgcaggcaggtcatcccatcatctccccattgtctcttcatcatctctgcagctctcagcagagaggaggccctagagtgggttgctcctctccgcagctggtcgtcccaacgtctgctcagctctggcttatcccagggcttttatgggcctcggaggggaggaagtgcatgccaattgctccatgggtggccatgggcgggcccagaaagggcaccacaagttcccactccagtccgaaggactggcagcccgaccccagcccaagtctggtcccgctctggtccatgggactggcagcccagactttgggcaccgacgagcataggagggaagtcaaggggtggctgagggcagctcagtgctg

SEQ ID NO: 479722 - DNA, 882 bp, Homo sapiens
aatggtaatgaacatttttgtttttcctacagctttgctctcacagacaatgctgaagaaattggctcccgtgaacctggagcctggaaagcatgcagggaaggctggcaggctggagacccaatgaagagctgcagttcaagtctgaaggcattttgctggcagaattccctcttcctcaaggcagcacaggggtaacaggagggtgggatcataaggagtgctgcatggaggggaattctgagatcattaatggaatgatgccattaaggcctcatgagcagacaactaggatgaatggaatccatgtttgcaaagatcagcagcagttatgcagtagggctgagggcaggagctataggcaggaaccctggggagagtgtgccaaggcccaaggaaaagaacagagcagttgtggatggactctcctggctgtggctgccgtatgctcctttctgtcctaatcaaagtttcccctccacactccacacaattagcacataaatgaacaatgtcaagaataaaagaaagtcatcactgcagatctacataaaattatagcatgatgacatgcatagctttatgttaatgactttaactaaaatgaaacggatattaaactgcatctgcattatgatttctcttatataaaaagtgtgcatatatatttatgtgcacatatatatttattcaattatttatgactgaattgttctcaatgattctaaaaaatggctatgtcaatttacatgctcggaagcaatgtatgtgagtactcttgtctcctccctccaacttcagaaataatcttgggaagcatacactttgcctcaccatttaaacttccaagattgtctcctaatggaccatttgcagatgatg

SEQ ID NO: 479723 - DNA, 841 bp, Homo sapiens
caaccacagctaaatcgtggcacaggggtgcaagggtgataaagacagacgatgccacactcttctcaggctttgaggccatggcttcagctcctggtgtggctgggatccaattctcctggaaggtccgaaggcccggaagttcaggccagctccacttgtcagcccgcgcccgggggctgccatccgatgccctcatccataggattcgaccaccttgacttgagaaccctgacaaatacaccctataatgccaaatatacttgcagccccactgaggagtcgggcaaggtacaaaattaccccattaaaaaccactgctttaggtcacaagctttgataaaagtacgtggtaaatgctattactcttctttgtctgaaaaacaaaacaataatgaacataaagaaacaggctcacagtgtgcatctctcatacctcatatatgctctctctttctttaaggaaaaatgctggtcattataaaatttcagcattgctatgcagcattaactatatatctattaactatagctctatccccactatcaccattatgtagcacagagaggaagggtttgggaatggacacccatatgctagtgttggttttatttctgtttacatttttagtctctttccatcatctgtaacacaaggttttgataaagacaaaatgaggaatatatgtaaagcaaatgcaacattgttggagcaaaacagttggtagatcctatttataaaattattagtacaaatgctagatttgacctgttatggtagagtaggaaaactgtttgactgacaaccaagaaacctggatcctggttgagtactgtcact

SEQ ID NO: 479724 - DNA, 913 bp, Homo sapiens
aaaatccattattattttctggagatctggctgtttaaaagtatatggcacctccccactcttccttcagctccagccatgtaagacaaacctgcttccccttcacgttccaggatgattccaagtttcctaaggcctcctcagaagctgagcagatgccagcatcatgctttctgtacagcctgcagaaccatgagccaattaaacctctcataaattacccatcaggaccctcagctgcagtaaactcttttggagtttactggaggtccaatccagaccatgcttgcctgggtatcagccgtggtggctgcagaacagcggatattggtgaactgcaaatgctgctgcctgatcgttcctctggaagttttgtctcagaggagtacttggccgtatctcaagctgcatgctgggagaaccactactctcttcaaagctgtctgacagggacatttaagtctgcagagattattgctcctttgtttgtctgtgccctgcccccagagatggagactgcagagggagtcatcaatgtggaaaaggcatagatatggaatatgcaatgtttttctcttaaatttgtgttggttgactatgggaagccaggaaaattatcttttaaaatgaaaataaaaattcattcttttttaagcccacaaataaagtcacgccatgcactttctgggggaccatgaataaaacatcaattattttctaaaaatcaacattgttttcttttccaaatacaataatactgttagggctttaggctatcattgggaagcctagttatcatcattgctaagacaagttcatttctttgttaaatgcttgctagtctgactgtgaaggtaatcattactttttagccacttttcctgcagttatcttgtaatagaatgtttgtgct

SEQ ID NO: 479725 - DNA, 745 bp, Homo sapiens
actgcagttacaatggctttcatccaaaagacagatattaatgaattctggcaagaaaggggaacccttgtatactatcttgtgagaactcactcgctatcaggagaacagtatggggaaatggcccccatgataaaattatctccacttggtcccaacgttgactcatggggagtattacaattcaagatgagatttgagtggggacatagagccaaaccatatcattctgctgctggccccttcaaaatctcatgtcctcacatttcaaagcacaattgtgcccttccaacagtaacagtgatgcagaagatgggctcccacagacatgggcagctccacccctgtgactttgcagggtacagcccccatcatggctgctttcatgggctggcattgtctgtggcttttccaggtgcacgatgcaagctgatggtgaatctatcattctgggatgtggaggatggtggccctcttctcacagcttcattaggctataccccagtgtgcactctctgcctctgggcctgtgatgggaaggcctgctgggaagacctctgacatgccctgaagacattttccccattgtattgacgattaacatgtgactcctcattactgatgcaaatttctgcagcaggcttgaatttctctccagaaaatgggtttttctttttcattcatcatcaggctgtgaattttctgaaatgttatgttctgcttcccttttaaacataagttacaa

SEQ ID NO: 479726 - DNA, 673 bp, Homo sapiens
tccactgacagcttgcactgttcatctagaaaagccaccgacactcaatgacaacctgtgaaagctgccaggaggagggtttttcctgcaaagccacagggatggagctgcccaaggctgtaggagcctacctcttgcatcagtgtgacctggatatgaaacatggggtcaaaggagatcattgtggaattttaaggtttaatgactgcctcgttaggtttcagacttgcatgggagtccccactggggtaatgcctagtagagctgtgagaagaaggccaccatcctccagacctcagaatggtagatttacaagcatcttgcaccctgtacttgtgaaagctgcagagagtcaatgccatcccatgagagtcgctacaggggctaaatcctgcaaagccacaagggcggagctgcccaagaccttgggagcctacccttcacactacagtgccctagatgtgggacataaagtcaaagctttaagatttaatgactgccctgctggatagttcattcctatttattattgaatagcattcaatacctccaatttcactcacctactaaaggatatcctggttgcttccagtttttggtaataaagaataaaaatactactaataggttttattttcagttttttttgtagacttaagttttcaattacctt

SEQ ID NO: 479727 - DNA, 1000 bp, Homo sapiens
tatacctaatgctaaatgatgagttaatgggtgcagcacaccaacatggcacacgtatacatatcttttggactcttggacttacaccagtggtttgccaggggttcttggtcctctgtccacaggctgaaggctgcactgtcagcttccctacttttgaggttttgggacttggactggcttccttgctcctcagcttgcagatggcctattgtgggacttcaccatgtgatcctccacgccaaagatttggtgtggcggcagcccgcggtgagagagacacggatcggaccaagagaaaaaaagctgtagactttattgagcagactgatagtataaagcttccacagcgtggaaggggtcccaagcgggtagccggtgttagattttttgattaccttttaaactttttaaggcgggaaatacgtgtggcgggaagatgttaccagagcaaaaaacaaagacaattaacatgtcttagatctcgaggaaaacaggaattgtaactcaagttttatttactttataaccttgtagcggcatggcaaaggagacaggacctcacgggattttacaaattgtgtttacaaggaattggaattgggagcataaataaggtcagctgatcacagaaaataatgggcttttaacattctgtttagttttacgggagggggaagggagagagggagagaggacacaaggaagcttacagcaaaagttttgctatttatagctttcttggggaagaaaacacatgcacaaattctgatgttaggaatattttaagcatatatcttcaatattatttatccaggaccaaaggttggatgatggtgccttttacttttttcatttggggaggtcataatttccttaatgtccttgatgcttatggatgtttgtcagtgtttgggcattgatgaattgtgtatttactgtaatcttctaagtctgggcttggaaaggctttccaggtattcaaagaaacttgaatgtt

SEQ ID NO: 479728 - DNA, 1282 bp, Homo sapiens
acatgctctccctagtggtttgagctgcggggtgaccaagcaggccacacccttgtcgcatgcgtcctgcaaggggaatctgggaactctcccgtttcaactggggccccatccgggatattcgtcagaaggtgcctagtgaatttgggtccagtgaagtccaggtccccttctctctacaggacttaaagcaatgtaacggggatcttggtaagttttcagataaccctgccagatatatagaggctttccacaatttcacccaaatatttgaactctcctggggagatgttatgttacttttgaatcaaaccctgacagacgctgagaatcaggccactctgcaagcagcagagagatttggggataagctttgcatcacatatagcatcagggaagggggcaaacattatccaactggaagagaagcagtatcaagggatgaccctaaatgggatcccagtgacaagacagaaaactggaagaggagacactttcaggtgtgcataatggagggcttacgtaggactagaaccaagcctctcaattatactaagttgtccatgatcgaccatggatttgatgacaataccactgccttcccggaaatgttaagagagcccttgttaaagtacacctctttatctcctgatccactcaatggacagataatcctaaaggacaaatatattactcagggagcccctgatatcaggaagaagctgcaaaaacaggttctgggaccagatagtgctttagagaacctcctgaaagtagccacttcagtcttttataatagagatagggaggcccaggagagagagaggaaatacagaaaagagacagaggctttaatggccaccagcaagcccacaaatcccagaattcccagggtgcacctaattgctacagatgtggcaagccaggtggagaccaatattaacccagaaatttgggcaactcaagggaagattggcggaaccaccactgccataccagtccaggtccatcttaaggatcccacctcctttcctaaccagaaacaatatgccctgaaaccagagaatgggccacctcttggggatacatcctgcagtcctcaggatggctacaatcggaggacaataagcttcatctaccagctgccaaccaatggaaagtacttaaaagccttcactaggccttccacctaggtaaggataaaacctatcaactggcccagagattgttctcagaaagctcattggtcatcactggagttttgctagagcaccaatttatc

SEQ ID NO: 479729 - DNA, 1906 bp, Homo sapiens
gcctcttggttccaatgagccggaccggaactatgtgatcccggaagttccgggtcctttggccctatatgatcccggaagttccggggcttttggacctctgtgattccggaagttccggggcgttccggggcgttctggggcctttggagcgtgggataagcagtaatggcggaggctgcagctcccggaacaacagccacaacatcgggagcaggagcagcagcggcggaggcggcggaaacggcggcagcagtctccccgactccgatccccacagtcaccgccccgtccccgagggcgggcggaggggtcggcggcagcgacggcagcgacggtagtggcggcaggggcgacagtggcgcgtatgacggcagcggtgcgtgcggcggcagcgacgcgtgcgatggcagcggcgacagcagcggcgacagctggactaaacaggtcacttgtagatattttaagtatgggatttgtaaggaaggagataactgtcgctactcgcatgacctctctgaccgtctgtgtggtgtagtgtgcaagtattttcagcgagggtgctgtgtttatggagaccgctgcagatgtgaacatagcaagccattgaaacaggaagaagcaactgctacagagctaactacaaagtcatcccttgctgcttcctcaagtctctcatcaatagttggaccacttgttgaaatgaatacaaacgaagctgagtcaagaaattcaaattttgcaactgtagtagcaggttcagaggactgggcgaatgccattgagtttgttcctgggcaaccctactgtggccgtactgtgccttcctgcactgaagcacccctgcagggctcagtgaccaaggaagaatcagaggaagagcaaaccgccgtggaaacaaagaagcagctgtgcccctatgctgcagtgggacagtgccgatatggggagaactgtgtgtatctccacggagatttatgtgacatgtgtgggctgcaggtcctgcatccgatggatgctgcccagagatcacagcatatacaagcgtgcattgaagcccatgagaaagacatggagttctcatttgctgtgcagcgcagcaaggacaaggtgtgtgggatctgcatggaggtggtctatgagaaagccaaccccaacgagcaccgcttcgggatcctctccaactgcaaccacaccttctgtctcaagtgcattcgcaagtggaggagtgctaaggaatttgagagcaggatcgtcaagtcctgcccacaatgccgaatcacatctaactttgtcattccaagtgagtactgggtggaggagaaagaagagaagcagaaactcattcagaaatacaaggaggcaatgagcaacaaggcatgcaagtattttgatgaaggacgtgggagctgcccatttggagagaactgtttttacaagcatatgtaccctgatggccgtagagaggagccacagagacagcaagtgggaacatcaagcagaaacccaggccaacaaaggaaccacttctgggaattctttgaggaaggagcgaacagcaacccctttgacgatgaagaagaggctgtcacctttgagctgggtgagatgttgcttatgctttaggctgcaggactgacttaccagtcagtcttccaagaagccttccctgactgtctatcccagcccccattagatgtcccaccttatacatagttttatcatagcacttagcattcatattgtaattgtccttcacgtattttgtcccttgccctttattgtgagaaaccatttctttgtatctccagtacctcattcagtgcctgaaacatggtaggtgccgaattgtactttacctttacattattgcacttcatcagcgttgctccacaaatgccagaaa

SEQ ID NO: 479730 - DNA, 736 bp, Homo sapiens
gtgttttgaggaaaacaatttattgtctagcttcaactcgtgagaactcactcgctatcacaaaaacagcatgagggtaaccatccccatgattcaattacctcccaccgggtccttcccaagacacgtggggattatgggaactacaattgaagatgaaatttgggtggggcacagcaaatcatattggcgtccttttaagagaataacacttgcttttcctgtcctcaaagaaacggttgtcgtcatcatcggaaattttgtctctgactttcaaaaatgcatttttaaatgcctggaggggctggcatctagctctcctttcagactgtgggaactgtgttatccctatgacagacctacagccaaggaaaataaaatgcagtcagcccttcagcaagaaatgtctggagaccatgtctataaggaagaagacatgaaacatgttataatgaaacaatgttattcaaggacctgctgtacaccatttcacttgaagttgcagtttccaagaatgtatcagtgaggttaaaagccctggttctgtatagtgggaaataatttctacagactaagatctgggcactagatatgctcattgctatcaagatctcatttcttttcttctagtatcccctgccctttttaaaacagaggtttttttttttaagcagttttagattcagagcaaatgtaaagggaggtacaaatatttcccatactcccttcccccata

SEQ ID NO: 479731 - DNA, 596 bp, Homo sapiens
agacttggatagggaagaacacaatgggactaagtcttattctttttcgtataacctttgcttatcataggtcctggatgtttccaaggcaactgcaagctcagttggaagcaacaagtaacttagatggcaagttcccaatggaattggaagtgaccaccacagacaaggacagcatgaaacagaaaacaagctgccacgcagctgtgaccatttcaataggctctcagccacgatttgccttcacctctgaggggacacaattcacctttaccaggctactcatggggcatctcagcagtcctgctgtcccacacaatttcacaggtaaaatcttagccacatctatctttctcaaggaacacaggtatgacatcaaactgatgacatcctcctctgacgggattcacttgacatacttatttaggccgtacaaacacaaaggaactctcgaaaaggggatggaccattgcctcacacatagtactaggccctgctatctcagttaaattcctgtcgttgtcgggaaacaaacattgactctcttagtgcccacaacgttaaagaaagcccaacatcttttagtcatttttggg

SEQ ID NO: 479732 - DNA, 2919 bp, Homo sapiens
tttttaaacaagagctgctcgtagctttgcatgaagcatgatgctgtcacctgctcggtctctggggaggcctcaggaaacttacgatcatggtggaaggcgaagggggagcaatgtttctgttgctgaccactaaatatattgacttattggggataataagaaataaatacatgaaaagtgatatgacaattgaaaatcccagtacagaaaatgtcacaaaagtggcagattcagtgaaaaatgaaccatgtgagaaatatgctattattgaaaagggacatggatgcagctgcaggtcattatccttagcaaataacccaggaacagaaaaccaaatactacatgttcttacttataagtgggagctaaatgatgagaacacatggagacatggtggggaacagtacacactagggcctgttggagagaggagggcttcaacttatgttgttccttccacctggaataccctgcatgaaacttgttcttactttatttggtttgttgaaatcctaccaagtctttaaagccccacctagatttctctttaatgaactcttttctttgccctttaactctctgtgacacttttactgctgtcttctattgtttctgcctttcttttgtaatgtcttaaataagacatttccccaagatgtttaaagcaacaatacttaacctttgtacaaccctttcatctctagagtcttttgcaatgggtactgaatgaagtcagaaatcttcttgcaaaggatcattggtgactacaagcctgaagatgaggctttaattgctatcagtgtttaagatttagcaggacttggtgtcccttttagacccaggagtcaaaaccctgtaactcaatgtcacaagtacttcaaaagcacatacagaaaggtacataaatgtaataaccttaattaaatttttttaatttccgtttttttcctaagcaaaccaaaacttaataataatggcgtaggaattgtttcaataaactgtaaaatctgttaggccagttaccaaaaggcaaaagaaaagaccttctgtactacacagaatattatgttggtagaaaacattttctttacacctttaataaaacttctttagcatcagggccgcaacaaacagaacttgaggaaaaaaacttatatgagctgaatatgagttggagagaattactgtttcatgccctttaaaaggggagaaaaaactgaaaacggtgagaggcactaacagttgaactttgggttaaaaaaattaaaatctcttgtaatttattaagagtaagtcaatcccttatgaaaatttcattgttctaaccaattatttagtgtataagtgttttttttaacacctgtaatttccctttaattacagacaagttgatcatataaaagtttcttttaaataaatcctcctattgtgatttaaacagactgttcatgacacacttgaactttctggtttgtcctgaacatccctctttcttaaacaatcagtcactttattctagaactaaatttaccgtacaagattctttctcatataaaattatttctctttaagctttcttaccaaaaaacctctttgtttttataactttatttacatctttcttatttcctcgttccctttaccttgttttatacatgacctttaaataagctttgaattagacaaaaattgttcaccttttaaaaaaaacatttttttgaaagaatgttttcctacaatagatttttattggaaaatacccaaataatgaaatatctattatttaatataactttagattgtaaattatgatgcatttgtctaccacactttagattgtaaattatgatgaatttgtctaccagtacttattccattacatttacctaattattttattttaattgtttgcctagattatttatgaaaactgcgatagtcatcatttaaagctacagaaccactgttgcaaaattataactgagacagtgaaaaagctctgatctaactcactccatcttgcttctaacttccaagctgtcctttttcattcctgggcataggccaaactaactttgggaggaactcagtttatagtttagctttgaaacaaagacagcaatagtcctttgccaaaacaaaccttactgcctatggactagaccacttaaaatcacaagattagaagttatggttatcttactaaattcaagatatagctattttcatgaaacctatattaatgtcttatttattaaaaattacataagcaaagatcattctgtcttggttgggtttatagttttataaccctatgccaaattttgaaaccttatagtatttgtcaggaataagtgtgaaattgcttgattaataaatgcaaacaaaaatgtatactggcaattcttaagacatttctaatattactttagcaataattttaaagctagcttatttattaaagattttacttgttacgtaaacatgaaaaagcatttgactagtcttttctttttttcctgataaagtatttgattcaagcacttttatattcttaagccaattaattagagctcttttatatattttcagtagtgaaacactgtgtatacaacacataaatacatagatgtattaggcatgtcaatagaagtacatcttatagggtcataaagacccttttttctcctatcttagactttcaaattgatgataacctgtttcacaagcctaggcagttgtcagctaaatagccttaaatttgcaaattaaaggaaacaactcaggtgaaaatcaaatagcaaaatttacatcataaggtacggagagaaaaagtatgatgtgctagagggaaattaaaactgatttaattgccaactaaaattataaaaatgatagaaattataaaggcctttt

SEQ ID NO: 479733 - DNA, 612 bp, Homo sapiens
ccaggtccctccttggacacctggggattataattcaaaataagatttaggttgaatggcttttttctgcttctctggacacgtgggccgaacacgggagccccaaatggtgcccttggccctgaagtctgcattgtcttacaagtccatcagctgtacggggatggtgtgtatgtatggaggatttgctatgaagggaggatcttcaattttggaggatgaaggaaccacaagaagtggaacctcaaatggaaggtctaaatttcctttgtttgaacttagattttcttccaagagagctttaacatttgaaaatcttgcatcttggaatggaataactcctttaataggcttcaaacagaaaattgcacaattagtcctcttgagggtagacagtgatatacccccaagcccgaagcagggtggtcagcagtggaaaaggggagtggtttctgctgagaggtctgctgttagtgtgatgggcttccttttgtaggtgatctgccctttctctctagctgtctttaacattttttttttcatttcaaccttggagaatctgatgattatgtgtcttggggatgatcttcttatgaagtatctttctggggt

SEQ ID NO: 479734 - DNA, 567 bp, Homo sapiens
cgaatagaattcagaatatggataggaacaaagatcatcaagatgcaggaatactttcctgtcacactgatttacctgctacacataattattcttattgggcttatgtgccttttcctccacttattcgacctctcacctggatagatgctcctgcagaaatctacactaacgatagtgtgtggatgcctagagccacagatgaccgttgccctgctcaaccaggagaagaaggcactgcatttaatgttaccatgggttataaatacccctctctgtgcctcggagatgcacctggttgtatccatctagaaactcaagtctgggctgcttatcttccagagagatcagctacagaggaaccaggacatttggtctctggcctctccctttctcctttaaaacaaatgaaagggggaacaggctgttatttggcttggagatcgggtaatgagtctcgaacatcgcatgcaaatgcagtgtgattggaacacttcggatttctgtatcaccccatattcctataacgagactgatcattcatgggaagtggtcaaaggacacctt

SEQ ID NO: 479735 - DNA, 700 bp, Homo sapiens
tcaaccaataactggcgagctttgatgtgtttagacacataaatgcttaccattgtgtcacaattgcctactgtattcagcacagtaacatgctgtacaggtctacaaagacgtacttcccaaagacctgttaattttatcaatgaaatggacatgttaacctggaatttaaagcagtatgaactagggaccctacttaaatttccaggaaaatcgtctccgtatctttacctctctgtagttgcaggggaaacagtttatgtgagagagtcagaaggaaatctttggcgtcagacagacctgggttccttcccactctaccacttattagcatgtgtgacatccagccaggtttctggtggccatacagacgagaaggtctttaggtcacagctgtatgtggattttggtgacccaagtaggaatcctggtaccaccacttgctacattggaaggcttggagtcaaggatggatttgatgaatcgcaggccctggaacctggtggggagaatgaagcaaatggcacatccgatggaaataatgcaaaaagcaaccagaggagaagtcagaatgaaaggtggtaacaggaaggtgaactggtttgggaccccagaattgaaaggacaacacagatgcagagcattcatgtcccctcacccaacagaaaaaggttaccaggcccggtgtttctgtatccct

SEQ ID NO: 479736 - DNA, 483 bp, Homo sapiens
tttattccttctttattattcctttatgtggacctgagtaagcgccagtgtctgttgttcccctcaatatgtctatgtgttctcatcatttagctcccacttataatcttccagcagaggcctcagatactgtggagcagagtggaacacagataagctgtccccagaaaatcctgcccaaattgaagattccactgtgcaacccacaaggattggaagatcccactcatgaacccatgccactagggcctagcgtcccaaccctggaacacgcagacgtgcaaactcttaacagcttctcagctgaaatctgcttaagcctactgaacttcctggtggagaagcaaccagcaccatggctgtggctgcctgctcccaacacactggctgtggcagtcagcttccagagtgcctcttcaggcttgactctgacccatcctttctcagtgggcggggcttccctgcaggaagtccagtaactct

SEQ ID NO: 479737 - DNA, 569 bp, Homo sapiens
gcctaatgctaagacaatgaagaagtttgctgacacctgtcataaaccatacaataattttatgtggtcaaatctaaaaaccttagcacagaaaattagcagcggcattagattctcacaggaatgtgaacctattgtgaactgcatatatgagggatctaggttgcatgctccttatgagaatctaatacctgatgatctgaggtggaacagttgcatcctgaaaccatcactcctcctccccctgtttgtggaaaaattgtgttccctgaaactggtctttggcgccaaaaaggttggggaccactggatattaggaaaccaaaagaagaaaaatactcaatgtgggccaaaatatggaaaaacagagtctcatgagcttttggtgggtgtgaaaactgaagaggaattggtagcatctctcactcccacaactgtgccatatgaaaaatccctccctgctggctcacagactccttaaggacatcttaggatgattccttaactttgctttttggatattaaaaatctgtccatttcatttacccttcagaacttttctctttccc

SEQ ID NO: 479738 - DNA, 621 bp, Homo sapiens
atgtactcaatgtttggctcccacttcttgtctagcagtctaaagccttgttcgacaatgccttctctctccagggctcccctggtccttccattgcctccacctgctagtcagcaccaggataattcgattacatacagcagtggttctccaaacatgggtcctggaccagcagcatccacatcacctaagaacttattaaaagtgtacattcttgaaccccaccccagacctactgatttagaaattgtggggctgggacccagtaatctgtgttcaacatgccctccaggtgacctcctcctgcctctaagtcaacaggctaagaagggagttacagtgctggttggggtgattgacctggactatcaagatgaaatcagactactactacacaatggagtattaccataccctgtgattaagatcaatgagaaactacaacaacccaatccaggcaggactacaggtggtccagacccttcaggaatgaaggtttgggtcactccaccaggtgaaaaaccatgaccagctgaggtgcttgctgaaagcaaggaaatacagaatgggtagtagaataagcactccatgagcctttttgtgggctggttcttacttgtc

SEQ ID NO: 479739 - DNA, 886 bp, Homo sapiens
agcaaacggcacaccaggagattatatcccacgcttggctcggagggtcctagcccacagagcctcactcattgctagcacagcagtctgagatcaaactgcaaggcagtagcgaggcttggggaggggcgcccaccattgctggggcttgagtaggtaaacaaagcggccaggaagctcgaactgggtggagcccaccgcagctcaaggaagcctgcctgcctctgtagactccacctcagggggcagggcatagacaaacaaaaggcagcagaaacctctgcagacttaaatgtccctgtctgacagctttgaagagagtagtggttctcccagcacgcagccggagatctgagaacggacagactgcctcctcaagtgagttcctgacccacgagtagcctaactgggaggcaccccccaggaggggcagactgacacctcacatggctgggtactcctctgagacaaaacttacagcggaacgatcaggcagcaacatttgctgttcaccaaaatctgctgttctgcagcctccgctgctgatacccagccaaacaggatctggagtggacctccagcaaactccaacagacctgcagctgaaggtcctgactgttagaaggaaaactaacaaacagaaaggacatccacaccaaaaccccatctgtatgtcaccatcatcagagatcaaagtgatggaagatcaaatgaatgaaatgaagcaagaagagaagtttagagaaaaaagaataaaaagaaatgaacaaagcctccaagaaatatgggactatgtgaaaagaccaaatctaagtgatggggagaagggaaccaagttggaaaacatctgcaggatactatccaggagaacttccccaatctagca

SEQ ID NO: 479740 - DNA, 654 bp, Homo sapiens
aaaggcataagaaagttcatattaatgcaaggtgctcggatgtgtttggctacaacaatttctgacaaagcaacagaatttggcgatgctgatgctctaagaatgattgaatggataaacaactcatacagcttgtcggatctaaggtctcactgggaagcacaaaggaagcaggcagcagaaggagacatcaaatggtgcagcctgcagttcccagcagtgactctcaatgggactgcatgcattaccatggttcctgcaggaactactgcccagctgattgtcagtggaagtgtggacacaggctatcctcatttctcctacccttatctggtttcccagcagcagatggtgatggtagtcacgtttttccagctgtccacactacagaggaggacccaagtttgtctgtacactcccttccctcattttgaggagtctgagggctgaaatgttatgcaagagaaagatctggtttgatactttggatccctctaaaattctgtaatttttatctttaatgaaaattgctaaatagtacaagcttggatagtggcaaattaataaattcaagcactctataaataactaaagtattaataagcatctctctaaaagtttgggcagaaaattatcttaatcttacattattat

SEQ ID NO: 479741 - DNA, 524 bp, Homo sapiens
tcggggctggcatgtctctggttgggaagggctttggaatgtttctgaactactctttcttccttggtggttttataactcacaaggtgaatggtgataccctgaaagatcaacaggaataccctcaggaatctgacaatgcagaatacagggatacagagagccaactatacattatgctggctacctgtaccaggagtactcttgaaggaagaggacaggaggctcccactggacacatgggatccaacatcacacttctaaaaggagatagtcaaagtctttatccattggtccctggatcagacctcatcaaagcacccggccatagtcagaatccaagaatgaaacaatggccaagttcagggtggaaccaaaggtcctacacttaaacaggtccttgataactgagtgtaactagtattaattattggtaaagaacaggtgagataacatcagttataataagctttattttactgggttttggatttttaaaaaatttttattttaagttcaggggt

SEQ ID NO: 479742 - DNA, 1307 bp, Homo sapiens
tcatctatgcacagtgaatagacacaatggtgagggctcctgaaagatggcaagctacctctaaagtgaaaagtttgtggtggagtgtctccaaattaaaaagaggggaacacgggtacagaggtaggcagggtaaaaggattttaaaataatactgcttaggagttgtatattttaagataactactataccttgtctacccttgatcctaatcctcaataactgcatgttcgtgcaaaatacaatttctactctataagaagaagagtagcctgttaggaaaagcatattcttaggggaagacatgaagacatctctttcataaatgcaattttacttggtgggtcttttggcatcactatatgctatttcaacctccttatcactgggacaggtattgatgaactcgtccctactatatgcattagttaggtatctccagatgccagtcatctcttttggaatatcaaagttgtgatattttttggccaccaccttgacaatatgcagtttggggagcaggctgcaatcagctaatgtcatttcattgccatccagaaatttatgtgtagaaaacttaatgtcctctatactattttcatcaatttcatcagggagaggagaattcagatatttatccagtttctgcagggttttcaggagatccttctccagtgcttcattagcctctcgccttcaattcttgataaatgcagagaatttggcaaagatgtccattccagcagtatttgattctgggtgttttggtgaaagctttaagtacttgggagggcataagacttcttcaagaaattcctcaatcttacttacatccgttttgacttcactgttgaaacttacaaacggtgggtgggtcctgggagctaagttctgtaggtctgcaggcttccatttcaggtcaacagttgtgacactaaatacaactcctttgagtcaacgaatcatgaagaacctctgggaaaaggggcagtttcctatgctttcaccatcactgccagctttgacgaggagctcaatgaggggctctttgtcctcctccttcagcccgttcaacggcatcgacaacgccatggccggctcggctgcgctccgcaaacggcgacggctgctgctgctgctgctcctcctgctccaaggctgctccgactgccggctcccgccgcagtgctctctggacatacttatgtgctaagcactgttctaggcactatatgtgtattaattcctcgttctaggcactatatgtgtattaattcctttaatccttataataaacctgtaagtt

SEQ ID NO: 479743 - DNA, 557 bp, Homo sapiens
tagtgcgcatggcctgtttgtcacctgtaaatgaagggttagctcaccaacaggctctgcccactgcccacaaatacaccttcctggggcctcttctgaaatcatcgttctttacattgcatccaaactctccattgctgcctccaaatcctagtgaatgtctgctagacattcacatcagctttgctgaagtctggattgtcaatgcgctggtcagctactttccagaaggcttggcatttaatggctggaaaattgcccatcaggtgccaggagacaggaaacttgtagctccttacctcctggatgaaagcagcgatggtgatgacatcattactgttaattacccctttgcaaaatctgcttgaatggcgaagaggtgggtgtgtctatgtgggtatttaatgtgatgattaaaatatattaatgatagttttcacttctctagcatcgtacatcttaggatcttctttaaaagtgcttccacaggctttaattaggcattttaaagtaaattccagacatcatttcactataaatactttgtgttttttcct

SEQ ID NO: 479744 - DNA, 602 bp, Homo sapiens
aaatactttatagatactatggtgatactatctaagaggcaccagctccagccagagagctgggcagcagctgccagccaggatgaagagcctctgaccccgaaggcaatgggcagagctgggccaccaggaccatggggcaaacatgccactctccctccaggtgccaaccaaggagccctggggctgactgtccctgtcaatgtcatccctgccaatgatcacatcccagcagcaacctgggctggaccgaggcccccctttatgaatggattaatgttgttacttcaggagtggggaagcagaaatgttcccaggctcctgatggtggcagccaggcctagtgacatggtgaaagcggacccggagagtggctggcgtcagccattcccaggccatgctctctgctacgctcccatcaggcagccataaaagaaatgaagctattttaagcctgcatccaaatgcaagcaactgagctggaactgcttgcaggatgccgtctgttaacagccatggctgaagactgaaacctgcaggatgggcaccaggagcctgggtcgtgctcctttacagggccaggagctgtccctctgcaacac

SEQ ID NO: 479745 - DNA, 656 bp, Homo sapiens
gaattttcttttgtaatacagcatggcccctatgcagaaaacctcaaatcagtctcctcagtcttttataaccaagagcaggataaggacagggctaaggagaaagaaaaatgcagggacaagaagcaggctcaactgttggctgctttgcaagcccccagcctccattccaggctgccctaaggatactcctccagataactgccatcagtgcagaagcccaggccactggaaggcaaactggccctatggcatgaatgacgaaaaacccccgcatggcttgccccctctgccacaagctcggccactggaaatgggactgccctggagggccaaagggacaagtcagaaagccctgatgtccaagtcagaaagtccatgtcataaatggtctgtgcaagtagtgagaaggttcgcaaaggagaagttatgaaaggaattttctatgtgtttaagttggttataactgaaagggaattatttaggatagtctaacattggtcccctatgttaaaaacaagattttcttaagatattaatctggtcttaataaaactgtaagaagttaaagcttcacagaataatatctcagttcaacttttgctgtgccctgctgctttcagctttttcttcccggagaatgccaaagataataa

SEQ ID NO: 479746 - DNA, 754 bp, Homo sapiens
tgctagcaaggttgcggagacaaagaaaaatatatacacttcattcacaatgacagtggtggcagcattatgtagcgggataggggccttgctgctgtctgtatgtttatttgcaccagaaatggtgttagcacaggggtggtgtgccggctggcacaggaccgtgtgtgctttcatgcatgtattcaaattggcagcagctgctgctaagtttggggtctccatgctcataaaggctctgatggcaatgaaggtgcatcaggggagtggggttgtgtgcactaatatcaacagctatgacatagtggggtgcacatacatgtgcacaagcagggaaggggtggtgaggtctacctgcatgcatactcactggcaaagcaatggtgagggtggctgtgggcaagtgcctgcaggcaaagaagctcaggggaggatgtggtggggagacagaatgtatgggctggtgcacatccatgggagtgctctactgggctctccatcagtcaagtatggctctccagcacacaagctataacgtgggcccccaagacgcatcctatctgggcatctgaggcagcactgcaagcagataaaggttaaaatgattattttaattttcattaaattaatgaagaaatatatacagagaattaacgtttagcaaatattaaattattcattctaaaaaataatgcattcttttatatattttggtcttattatatttccttcagtaaagtttttgagttgtctt

SEQ ID NO: 479747 - DNA, 990 bp, Homo sapiens
ggcctgtagctgctttattttgaccaatttctcccatttggaatgggggagtgagtgtcccttcccgtgctccgctgcagacatgcctgcaccaaaccctctgtgtcctgcaccagattttaagtgctgcccataccccttctctaagcagctctccctgccaactcaagcgtccatggtggtgaagaagtctccttctgcagggattccagaggcttgtgctcaactcacctgttcctccagagtcaatggggaccagaaacatgccctggtgcatttctgcctgtgtcattttcagtttcatctccctttaatgcagcttccttgtcttccctctgtccattctcaggaccttccctctgaagatcttttaggaaggcaccagtcagtcccttggtggcagttgttccacctggctgcatctagttggctaactgtcccagctcccacaaagaagcattttagaggtcacggaacaactgtagattttcccattgattgctaagattacttctcaagtcacttttagagttcaacacaattatggaaagtgaggatgacctagatattaaaatattattatttaccctatggtgtgtcttcagtgcaaatttgtaaacattttaaggcaaagaatatctcaagcttaacttttttaatattaaatttttattttggaataattttagatatgcagaaaagttacaaagatagacttctcatatattttttacccaatagcccccaatgtttacatcttatataatcatgccacttttgttaaaagtagtaagtactggcatcctatcatttcatgtgtatttcaacaatctttttactaatattttttattccactaattgccttatcaatcaatgaataccagtgtacattccaagtaatctttcagaaattatcactttcctttgttccttccttctttcgtttatgtacttaagacacattttaaatgtctatatgctaggatac

SEQ ID NO: 479748 - DNA, 629 bp, Homo sapiens
ggtaccatttgacagttaccaggggtgggagggggttggggagatgaagtttattacagaatgtcttctgtattcacacctgtggagaaaggaaaagaagaaggattggcccaagaaaaagtttggcttttactcagtcccaataaagggctcagctgacccagtgggaatatttcaaactgagatgatacagcaatattttcacagcagaggacaaggcttggggctgaagtttgtcagacagcagcgctttcagccactgagggaaataaatcgttcagccctgaaaggagaaaatggtttggaaatgattgataatggacacagaatgggatcaaaggacaaacaagaacttttagacaagttacataaagaatgtattcatattaattttgttgatcaaatcatgttcatctaatgcttgtgtttatgttaaaatatgtaaataaaatatctaacagatgggagaatagcctgcaagaggtatgcaaaaccttggaaaatataaattatttatattttattattaaataatttattattacaaaacatatttataaaagagcattaattgaaaatttatgtctgtactaataatttttaatgataattaatggagaaacttgatt

SEQ ID NO: 479749 - DNA, 1075 bp, Homo sapiens
acaagatcagacatagaaatgtctttgtcttttgtataatcagcgggctcccaggaaaaagtttcttctccttttgtgggcatgaacacagtgggctccagcagattctgttgggcacttttcttttttttggactggactgctgatgatcagcttctaaatagatgcaaggactggtgtggcttccttctgcttgctggaagggctcccaatgggtcattagggatgagggtttctgagaagcaaactgcagtgactgttatttttcttctgaatctagccacccagcagagggctctcagctgtggataccagcacctgctccagtggaggcagcaggaaagtgaagtagactatgctacaagcctctcagctgagaaaacaagccgactcacagttctttggctgtccgtggagcctgtagcagcaattcacctttttcaaagggtctgtggatcctctaggctttcctggtatgttcctgcagtagtttttgaagttcacgatggacaccaacagtgccgccttcaatctgtggccgaaggcctgagagcccctggcaaaccactgatggaggtgagttcccccagactccaggtgggtccacagagtgaagaaaatgaagtaggacatgaagaaaacactaagaagaaaccacaaagccataaaagtcataagtaaaaaaagtcatgaataagtagataaaaagatttacagttgtaaagtaaagtagttgattagtagtggcaaatgagtaaaaaataaataaaactttattgctgaagatataagagaaatccccaagataatcaagcaactagatgtgctttaaacactgatgaatttccaaatttccatttatttaaggcctaatttctagtcttcccatgaggccttaccttatgtatttacctaagcttctgtgaagcattgcactggatttaaaataattgcttttctttttatttccgtgtatgtcttaaaaaatttttaatgaagattttggatttcacatgtaatattccaactttgccagctaatacacaaagaactggcttctagcttgtctttcaga

SEQ ID NO: 479750 - DNA, 596 bp, Homo sapiens
tctaccagcatgccagcgtctatcatgtgctgttttgccagcgtgctcgcctcaatgatgttgctggcctcacagaatgaaaagacagccttcaatctctgggattctttccgctgcctggtctactctaccattaatacttatgattgcattttgaagttattgtgtgtttttcagctttatcaagatgtactgatctgttgccagccagaaagcacatgtaggagatggctggagaccctgtttgggagttctcactcagacaggaggaatgggattagggactcacttaaagaagcagtctggctgcttttttgtaaagcagctgtgctgttttggggataccttcagcccctgatagttttaggcttcccaaggcccacagctacaaataaaattaaaaacctagtaattaaccaaagaagtaaaaaatctctacaataaaaactataaaaaactgattaaagaaactgaagagggtacataaaaaatgaaaagatacattatggtcatggattggaagaatcagtactgctaacatattcatactatccaaagcaatctacagattcagtgtaatccctatcaaaatatca

SEQ ID NO: 479751 - DNA, 968 bp, Homo sapiens
actcagccagactcaggaagacaatggggacaacctgcctacaaataggagctacccactctggctgtaatacaaacagggctgaaacacgcccctcgtccaccacattgcaggtgatgagaaggagagaagagagaaggagagaagagagaaggagagaagaggtgcagcccttcagggagcccagacttagaagctcccaaagccagggctatgacatcctctttggggctctgtggttcatggcgccaccatgtttcctagtgcccacagtggaagctgcttgtggtacacctgatccaactgcagcagggagccagcacctgtgccagtgcctggagctgcctgccccaccacagcagctggtgtgcctggctgtgcacagtagccagattccatgcttgctcattcacacatctcttaccactccatgcctggctcacccttggcaagcacgggatccgggctggtagcatgagccgaccacagcctgccaggccaagtgggcggaatgagcccagtgggcctgagcaaaactcaggcaaaggtgccaccagccccagaggcttctggctggaaaagtgacaccccaaggatcccgtgacaatttccttcctagtttgctgagggtttttatcatgaaagggtgttaaatattgttacatgttttttctgcatctatcaaggtgattatgtgatttttatctttcattctagtaatgtggtgtattgcatttattgacttgcatatattgacccactcttgcatcccagggataaatcccacttggtcatggtgtataatccttttaatgtgctgttgaataatgtttgatagcattttgttgcagattcttgcatcagtatttatcgtggatatttttctgtggtttttcttctcttgtagtatcattctctggctttggtattaggaaatgtgttgaaacatctataaactccaacctgaa

SEQ ID NO: 479752 - DNA, 1724 bp, Homo sapiens
agctcctttagataaaccataactaggctgggcgtggtggctcacacctcttcagccatattttactttcagttccttggaggggtgatgactaatctgctgaccatctcccacgcagcaccctctgcctgaaatgctctcagtctttcctgcttctcctcctggattatatcctcaagatggggctggttggtcaccagaaaaaccaactgattggaaattttaccccagccacagacttctgggaagctgcaggtctgttggattttgttggaggtccactccagaccctgtttgcctgggtatcaccagcggaggctgcagaacagcaaatattgcagaacggcaaatgttgctgcctgatccttcctctggaagcttcgtttcagaggggcacccggccttatgaggtgtcagttggcccctactgggaggtgcctcccagtcaggctacttgggatgttagctttgcaggtcttcatattgaggatgatgaacctttgattttaaagacaaattgtgataaaagaatcctatactgctataaaactgatggcgcctatcaaagcattgagaatttacattttgtaaaatacccatgagggcaacttaggacctaactagtaaagaaggaggttctgtatttcgtaaacttcctccaggataatttcaaacgatgccattgcgatatgaatatttgaagcctttggtgccattctgttccaagtgtgttctaaagcaagcagaaaccctccaaaaggatcagaagaaatactcttctgtattagaattatttatctttagagatagttgccagaaattgctttctatagctaactactaatttttttcagtcttgcaagtttttagcctgatgagttgcaaaatgatcagaaatttaaaacttattgatatttgagttgtgttttcatttatgtgactatccttttgcaattttctatatagccacagaagacagggttccatatgaaaccaaaccctctagaggactaatattattctcagattaatgaatgcttcttcttttgataaagcccccaaagaggaaaaatagaaagaatgtttgcaaagataaaggatcattgaaagtatattgaaatggattttataagccttacataaaagactatttaaagatttatctcttctagatttttagtgagagtacaggtatgcaatattttagagaaaataaaatattctggttagtcaaagttctgattcctagaacttgaacaagacatagaatatcttaatttaaggaatcaggattcaggaagataataataatgctgtttttttttcaaaccacaaatggtcaataaataatgctgcttttaaatggagtctaataagaaatatcattgagttttttatgtgttaatcactttagagtgtttgtgtaataatcattctagtatgctaatcattatctgttttaattcaatattacacatattgtaaacttggttctgtagaaaagtataatttaacttgcctttgtacttgtgaaaaataagatggactaattgatagaaatttacaagtcataaaatggttgctaagtaaacttattacatgaaatgaaaaaagaagggaaaatgctgacaatagagctgcatagaaattaaaataacagatatattaaaattgaatagattttagtgaattactttaatcttttttcagttttccaggtagcc

SEQ ID NO: 479753 - DNA, 1361 bp, Homo sapiens
accactactctctcctgctccccacttcactctcccatggcattgcagtgcatggatcccagctccgtgagtggaaagcacacgccggagggcgctgctgttgccactgcatacccaagagcccactcggaccctccagcagagggcgcagtgctgcctctgctgtgcaccgctgtgccgcctccgctgtgcaccgctgtgcaccgctgttactgggcttcatttgctgagagttccccttccgcagtcagccaattaattgaaggcccgaatagaacaaaaaggctgactcccaatagagaattctactgcctgtcagtctttaaactgcaacatcagttcttccttgttctgcagcaccctgctgaccttcagactcaaactggcatatcgactctgcagatttttgacttgccagcctccataatcaggctgaagtggctgactgtgtgcactgtcacatgtgagaaagtacatgtaagagtgggcgtgcaggtgtgggtgtggaaggaagcttgtatggaagcctctggaaccagaggaacttttagttgactcactgaagtagtgttgtggcaactgtgggcatttttgggaaatggttaagtggaagttaaatcatgaatacatgtagcctgggcatagtggggtgtatttatgtgatttagagtcacttttgtgtgcagttaagttattgcttgtcattctggtgtaggactagcttctgagaatattcctatcacccagtgagtcaacctacctggtggtgtgacaagaaattgtagtggtaaaagttctatctcaatacaaacttgtgtactgccccaaaatcaaaagtatgtgagtagcaaagagaaaataaagcatggaatatatgaagcccaaagctagtgtgtagcaaaatccttccaattacttaaatgtgtaaaactgtaagcaggagatttgcttttcattttcaactactcagaatggaaattctctcccatcagaaacaaactatacactttacaattttatttgtcagtgatttcataccaattattgaaaaagaaaccataaaattcataatatgctactacaatgaagacattgacaactaactggttaatgagagctgtcaattcaagaacatttaagattagtcattgtgcaagaacccttgaaatgcccccaaatattatagcttacatatcaagaaacttgatagaagtcttcccaaatttgacagttgtaaaaagcttgtatgaccttactggtaatgagttgcacaactgaaagatatttttctaagtcatggagaggcaattaaagagtataaagccaaaggattgtggcccccccgccaaaaaaaaggtgtt

SEQ ID NO: 479754 - DNA, 793 bp, Homo sapiens
atagaccacaggtgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcattgattaaataagaattacatttctgtgactaaatctcagtttgaaaagaaaaaaaatttatttttgaaaccaagcctgtatatgtcggccattcgtgttgttatgaaggattgctctatattttagaaggatttttctatt

SEQ ID NO: 479755 - DNA, 709 bp, Homo sapiens
gtaggtagcattggaaaaggcaacattcagttggtgtatccgggctgctaatgcagccaccatcttcaatgttgtcagttgctgtggcagaagggaaaagagagccctggagagtcgtggggcttcaatcagtgctcagcctggaaatgacactcgtcacttccatattcagtgggccatattcagtgaatatggtgtcagccaaagacaagatcaacccctctcacataaatacaaatccatattcaatcacagtacaagccagttctagaccttatgtctggtatttaccaggggttgcaaatatttggaaacatgacattgacaaggagtatgcaggcctgcggggaaaaaaaaaatggaagaacttggggttaacagaacctaaaatctatgaggcgaaccctcgaagggctggggcccaggcctctgaggaagtagctctcactcaatcagctggtgctggtacctttaagggtcgaaaaataatgcagctatagaaaacagccaaaacactaggcccattttcctgatatgatcaaatttatgtctgaattacaaattgccaaaaaaactttataaattctttttcattttgccatacagtgctttataaatttatgaaaaatatacaatgttaaacagtttaatatttttctaagttcataattatgactcatttttctaagttgaacagaaacagtagaaa

SEQ ID NO: 479756 - DNA, 845 bp, Homo sapiens
agcagcgtctctggcctctccccattagataccagtagtatatcccaagttatgacaaccaaactgtcttcagattttgtggaattcttgttcccagatagtctgagtttaatgagaaatggctaccccgcaccactacctatccaactgggcaaacaaggaaccacggtatcatcgaaaccattttctttcctacccatgcccacccttccattgattttaattcttgcaaacgtggtttcactgtttgttatgttattctgtgtgttttctatccttgaaatatttcatgaaaatataacaaaagaagcaaatggcattggtaaattggggaacggaaggatattcaaagtgggaacagactatagccataccaccctgaatgtgcccgatctcatcaaagtagaaatagaaaggggtcttgtgaaaacgcagattctgatactacaggacttgggtgaggcccaagaatcagcatttctcacacgctgctcacagctgccagaggatgctgatgctgctgatgctgctggtctgtggcccatgctttgaagagcacattctgtggccaggcatgggtgaggtgcttggcttttcaaaatctcctggaattctcacaaaatccagcaaggctggtattatctggctacttgcatttttttctttttactatattttctatgcatgtgcatggatataagatatatgttcctacatatatcttcagatatattgttattttagcagctgtcactcagaaagaaagctgtcattgttaagaaaaatcttggattaattaaaatgaagttattatttttgcaggtcaaagatgatcaaatatcagc

SEQ ID NO: 479757 - DNA, 678 bp, Homo sapiens
tttctccgtgggccacaagaatctgtctgtgtggtcaacgggcagaatgctaagatcatggcattgagagagactccaagcctggggaaagagcctagaatgccacccactgtgatgaaaacagccagcactcacaatagtgaggggccattcgatatgggtgcacctatccacagtgccttcagcaaatttgctgcaaaaacagtttttgtggggtttgtagcaaaattatatgataagaaggacacgaaccgaattccttttttaaaggactatgctggtttttgtagcccctggctgtgtagtgacaacaaatgcatgctaaggggcagtccctgccatgaaactgacactttctcctgccttctcaaccgccagccctcacctgtggggagctacccccacgactcttgtcctcttcttttgcctttaagtgaaacccacctgccttgtgagcccttgagctaaacagctggaatatggactcataagtctgggattgctggggagtgtgggcccattgagaattttgtagaagaccacattagaagagcatggatcctacatcttggccttctttgcgtcgagaaagcaaatctttgtgggggaactgaagttaagctttgagtatggaagatggaccctgagggtacatttttggaaccttacctagaagcc

SEQ ID NO: 479758 - DNA, 632 bp, Homo sapiens
acacctacttaaggcgctacccacccaccactcctgttctctctgcttggactgcagaaacgccttcacgtgtcagcattggcttgaagatccagccaatggccaagatgttaataaccatgctgccacaagatggcgcccaccacccaatatctcgggcttcctgatcagactcgacgcgtgcttgtgacacagcctcaggatgtcctgacgacatgtgcccaaggtggttggggcacagcttggttttacacatttttgggagacatgagacatcagtcaatctctgtaagaagtacattgattcttccagaaaggggggacaactcgaagcagggagggggcttccaggtcacaggtgagctctctgtgacagggatcctttgttctggattgatggcttgcgtttcttctttgctacctggaggcactggagagttgcaagagtgcaagtccaagctatggcctatggaattcatgcacctgctcactctcagctgcactgtctgcagtgtgaattgctcagctggagagggtgtgagtaaccagctccctcaagccccaacaattctgaacacttagttttataactaatctatacaaagcatggctatgagcttatcggtaattct

SEQ ID NO: 479759 - DNA, 2559 bp, Homo sapiens
tctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacgcaacgttagatggttttgatggtaaaccctaaaggaggactccaagagtgtgtatttatttatagttttatcagagatgacaattatttgaatgccaattatatgga

SEQ ID NO: 479760 - DNA, 2983 bp, Homo sapiens
ccagagtcatcatgtctcctgagcagaggaatcagcactgcgagcctgaggaaagccttgaggccgaaggagacgaggctttgggcctggtgggtgtgcaggctcccttggctgaggaacaggaggctgcctccttctcctctcctctgacagtgggcaccctggaggggctgcctgctgctgggtcacctggttctccccagagtcctcagggaacctctacctcccccactaccattgacaacactctatggagccaatctaatgagggctccagcagccaagaggaggctccaggcacctcaccagacccagcagacctgaagaccttgttccaagaagcacttgatgggaaggaagtggataccactggccactcctacatccttgtcacttccctgggcctctcctatgacggcctgctgggtgatgatcagagcaagcccaatgcaggcctccagataatggtcctgtgcacgattataatggagggcaactgcacccctgaagaggtcatatgggaaaccctgagtgtgatggggctgtatgctgggaagaagcacagtgtctatgggaagcccaggaagctgctcacccaagactgggtgcaggaaaactacctggagtaccaccagcaggatgcctgggtctgcagcgatggtttgggtggctgcagctgcacccaggggagtgaggctcctgtctgctccatgaagcgggaggcctgtatccaaagctgcgacttgggtagctgcagctgcacccaggggagtgaggctcctgtctgctccatgaagcgggaggcctgtatccaaagctgcgacttgggtggctgtggctgcacccggggagctcccaccccaccaactcggaaggggcagggctcccacttgtccctgcctcatgctggttccaaggagtgtgcagccctggctgcacctccctgttgtagttcatatgatggtagcatccactccagactggccactgctgccttcagtgagacatactgggaaaccttccatattgctttgtgacttataacaatataccatggcattggaatagatattttcttggcaaatgtaagaaattatcaataagattgatggggccataaaataaaaggaaaagtctgctaattctagcctttttatccattttcatctgttgttctataaaaattgaaacatatacatataactggatttgcttcgctttttgaaggttgtaggagaaattacaacttaaacaaaagacctgctcactgagtctttctttccacaacttttatgagcatctcctctttggaaggctctgggttagtagtggagttactagaataagccagagaaacccctacccttagagtagtagagtctaggagttgcattcatgtaattaaggtggcgagatgtcctctaagatgcagaggaaaagtaagagaggggtgagggtgtggggctccaggaaaatccttgtttgcaaagtgcctaatggcacttgcacaagtcttcagaaattcctcccagaaatgaagaggattgctgtagtaataaattataatacagttgacctttgaacaacatgggtttgaactatgtgggttcacttatacacagactttttaaataaatatattggaaatttttttggagtttgcaacaatttgaaaaaactcacaaactgcatagcctagagatataaaaaaagagttatgtcatgaatgaataaaatatatgtggatactaggatattttgttatttagtactataaaatatatgaagtctattgtaaaaggttttatcaaaatttatgtacacaaaaagttacagaccgtacatggtattattcacagtcaagataaatgtaaacaaatgttgagatgtagtattaaatcataactgcataaaattaactgtagcataagctgtgctactgtaataatttcatagccacctcctgttgctattgcagtaagctcaagtgttcttctatctgcttgaaaagccatgggacgctaattatctccatgtgaggagtttgtctctccagtaaattgcgtatagcagtaaaaagtgatctctcatggttctcacgtattttccatcatgtttagtccaatactttaaaacttgaataacaccattggatctatacaatgtgccactagtgatgctggaattcctgccaagaagcagagaaaagaaataacattataagaaaagttgaattgcttaacatgtaccgtagattggatttgcagctgtagttgcccactgtttcaagattaatgaaatctgcataagaaccattgtaaaaacaaaagaaaaaagaaaaagaaaaagaaattcatgaagctgtttctgcaactacatcagcaggtgtgaaaaccttgcacattttgtgaaacacctttttatcccatatggcaaatgcagcctttatgtggtgcagaattgccacaagaaaggcatacctatagattctaatatgaatccagaaaaatccaagttattatatgataacttaacgcaaaagatccgtgtagaatataaagctggagaatataatgccagcaaaggatggttcaataattttattatgtatatacatatatatttaaatatatacataataaaatgaaatatatatatgtatacacattatatataaactgggccaactgaggccagatattggggagtatgggcaagtttgggcaaagcacaggtatatatatatatatatatatatatatatatatatatatatccatatatatatacccactgggatagaggcagtggtttgataatcttagaaagagatttggcttgaaaaatgtcaagataacaggaaaagcagcttctactaaccaagaggtagcagacaagttcccagacgtcattaagaaaattattgagaagaaaacatatctgcctgtacaggtttttaatgcagatgaaaataccctactcc

SEQ ID NO: 479761 - DNA, 5301 bp, Homo sapiens
tcagtgtcgggttgggaagacgtgctcagtaaatatttgtgtgctgtaacctatgttaggtgctttagatgctggcggtctcagcatggggtgaagaagggcttgtacacttaagatgccttacagtactgtgcagtgctgtactgcgggggccaactctggggacctatgccttggctgcttagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctctttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtctacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgt

SEQ ID NO: 479762 - DNA, 1613 bp, Homo sapiens
tccctgagacagcagctggggaatgaggaaagtcaaagattggatgccgagaaggaaagcagagcctttgggggcaggggagagggagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggagagccgagtggcctatgcacagctgggtctgctatgcagcaggaaggctaagttggagacagatgtgagaactaaccatgaaggaggagggggaaaaggagacagaaggaattaccagaacactccagagggctccaagactgtatggtgggatctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagtttagtggtctattgcagctagcctgtgttcccagtgaacctggaaacaaggttctcatctgtgctcaggcctcaggccagaaagggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaa

SEQ ID NO: 479763 - DNA, 631 bp, Homo sapiens
ccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctggggcgtgcagagagccccaacacccacacaccagaacccagaggtatccctgcctgtgatttttaatttgacagtaggtggcagagtcctgggagacgtgggaagaggccataagagaatgcagacatgggaatggattaatccagagtccagccatggtctgcaggtggatctccctgtctcggcctgctcacttacaaatgggtgctcatttacaaatcggtgtgaatcacatttcatcatttgtgagctccttagtttccaagaagtacagttttctcatgtgtttcttggactttatgcatatgcctccagagtttgaatcatgcaaagatgctgccacttaaaaacctctttcctacaaacttacacccctcc

SEQ ID NO: 479764 - DNA, 1496 bp, Homo sapiens
gggacaggctaaccaggaggacaggagccccaagaggccccagagcagcactgacgaagacctgtaagtcagcctttgttagaacctccaaggttcggttctcagctgaagtctctcacacactccctctctccccaggcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggagcgcctacaaatgctcatccacatctttgatcttctctttcctgggcacaagggacgaatacataatcagcacttctgtctggcatcagcacgttcccgtgtcacagtgcccttccccggtcactatcatgtttcctcccttctgactctgcgacctgacctgctgcttgctcttcactgttgcctccccctggaggctgggcagacccccctgcccttcctgcaacatggagcattcctagcccttgaagtagtcccctggttctcgcacggctcgcccttagtccagtcccacagccgcaaccattctggacggtgactttagacacttggtcctccctccctgggagaattctactctgtgtattcccagtgggctgtgagaagagtccaatttgacccataagctcctggttgggttgcagcccccaggattgagagagtattttcgcagtcagttgcatatttgtagtaggattttatt

SEQ ID NO: 479765 - DNA, 3624 bp, Homo sapiens
actcaggacaccttggactccagatcactggggacctccgcccttggaggtcccacgcacgatggctgcatgtggtgcatccctgcctatgccttggagacaacaaagaggagagggctttggttctcagcggacaggccggccaggaggtcagaagccccaggaggccccagaggagcaccgaaggagaagatctatctgtgggttcctccccatcgcccagctgctgcccgcactccagcctgctgccctgaccagagtcatcatgtcttctgagcagaggagtcagcactgcaagcctgaggatggccttgaggcccaaggacaggaggctctgggcctggtgggtgtgcaggctcccgccaccgaggagcacgaggctgcctcctccttcactctgattgaaggcaccctggaggaggtgcctgctgctgggtcccccacaacaacactctatggagccaatccagtgagggcaccagcagccgggaagaggaggggccaaccacctagacacaccccgctcacctggcgtccttgttccaatgggaaggtggctgagttggttcgcttcctgctgcacaagtatcgagtcaaggagctgctgaggaagctgctcacccaagattgggtgcaggaaaactacctgcaataccgccaggtgcccagcagtgatcccccgtgctaccagttcctgtggggtccaagggccctcattgaaaccagctatgtgaaagtcctggagtatgcagccagggtcagtactaaagagagcatttcctacccatccctgcatgaagaggctttgggagaggaggaagagggagtctgagcagaagttgcagccagggccagtggggcagattgggggagggcctgggccagtgcacgttccacacatccaccaccttccctgtcctgttacatgaggcccattcttcactctgtgtttgaagagagcagtcaatgttctcagtagcggggagtgtgttgggtgtgagggaatacaaggtggaccatctctcagttcctgttctcttgggcgatttggaggtttatctttgtttccttttgcagtcgttcaaatgttccttttaatggatggtgtaatgaacttcaacattcatttcatgtatgacagtaggcagacttactgttttttatatagttaaaaaacatggagcatccctatcccctgcagaacccccctagctttcccacggctcaccttcggtcctgtcccacagccacagccacctggtcctccctccctgggagttctatacacattctttattttcccaatgggctgtgaatagactatactttgcccataatctcctgactcttgggaaacagccctgaaggtggagagtagatttttaagccactcacatatttgcagtaggattttaatgggcttcttatctgaagctgggaactgaacaggcaaacaaatagatagtgctcagaaattccattccttcgtaagaggtagaagaggagcacccatcctctaaagctgaattcttacaaacactgggctcctcccggggtatgagaaatgcgtccttgatggacatgccacctggaatttgaaaagaatgatgaatcactcttccactgcctcctgtctggcatctgcacccagggacatactggctttcagtgtgactagtggcacctgcacaggtgtttaggcaagaacagttatgtggagagaagcagatatgtcacgtaagattctgcccctgcatcaggtggaaggaggaaatccgcagcctcctgagatgatagatggcattgcaaagggaagtgcggtaaatgctatggagtatggaaggtgaaatctccctgctaacttttgcaggatcttcttcaatttgatgggttaatgcatttgaaagcatctgctacgtggtagacacttgcaaattcagagaatttcaaggcaaaactggtcttctcagaaccgtctataagaaatgaagagtgtagttatcataacaaattagagtttgtatgtagcttcttctacttctggctgcgttcatagccgttgtttctccacaactatattgttcaaatttctcatattgccatgggacattttagctagtctgatctattgaaaaaaataacacttggtttcatcaattgcatttattgtttccagaagtttctgaagtttcaatttcattaatttttctcttcctgtctatatcatcccaatccttttgttttcctcaggtttaatttacttttatttttctaattatttaacatcaatgattagatgttttatttgagccatttgttactttcttacataagcactcaaggagataaaaattaggcactacgttagctgatttccacatattttaaaacatcatattaccatttttatttatcagaatatattttctcattttccttaataattttttaaacaaagaagagtaaaaatgtgttgtttatttaaaattacatggagactttacaaatatgtcctttgttatatttttattttattctggatctttaaaatttccactttgtacaatttcaattattaaattgaaatgtataatttgaaatgaatacattttcgtattaaaacgtatattttgtacaacttcaattattttaaatttgttaagagttgttttacggtctatcttggtaaaaattccacatacacttgaaaacaatatttattctgctgttgttctgtgacgtgttcagtaaaagccagtcagctcaagttggttctttgtgttattcgggttggtctataaccttgcagagtttctgtgtacttcaatcatttactcagagaggagttttgcaatctccaaatgcaagtgtagatttgactatttattctttcaattctatcagatgtttcatgtattttaaaacaatgcttttaggtgaactaacaggattatgatgtattttttgttaattgactcttttatcattgcataatgtccctatttatccagggtaattttccttcccataaagtttttaaaagtttacttttctgtttttccagctttctttttaattttcaattttattatttaaatggacaaacagtgtttttttccttttctgtccaattctgtgggttttgctcatgtatagattcatggaaccaccatcacaatcttcatacaaacaattccgtcaccctcctctccaagagaaaccccttttacttgctatacacttatagttatacccacatgtctacaactaacagtgggaacctctcatctgtactcactatttcagttttctctttcaagaatgtcacatgaatagaaaaaatagaatatgtacctggttgagactggctctttccacacagcaagacatctttgagtttgatacaccttgttgtgcataccagtagttcatgccttttattgcagagtagttatttcatagtttggatgcacaaaaacttcattgtccatttatccacaaaaatatatttgtgtaattttcaggttttctcaaatatgactagagctgctgtaaacattcatgtagtaatgtcttttaaaatttttttttgttattttcaaatatatgttactgtagctcatt

SEQ ID NO: 479766 - DNA, 1791 bp, Homo sapiens
taggttcagaaatgccatacaaaagtcaagtgctggaattggggaccccaaaagcctgtttggtgctctaccctcctgttggcatcctggtacctgaaaccaggaagtctcaagaggctcatccaaagcccttaatgtacctgggtgttgtggctgtttattcaggtcccaccacccagagaatctctctgcaccacgtattccagctggaggtggcgtcagcaattctggactgctttttctatcttttcagtgcctcattcagtgatgtcaagttaaaaccagaaacgatgggtgttcaccagatttttggttcttatgaagggacatggatggagctggaaacacttatgctcagcaaactaatgcaggaacagaaaaccaagaaccacatattctcacttataagtgggagctaaacaatgagaaaacatggacacatgtgggggaacaaaacataccggggcctgttgcagaagcaggcagggtgagggagagcatcgggaagaacagctaatggatgctgggcttaatacctaggtgatgggttgatctgtgcagcacatcaccgtggcacatgtttacctatgtcacaaacctgcacatcctgcacctgtacccctgaacttaaaagttgaagaagaaaaaataaatttgcatatagtaatttttaggatacactgttagggtcaatacatttcatacggttttaacgtatggctcatcttaccctacaaggaatattggaaaattgtctgggggcaaaagagcctgacctttgtgctgtcatgttgacaagtcttgtgaggaaagcggccctggaaaggcacgtgcctctgtgcaaattactttccagcagaggtaattcccatagaggctaatagttaaaggctttgtgccaagcctcactccacacagctagaggaaagaagtgcctcatttatttaggaaaatctgggtgaatcatcaaggcattcaccacagttttcacatttgcttatggttgttttgccctcagtgttttcatgttcatgtattggcctcaggattcctgcaccagatgaatgatataaaattgaatccatatgcccatttggtgcataccttgaacattgctttaacttttacacagaatatgtttttgtttgtttgcttgtttctagaagttccaggaaaagaaacaaatttcatgtagcttctttacaccaaggagaaaaatctttcccatttttttcaattgaagggtcagcttgttcagggtcccagatttgtgctatttcaaagataaatccctgatttaccttgatgaaagccagatatcttatctccacataggtattagcccctatcacctaagtctataccatattcagtagaatttcccttgatcgcttagagatttttttttctgtcatctgaggatttgcctttctttccagcagatatatttttaagcattttgatcacatagaagaaacatttgtaaatattttagcatgcagtgttgtccacattgactctgtccacagttttttgaaacaaaattctccaaaatgtttccaattctctatagcatggtaaaatgttacattaacttttcttccttctttttgtcaataaagccatgctgacaatttaactatgtgcctggagctagaatataaaatttataacatcaggtctttatcttaggtttttaatcaattttggatccttttgtagagaagctcgatattctcaactaaatatcgtaatagtatatttgaatctaatcgtgtaaactattgtggt

SEQ ID NO: 479767 - DNA, 1348 bp, Homo sapiens
ctggagactatttttctaagtgaagtaacccagaaaaggaaaaccaaacatcgcggagatggcactcaaattacaagaagcaatccttctcattcttctgtccactttccaaaagcaggggagccttaccccatggctctcaccaccacaggccaatggagagtacttccagactaccactgatgttctcttaaagcccaagggctcttcaagccccagagcacttaagtccacggtggtgaggcatgcaggaactcaagttctgaccactgggatctgcagttcccctctggctagagctggtttaaatgctccctccatgggtgcgtgtcagctgagtttggtctggttttctttcctgcttcaacgggacagcagtgagttaagtgcctcacaactcctatactctccttccccaccccagccccctgcccccagcacggagaactgttctctgcgccatgcctccaatgctggtggatcagggagtggtagtattggcaattcaagactgtttttctacgtcttcagtgcctctttcagtgatatgaagttaaaaccaggagcttgcctttccttggcgccggctgtgaccaattattattttagagagacagtttaacaactgcctgaccattatctaatggttgactgacattcctggggggccctcttctgtcttgcttatgtgtatctaactacctactttaatactgtcgtaacattttaaaacagataaagatgttacacatatatattttttaacttaataaagtgatggaacataagagctatttgatcattctttcctcaagaagttaactattaataatattgcagcttattacatcttgattatgatttgtaggttgagctttaggggtcctgcataaatatcaaaatatattgcacaataaagaaaatgtgcatttctctgtttcatcaatttggcatatctcctttcatttataaaatgaggcattactattgaagccatgaggggatttttctacaattatatgatcatgacattttatttcagatcagtaactatttatttagtaacccaaacattgctaggtgctgtgatacaaaattctggggagtacaaagatagtcttataaatgctgtgttgtttcataattcgttttgaacccagtggaaaataataataatgcaaataatgtattcattttgattatagtattaaatagctatatgaccacaggaaaaaaaggacaataaatctacagatgtttccagtgttaagattacaataatatagagttgttaacacgaatggatgttaaattttattgaaagccttttctgcatccattgagcacc

SEQ ID NO: 479768 - DNA, 501 bp, Homo sapiens
agcttgtttctttcattactacagctgtaaaattcatccgtggtccgtatgctttgttcaaggaaacacaagcatagcattactgccatattcaatttgataaatggtgatgtctacaaagtaacaaacagcttaaaccgtagatataccagaaaaagggatgattcaggtcccagatgggatagattacttcctaaatacaatgggggtacaggctttggtgaaattcacctgtttcaaatgagaaaaattggcccaaacaaaggagctacaggccccatgcaagtccaaaatcgctgtcaaattttaaagttccaaaatgatctgctttcactccatgtctcacatctggttcatgctgatgcaagagatgggttccatgatcttaggcagctctgcccctgtggctttgcagggtacagcttccctccaagctgctttcaagggctggtgttgactgtctgcagcttttccaggtgcatggtgtaagctgtctatgga

SEQ ID NO: 479769 - DNA, 770 bp, Homo sapiens
tttctaagtcatttgcttataaaagtcatgagatcatttatgctccagccatggctaaatggggccaaggtacagcttaggctgtggcttcagagggtgaaagacccacacctgggcagcttcaacatggtgttgagcctgcaggtgcacagaagtcaattaattgaggtttgggaacctccacctagatttcagaggatgtatggaaaggcctggatatccaggcagaaatttgctgcaaaggtggaaccctcatggagaacctctgctaggacagttcagaaggaaaatgtgggtttggagcccccaaacagagtccccactggggcactgcctagtggagctgtgaaaagaggcccaccatcctccagaccccagaatggtagatcctcggtcagcttgcaccatgtgcctggaaaagccatagacactcagtgccggcctgtgaaagcagccagaaggggggatgtatcgtgcaaagccacagaggcagaactgcccaaggccatggcctcttgcatcagtgtgatctggttcatctgtgccacaatgcagaggtcacaatttataccgtcgtaaaaatacaagattttcaagcagccgtttatgtttcaatattaatgtatatttagaaacagcttttatgatttaataaaatgttaaaatttattttatagcactgttacctagttgtgcatacttcgacattgcttttctattttggaaatggtagcacctagatttaggtgaaactggttagcatcattgct

SEQ ID NO: 479770 - DNA, 2784 bp, Homo sapiens
aggcattcaggcatttccatacatcttctgaaatctagccatggctggagtggctggaactcagtgcctaggctgcacagagcatgggaatgctggaccaggtccacaaaatcactttttcctcctaggccgccaggcctgtgatgggaggggcagtgcggaagggaaatgtggttttgcagcctctacacatagtccctactgggcactgcctagtggagctgtgagaagagagccaccatcctccagaccccagaatggtagatccactgacagcttgcaccatgcacctggaaaagctgcagacactaaatgccagcgcatgcaagcagccaggagggaggctataccctgcaaagctacagtggcagagctgccaaagaccacaggaacccacttcttgcatcagtgtaatttggatgtgagacttggagtcaaaagagatcattttggagctttaaaatttgactaccccactggattttggacttgcatgggccctatgtagtcctttcagccactagaaaaaatattttgggttaactgatgacatcttataaactcatataattttatgttataggaaattagattgagaaattactgatggttgtacattataaatttaactctcaaaaataaaaaaattaagcattgcaattatatagtgaaaaataaccatggaatacaaagcagttattaaactcaggttttcaagatgaaaaagttctaggaatctattacacaacaatgtgaatatactgagacctacttaactgtacatgtaaaaataattaagatagtaaatttgatgctgtattttttaccataattgtgtatattatattattttaatatattattaagactagattatatttcatgtattatgtaatatatattaaatctgttaaagatattggaaaactaaaaacacaagaaaaactattttgactgaacacagcttggagtaaactcaggtaagctctttcccatttgagtcaaaaatttcaaaacaagtcatgtagaataaattataaaagacattaaattttaataataataaattaacctttttaaggcattttcattcttctgcacttaagaatgcatgtttccaaggtctgagtttatactactatgactagtaaatataaacatccacatgtatttatagcataatgatctttcttaagccaagaaaatacatattaaaaccataaactttatgtaggttgccaaaattctttaaattatataattatttttaatgtattttagttttgcttaaaagagggagtgatttatatttttgatgtttttaactaagtaatggcaatatggaacttttccacagaaactccataaatatcatagtaatttgttggtaatactatttgtttccataaaattgaaaatgtactacagacatgggtgagtgctgttttccaaaacatatgtaaataattttttagataaactttcacactgttagcagtggaaggatgagttattttctttgaatgtatgccctgtagtaggatggctgtgtcaaaccatagttctattttaagttctttgagaaatcaccaaactgctttccacagtggttgaactactttgcattcccatcagcagtgtataagcattcccttttctctgtagcctcatcagtatcatgtttgatgcttttttgaaaggagttttaaattatggtttctaattgtttattaatatttaaatgtggagttgatttttatattggccttttagaataccaacttgttaaatcaatgtattggttctagtagatatctgtgaattcccatacaatcaaattttttcaaataatggaagtgtttctacctcccaatccaatcagggcattctttatttctttctcttgcactggttaggatatccagtacaatgttaaaggtattcagagaggatatccttgatattttattgaacttaggtagaaaatattgacactttaatcactgagtatcatgctacttgtagatttttcatacaaatacttaatcaatttgggaaagtccccatctatttgtagttggctgagaaatttttatcataaaaaagagatgaattttgtcaaatactttttgtgcatcttctgaaatggtaatacgatattttccttaattctatcaatgtgatgtatctccttgagtgtttttcaaatgtgaaaccaaccttacattctcaagataaatcccacatgaccgtgatgtagtgctatttttaaaattattactggatttgatttgatactatttaattttttgtatccatgttcacaagggatattggtctgtagttttcttatgatgttttcaactggttttagaaacaaggtaatgctgccttcataaaatgaggtgagaaatgtttcttgattttctatgttctgaaagggtttaactatgatcgatattatgtcttccttaaatatttgataaacttcaccagtgaaaccatcagaacacaaatttatattgaaaatatttttaataaaatttgattttattaattgatgtaaggcttaaaagtggaggcagacttgataatttgtgtctctcaattatttcttccatttaatgtaggttgtcaaaattatctgcataaacttattcataataagtccttttcaatgtctgaaagtctgtagtgatatgccacccttcatttcttatattggttgattaaattttcattctgcttttcctgaagttactaacaagtattttgaacactttt

SEQ ID NO: 479771 - DNA, 546 bp, Homo sapiens
tctgtaaaatatttgaagagatttattctgagtcaaatatgagtggccatggcccatgacacagccctcaatattcagatacgtccagagtttcttccttctggtgggttcgtggtctcgctggcctcaggagtgaagctgcagaccttcacgatgagtgttacagctattaaggcagtgcatctggagttgtccattcctcctggtgggttcatggtcttgttgtcctcaggagtgaagctgccctcaggagtgaagctgcagacctttgtgtccccacctgattcaggagcccagctggcttcacctaatggatcccacacaggggccgtgggcagagctgccggccagtcccgcaccgtgcgcctgcactcctcagcccttgggaggttgatgggactgggcaccatggagcagggggcagcacctgtgggggaggcttgggccgtgcgggaacccaccgcaggggggctcgggcatggctggctgccaggtcccaagccctgccctgcaggaaggtggcagaggccccacgagcattagagc

SEQ ID NO: 479772 - DNA, 533 bp, Homo sapiens
actaaatgcaatgctcaatcctgaattgattcatgaattaaaaaaatcatattttaaagatattattgggaaaatcagtgaaatttttataaactttggtcttcaatctcagatattctttcttccacttgatcgatttggctatcgatactttgtagccagcaggcagggacgtttaagtctgctgaagctgcgcccacagccgccccttaccccaggtgctctgtcccagggagatgggagttttatctataagccactgactggggctgctgcctttctttcagagatgccctgtccagagaggaggaatctagagagacagtctggctacagcagctttgctgagctgtggttgcctcctctcagttcaaacttccaggcagctttgattacactggttacatttaatcagaactatggtccgtcataaaagagcctgtatttaccaaattaatgcataatattcacaagaaaccaccaataataaacaaattaaaaaatactgttgagggatggctggcaggatggcc

SEQ ID NO: 479773 - DNA, 489 bp, Homo sapiens
cagcaattagttagtgagaaagatgacagtggtagccacaggggattggttacacagaggaggagtaactagcttggaagcagcagggaaagggagcttagcagcagttgtggtcaatgctactccacttgttctggggctccaaccaagagagatgtcagatgggacagatccactgctgtggcagtggcagaggggctgtcagttggctctgggagctcctacccacagcaactcagagccactaccagtgggtatgctcagcaatggttggggtggctgttctgcattcctgagccaggggacctacctggtgaagagggggcatgggggctcccagggaagagagactggactcctctatgtatgctggctgcactgtactggaggtgccagtgtaatgactattgtctttgttcttttcccagcttgaaggcaattaaggcagtactactgcagctgcaatggtggaggggctgtggattgaat

SEQ ID NO: 479774 - DNA, 613 bp, Homo sapiens
aaaaccacacaagaaaccactggaatggatttaagtgtattacatacagtgttctttgacatgtatatatctatttctataaatagtgttttactaaacattggacttcacaacctgctaaaaatcccagaatggttgatatgctggcagcttgcactgtgcttctggaaaagctgcagagcctataagaagcagctgtgggggctgaacctggaaattcacaagtgtggggctgtccaaggccttgggagcacaccctttgcaccagtatgccctgtattctctcgttccaccttacgagaaacacccacaggtgtggaggggcaaaccacccctacaggtgggtcacttccaaaatggccacgggccacttccaagatggtagcaagcctcgtgttctctgacatggggttcttggcctcacggattccaacgaaagaaatcttgggccatgcaaatgaacccgggcacttagcagtgcaggaacaatggcgagcctttagcccaatcggaagcagcaatgggcgcctcactggatcaggagcacagtgaacaccctgcctgatctgtacggatggaagtcggtggtggctgggctcaaggtttagcttat

SEQ ID NO: 479775 - DNA, 609 bp, Homo sapiens
ttaccatttccccatggtggggaagtgtctcctggttccatgtcatttccggaaaaatgtcagggaagacaaatatacttcatctattgataaaccatctattattttagagaagtgcatttgtgaaaataaggacatgtctgagctagacaatcattttgaagaaattggggataacatcagaagaagcaatgccaaaagtaccatatactccttcactgttctcaactatatttttatcagtatcgtgtatcccgcagatatgctcaaggccctaattagccagtatctagttaataatggtcatttcatcaaaggattatgctgctttttatatctaggaaaaatagggagaaacacaatctattcagtcaaaattttaaggacaattttcacagaaaatagtgtgattatcactgagaacctacgcgctcctgagagagcacaaactaatatacaacaacatctggcaagttttacatctcacttggctttaatttaatactgtctaacaacaagaaaaatggaaggaaggctttctaggtatttgaagaaacttgggccccaaactcaataatgctgtggttcttgcacattcacagtgatacc

SEQ ID NO: 479776 - DNA, 632 bp, Homo sapiens
ctctaccagaaaatgaaaggaattgaaattaagagaagggagagattgaagtgtagcaccaagattgaaaggagaaagaggttgagggatagggaaaaattgagagctgatgggattgctggaaaagactccttcatgactaacaagcagccatctgaacttttgattcagagaaatcttgatcactttttgcttccacaagatttcacactggcccattacattgatgacattatgctgattggatccagtgagcaagaagtagcaaacacactggacttattggtgaggcagacagtgcccaacgaagctaagggagcagggacattccatgccatagggatagtgccatccagtagagcctgtggaggcaatttctgcatggcagagtgtcagcataggcagagccctggcagaaagccccatcatggccataggtcaggcactgcaaacagccatgacataggcattgccccgctgagccttcctgatgtagtctgcatgctcatcacctctgaatcccatgttgaaatgtgatccctaatgtaggagatagggcatagtggggaaggtttgggtcatggagatcagtgattttcaatcttagctacacgttagaaatacttatatag

SEQ ID NO: 479777 - DNA, 1710 bp, Homo sapiens
gcgtagcctagggacatgatgctgtgcatcccagatgcttcagctccagccatggctaaagggggccaaggtatagctcgggccattgcttcagccccaagccttggcagcttccacgtggtgttgatcctgcaggtgtgcagaagacaagaattgaggacagtgaggaagaaaaatgtagggttggagcccccacacagagtccccactggggcactgcctagtggagctgtgagaaggggtccaccatcctccagaccccagaatggtagacccactgacagcttgcactgtgcacctgaaaaagctgcagacactcaacaccagaccatgaaagcagctaggaagggggctgtggaagggacttgccttgtctcagatgaaactctggacttggacgtttgggttaatgctggaatgagttaagactttggaggactgttggaaaagcatgtttgtgttttaaattgcaagaacacgagattgggaggggccagggatgaaataatatagtttgtctgcgtctccacccaaatatcatcttgaattgtagtttccataatccccacgtgttatgggagaaacttggtgagagataattttagagttgtatctttggacagaatttagcctgcagcctttctctgtactgtgttagagaaattagacttttcaacatgggaattcaagttagcaaaatttaaaaaagaaataaatagaaagagagagagggaaatataaagaaataaagaacagtatactgatctccatacatttggagattataactctatttcaagcaattatgataatttttagcatttacatgactgcctttgtattatagaaactgttagattatgatgattgtataggccagatttatatttgcagcaaaagcaaaacaaggatactacaaaaatgatcacaacttgaaataatttgttaatttgttacttgttagtcatgctgtggtaaggcttttctttaacattggtgtactttatttgtgaatttcatttataggatcagtaagcatagcctaaggtccattgaatcttaatgaaaaatgaggcactttcagtaattaactgcaatattacatcaattccattttaaaggtttcagggaaaggtacgttttataatttcccaataaaaatataaatatttagcagttctgattatcagaaaatgtatacttaaatccagcttaattctttccacaataattggtattttcttgttcatctgtgtttggtaaaaagtagtggttgtgtaagtgtagttatatttaaatatctgttatttttaaattgtgaagcattcagaagagtaatacaaaattatctacaactctgtaatgtaaacatagtactttacctctgatttgaaaatatggacaatttagagaaagagaatcatttaacaaaatacaggcaagtttaaaatagcattattctggacacatgaatatgtttgaaattcaaagataaaggagatatttgcagctagggttaatggagcaaaatgtttagctttagaggatcagactttaatgtttattttagcctaatttgattcttgatgcttgtaggggtgatgactctctaagagatccttagttatgagagtctttgcgttctggttttccctaatgctgattgtagtagttatattcttggtgtgtgggtaagtttactatctccta

SEQ ID NO: 479778 - DNA, 561 bp, Homo sapiens
ttttatcatgagactgcactatgaaagtcctagatgtcatcatcttccagcagaaggctgtttttgtctacaatgaaaatctgttgtttaaagaaacagcttccccatccccagtagtggcaagatcccctccaagacccatgctgccatcagcctttccacctttgtctgaggagataaaccctgcactaactgaggcaacagtgatggcctctcctgaggcagctgtgaggcaagataatgttgattctcctcaatacccaccccgaacacccttgtgtgcttctagacctataactagattgaagtcccagtgggcccatagagaggaagggatcaaaaggcttgtagaaattgggatggaggagtggattagtcactttagacctactcatcccagctgggagggtccagaagatatatccttgaacaatgctttgtgaaatggatttgtgaaggcagcacctgcatctttgaagagctctgtatgaattgctcttctctgtatgacagatctaacagtgggaaccacagtcacttaactacaaaatttaaatgcaa

SEQ ID NO: 479779 - DNA, 891 bp, Homo sapiens
ggtgtaggtaaagtttgtttatgctttccacgacctccccctgtgctgtaggaatggtttgtaattggggtttgcttatcgcagcaaggtaatgagcagaggttgtgagagctgggagagctcagaagaagataggaggatgagagaaaatttaaaactccctagagactggttaagtggttgcaaccaaaatgctgataaagatatggacaataaagtccaaggtgatgaagtctcagatggagatgaagaagatattgggaataaaaacaaagccactgtgctgcactgtggggaattcctcctggatccaaatcatccagtctccctgttaccagcaggggaaaaagtggcagactggcactgtggtgatggctgccgcccctcctgcaaggagctcagtcgtcttaggcagcaggcagctgcagtgttgacagccaactctttcccccagggacttggtagtcttaggcagtctccagccaaaaagtttaactggcaagaatttcggtattgattggaaaatacctttcgtaaattttataaatacatgttcttttttcactctaggactttttgggctagaattctaaaggtagtaaataacttacagaagaccagtatttctaataaaatgttattttttacctgctttatatgataaatagatacctagattcccttgagctatgtgcattttatactcagtctagaccttattaaatgatataaaaatgataatttaaataatttatttctagttatctcagttacataataaatatattaaaagtatgaaactgctcatttataatataatcatgctggtcttttgtgagaatattttatataaactcatataattttatatagtgatacaacatcagtatc

SEQ ID NO: 479780 - DNA, 477 bp, Homo sapiens
tgtgtccccagaatttagcctctaaataagggcgactatgttgtccagagaccacatgttgaaactcctggtggcagtactttttcttcatcttcagtatccaaatggcagaaattttggagttcatgccatagttagctctaagaattatcctgagcaagccaaaagccatcgcaagctccaaactgactgctctaggctccttctgggaagagcaataaaaactgccaaatgctgtagcgtggtagctaaggctttgtcttttcccaatggtgacatgagttcaggaccctggctggataccacattcaaacacccatggagccaccttcctgccctgacagctagcaacaggccaagacccacagagcgatccactgcctctttgtcagcagtgaagagttacagaagactgacctttgtccattttctccaaataattggggtcttaggatcatgagtgggaaaatgctacaa

SEQ ID NO: 479781 - DNA, 1093 bp, Homo sapiens
ttatgaaattaatgtgtctggagttggttcctgctggtgggtttgtggtctccctgacttcaagaatgaagccgcagaccttcgcgtgtgtaaggggacccgagtgggttgccactgctggccggggtggccagtttttattcccttatttgtcccctcccatgatcctgctgattggtgcattttacagagcactgactggtgcattttacagagcactgattggtgtattttacaatcctgttgctagctacagagtgctgattgcttgtcaattctactgctttccccagcgtctgcataataaggcagacaactcaacacaggagttgatctgtgatcaacacattcaagtgatcacgtctccttccttggcagaatactccttgattctttccctggggaaaagtcagattcctgttgattgtcctcagctcaaggagaagggtttcatctttatttatagcacttgtgaagtgcccacaggacacagcaaggtcagagtcctagctaagacctaagacctatccatagtatatagaaataaggcaacctttgcatcctcgagaaacttatattctaaagtatggattgagtcaatggcctttgaaatggagattgtctttgcgggggggggggggggggtcctcaaatatgtgagcaaaccaatcccagaatctcattttgagaatctgttttatgggaccacttttggggtaaattactgtatcggtaaggatctcagaaatctgacattacacttaaactagtttctcagaaatttaatattaaaactaatttcaaaaatatgaatacagtttggagaaaccaagagggaagtgattaccaccattaagaatgaaaagaataagagtggttttcataccatatttacaatgttagaatattctgtgtttttttcatgtacttaatattacctgtgatttttgtaccttcaggtgattatgttttgctcattaacattcttttctttctgattaatgtactgccattagcatttcttgtaggacaggtctggtgataatgaaatacctcagctttgatttttctgggaaagtcttcatttctcctt

SEQ ID NO: 479782 - DNA, 2792 bp, Homo sapiens
caacgagctgccttgctcaagctgctgcggtatgcttggggtcccagtttttccagtacctggagttcgttataacaatgtgaaaaagaactactacagaaaattggtatcatcagagaagtggggctttgctctaaagatacctgaaaatgtggaaatgaccattaaactgggtaatgggcagagaatggtacatccaccaacagcttgcaccatgcacctggaaaagctgcaggcactcaatgcagtctgtgaaatcagccctggggactgtaccctgcagagcaacaggggtggagctacccaaggccagggggcccaacccttgcatcagtgtggccttgatgtgagacatggagtaaaagaaaattattttgaagctttaagatttaatgactttaatctttatattacacactacctaccatatacgggaaattatagttatccaatgttgagcaacaacaggtccaatctcaggtcacatggggctttggatgaagattgaagataacataaaatgaggctgaaatgacaaacagggttaaaatcatacaagaatttaaaggccaagttaaatatatctgtctttatttcaatagcagcaggaaagtcttgaataagtttagcaagggaatacatcatgcacatgggaaagagaagacaaaatgaaattggtgtttgttgttaaaacatttttttctgaggaagatcatatgtcatatatctcagacattttcttcacggtaaataaattgcactagaaatataactagcattcttaaaatgcatttttagcaatttgttaaagtatagcatacacatagaaaaattcataaaaatatcacatcaatgaattatcacagtaaagcacatctatgtaataaacataaaaaaaataggttgctaccaacatccaaaatagcccttcagctttcttcagaaccaaaatatcttccctcttctacaaaggtagctagtatactggcttctaaaattatagcatagttttgtcttttttaaaagcttttgagctttatatcaatggaaatataagtatgtattatttgtgtctagcttcttttgatcattgtgatcaaaagaattgatcacaattcttttcattcatttatgtccttttcattcatttatattgttacatgtaattatttattatactttctgtatatttttccatgaaataaatataccaaaatttatgtataaattttactgttggacgtttggaatgtttatagtttgagctgcatagttttgcaatgaatgttctttaacatatatattagtttgtataatcataaatctttttggggtatatacctaaaaataagatagaatggtcattggctatgcatgcattttaatttggtagataatgatgaacagttttccaaagtggttatgtaaatgcatacatccactgttcatacattagagtttcagttgctttacatctttgcttatattgctattattttttaatttgccattcaatcaagagggtcaatccactggaaaaaatgtaacagttttaacatgtatcccccaaataacagagtttccaaatatacagccatattttatagaataaaaatgaaagtagataaatccatcatcacggtgggaaattttaaaacatcacactcagtaactgatagaacaagaaaataataaaaacatttcatctccagatgattcaattaacagaatttacaaaagtgacccaatttgcaaattgaaatagttgtaaataactgtttaataacagatgttttcaaatgtacgttatacttctacccaaactgaccacatgtaaggctattaaaaatatctaaagaaattttaaagtattgaaatcattcaaggtatattttatggctacagtggaattaagcctaaaaatcaataatgcaataaaaaagttcaactatttagaaatttagcaaaatacatcaaagaaatttatcaaattagaaatcataatgaaaagtaaaacattttgatttgtaaactaatgatcatacagcatatcaaaacttgtggaatgcagcaagtctgtgcagagaagaaaatatatattcaaaaatttataaataagaaaagatggtaagtcaaaaatcaataaccaaatatttatatcaagaagtgagtaaaaggacatcttattgtataccaaaaatgtagaagttagaaaataaaaagagtatttattaaatacaaaataaacaatagaagttagtttattaacaaagccaaaagtggattttttgaaagattaacatttgatagacatttaaccaaattgagcaaaatgaaaatacataaataattaaagacacaaatttgaaataccagggataaaaaggtgctatcacaagatattttacaaattttataaagatttttaaatagcataatgaaaaattttaaagtacaaataaaattttgcataaaattgaataattcctagaaaaacacaaattatcagaattgacacaagataaaataaaaatatataaatagcactgtatctattaaagtcagtaaactggcaaataaatgtttccccacaaaatatctttggtgccagatgtattcacttctgaatttttccaaacttttaataaaatgtgacactaattgtacacaactttcttggagaaacaaaaaaggggagaaggaaagagagagaggttggatatagagagtaatggggtcagtgtaattttgtgaataacaaataacaggaagggaaacttaggggtaatcac

SEQ ID NO: 479783 - DNA, 692 bp, Homo sapiens
gcctctcttaaggatctttgacaaaagcctagtttggctagtatggtattcaaagcctgcaaatcctgtgatccccagaaaggcacaaagttgctttcaggtgattgggataggtattctaaggatgacctgtatttattctgggagagcttacatactttgggggtcaagattatccccaggttttggacatcttgtcttagaagctgtgccttggccttggacaccttgtaccctctgtctgtgaggaaatttagtgtctggactagatgttggattcccaactctcttgtgggggagcagattaacaggtcttctacatactgtaggagatgccctccccactcaagcattagatcctgcaaagctctagtcaaggcttgcccaaacaaatgggaactatctctaaaaccttgtgaaagcactgtccaggtgagctattgactccttccttttttatttgtccactaaaatgcaaatagagtttggaagaatgagtctaggggatacaaaagaaagtgtctttgaggtctaagactgaaaaccactaagcatctggaggtacttctacaattacttaagggttggggaccactgggtttgttgagactactgcttcatttataatttgcagatcctggactagcttgttttctctcttgctcattttaacagatgatttgtttccccag

SEQ ID NO: 479784 - DNA, 862 bp, Homo sapiens
aaccatcacctgaatagtgtacatcgtagccattgattttctcacaaacgtatgtaggcttaaataatgaagtatttagaaaaatacaggcagatgtgggaaggtttgaaacttcctagagacttgttgaatggctttgaccaaaatgctgataatgatatggacaatgaagtccaggatgaggtggtctcagatggaggtgaagaagttgttggggactgtaaaatacacaaaaatgtggaagcaactttggaactgggtaacagacagagaatggaacagcttggagggcttagaaaaagacaggaagatgtggaaggtttggaacttcctagagtcttgttgaatggttttgaccaaaatgctgatagtgatatgagtaatgaagtccagactgaggtggttttgggtgaagaagagggcaatctgcagccactgtgggagttgagggacagttacctcaccactgatgtaatgtaccagagtggagaaaagctgcctctactgcacagaatagtttgtgcaagaagtggggcacagcagacatcagtaagccccacccagatcccatgcacttggcaagttaatactgatagactcgccccagtatccaaaaagaaggaaataatcttaccagataccatcccagttaccctgggttccgtggactcactggatgtgggggtgaaggatcccgggcaccctcagtcttccattgtcagtgccagcagtgaagagatttcctcctgtaatggtgagggggcctcattatgagcctcacccaaacaggagggtgtcctctctggttggggggaggttatcttagggttggaatgtttctggttggagatgtaatttgtgg

SEQ ID NO: 479785 - DNA, 674 bp, Homo sapiens
ggtgggcactgtcattaggctggtcccccacttctgacatggaatgcaacaatatggaaatctgagtgatgccaaaccaagctactgtcagctggtgagtgaaagaagcgtaaaggattcattccacattcatgctcagatgacagagaatgaagaatatagcagtagtggtggagatggaggcagtgaagaggacttttctacaaacaccaaagctgtgagcagaaagactatctgcacagttgaccaaaagggaaggaaaattgaatcaaatgaagattattgtccaatcacaatgtcagatgcctggcaagccctcaagggtccaagcactggggaaagcagcaatgaaggcctgactagtgtattcagcaccagtggaagccctacagatggaccctggattagtcatgtcccttacagtaaatcagctcatattcttatgtatgaggtctattttgctgcttaagctcatcagattaatataccactttcaacttctactcctaaacagaaattgcttcttaaaagtactgttctactttagtgatgtacagttatctaactaacacaagacattcaaacaaaatgtgccttaaaaaatttaataattttccattattttaaaagaaatgcaacagtgtgtccttaggctttattaacttgtgcttcac

SEQ ID NO: 479786 - DNA, 1534 bp, Homo sapiens
tttctctcttttttttttttttttttttttttttcagatggaaccatacagggtaacttcctgacattgccatggtatttgtaaactgttatggcactggtgggagtgtagcagaggacgaccagaggaccatggaacatggggaacttttgctccccaaacggggaaacatgagagccaatgggactgctgaaaatgatccctttgtgaccaacaagcagctacctgaatttttggttaagtattgctgcaatggggacacagagacacagacagcgaaagatggccatgtaaagacaaaggcagagattggagtgatgcatccactggccaataaacaccaagaaaataagcctattgattttactcaatcaacactgcagataaaggagcacccacacacagatatgagaaagaaccaatgcaagaactctaataactcaaatggccagagtgttgtatgtccttcaaatgactgcaccagttctttaacaagagttcttaaccaggctaaactggctggaatgacaaatagaattcagagtatggatagaaacaaagatcattgagatttataaggacagcaaaacttgacccaaggaaaataataatcataataaaacaatccaagtgtattttataacacattctaatgaactcttttgggttatactattttttaaaaaaaattaagagaagttttttgttgttgttctttctctttgctttactcaggctattttctgtgcttctgctcctttgtgaacatatgctgcttcattctgactgaaaagtttaaatgaagcaccttaaagaaggggcatgaagaatataaagaaaattgtgtataaagactaaatgtctttttcgggtgctttttaaaagaattttatttaaaatcattctaccaatgacatttttttcaggtatttaaaagatatagaattattttcagtattaaaggacactatctgtatttgtaactatgataaaagggtcatctcttgtggttaataacaccaattatcttttaaatacattatagaaaattaaaaatatatcatcaccaatttgcctataaatgtttttctttattcaatagtggtgtttattaattggtacaaatctttttattttcagagcaataaaagcatgaaaaactttatttttaaaagaatctttcataataaacctcagctacaccattactaacaactttgacaaatatactttattataaacctgtaaatgcctaatactgtgcaattaaaataattttgtatcattattcttgctagcaaaatagcttttcattttttgttcaacatgagaaaaataatgagggaggtgacttctcctcagtgccaggtgggtccttaggtgctgttcaggagtcagagactagagccaaaaacctgtcctgtgacttatccttcagcgtagtgggctgccatctggccccagacaactccagaaatgaagtctaagagtaaaggcctgaaatttgggaccccaggtgtctgcttggtgctat

SEQ ID NO: 479787 - DNA, 1496 bp, Homo sapiens
agtggagctgtgagaagaagaccaccgtcctgaccccacaatggtagatccactgacagcttgcattgtgagcctggaaaagccacagacactcaaccccagctcacgaaagcagccaggaggggtagaactgcacaagactgtggaaacccacctcttgcttcagcatgacctggatgtgagacagggagtcgaaggagataatttgggacctttaagatttgactgccccactggattatggacttgcatggggccttgtgcttttgtcgactttgtagatcagttggcggtagtattttggtcaaagccattcgacaagtctctaggaagttccaaactttcccacatcttcctgtcttctgagccctccaagtctctaggaaatttcaaacttttccacgtatttctgtcttcttctgagtcctccaaactattccaacctctgcttgttacccggttccaaagtcacttccacattttggggtatctttacagcagttccccactacctggtaccaatttactgtattagtctgttctcgtgtgctaataaagacatacctgagctggggtaatttataaagggtagaagtttaactgactcacagttccacatggctagagaggcctcacaatcatagtggaaagtgaatgaagaacaaaatcatatcttgcatggcagcaggcaagagggcatgtgcaggggaactcccttctataaaactgtcagatctcatgagacttattcattatcataagaaaagcatgaaaaagaccttcccccattattcaattaccccctcaccaggtccctctcatgacacatgggaattaagggagctacatttcaagataagatttgggtagggatacagccaaactatatgagtgtatatatttatggggtatatgagatgtttggatacaagcattcaatgaataatattcacatcatagaaaatggggtatccacccctcaagcatttatcccttgtgttacaaacaatccaattatactcttagttatcttaaaatgtacaattaaattattattgactatagtcaccctgttgtgctatcaaatgcttggacttgctcattcattctattatttgaacacattacccagccccaccagtacccctcctagcctctcttaacaatccttatactgtctatatccctaagtttgttttgattttttgatcctacaaataagtgagaacatgtgatgcttgtctttctgtaactggcttatgtcaggctaaaataggtgttccttattagcaaatccggacttccaggaaatacactattaaatgaggttgagatgaggttttctatgcattatggtatgaatcttgcctttgtgccagtgatttatggcataacgaatgtatgtttgttggttgaatttactagccaagcctgcatagtgtgtttgcctaatagttgccaatttccactggctcctaggctgaaagaaataataa

SEQ ID NO: 479788 - DNA, 893 bp, Homo sapiens
cagggggtgcctaggagggtggagaaaatgaaaaagcagcttaaaatacagggttggaaagatgcctgggggaaaatatatcttattcttatgcaaatgaattcctccaacagggaaagaaacttaattggtgtttcttccctggggcttggatggagctggaccccttgggcaggggaggggaagacactgtggacacatggcagggaatgctggccagcctgccaggtggggactttgagccttgtgccccagcccgagctgggaggggagggagaagggagccgtcacttgtccatccatcctgaaaaaaagaagaaaagaagaaaaaaaaaagaagaaaagctgggttggaccaaggctgacatttctaatccccatcagcgatgggtgtgggtggggggcacggtttcctctaccttcagaagaagtccaaggacaaaaaggctcaaaaagaaaaggaaaaatgattttctgttctgcattgactcacgtttcctcacatccacgtacaggccaccaaaatgatgcaggatctttgctccttacctaagctaaaacccaaattcttctcccacaaccagaaaaaaattaggcatggggacacgttgagagaatagaggctataacaagaattagttagaggggtgtccatatagtttacatataaataaacatatttattattttatttttcagctgtattgaggtatagtagacaaaaattgtgtatagtcatgatgaagaacatgatattttgatatacatatacatcgtgatgtaattaccataaccaagctaattaacatatccattacctcacagttacctattttggtgagaatacttatgatctactcttttagcaaatcaccagtatataatatattatg

SEQ ID NO: 479789 - DNA, 555 bp, Homo sapiens
ttaggaactgggccgcggcaggccagggaacattactgcctgagctgtgcctcaggtagcgcactccttatgagaatctaatgtcgatctgagatggagcagtttcatccccaagccatcacttgctacccccaggtccatggaaaaattgtcctccatgaaaccagtccctggtgccaaaaaggggaaacttggggaaccaaaggccccattcaaccagtgggagtggagcaaataaagtttcccaaaaagaaattactgccaaaatgcaaagcggagatgccctggtgccaggaggcccctgggtggaggctgccttcttctgccagaggctccacttggcaaatcgtcagtcatagagattatagctcaaaagggacgttagtgttgtgggtccctcaaaacactaacaattttgcacctatggttctccatgattggaagtccctgcccctgccccaaacaatcacaggacaagaaacagactacaatgcatcaatttataatacttattcacaagtaaaagcaacataaacagtatgctgaattgcctcc

SEQ ID NO: 479790 - DNA, 571 bp, Homo sapiens
agtgcagcccaggaggtattgtcatggaagacatccctcttaaatcatctcccagagggtggcatctgatgaggtgggacccactgagtcaggcaccagagggaatctcctggtttgctggtggcaaagtccatgggaaaagcgcagtatctgggccagagtgcactgttccttcctcccatgcagtctctcatggcttccagtggctaggaacaggaaatccccagactccttgcacttcccacagtatcaagaacttggaaaagtatgatgaaagaactctttttggtgaaggaagtcaacttaaaaaagaaatcactgttttccaaagtaaaactgtgtcagagactgttcgaataccagaaatcaatcacactaaaacaagtgtaaagattcacttttctcctgaaaatgatccttgcacctacttttgatcaggtacacctgtaaatcttaaaaagcctataaagaaatacctaactagtacgttggacccaagacacaaaaaatctcacatactacaatagtaactgaagtactaaatgtttactcaacttagaaaattgcaatc

SEQ ID NO: 479791 - DNA, 600 bp, Homo sapiens
ctgaagagagattcaacatggctgaatctcaaaatcattacgtggaggacaagaagacggacgcaagagttacgtactgcatgattccattgatgcagaattcaagaatagccaaacgcagccatgttgagggatctctattttctcaatggtcacaccccaagcaaaccgttgtcctggatcacctagcagaaggaaaagaatacctataccagataaagtcagagttcaccagtaaggacataccgttctatgaaacagtttgcaggaaagatgctgccctgacgatgcagcctgagagtggagtgtctgtgataaagatgtacttaaataaagagaatgggaagcggccaagggaaaatagcaaagctgatcaaaggtttgctttgattaagggaattttccacctacgtgtttcttgagtgaaaatgagttgcattattgacttgcatcccatttgtattttgttatattattcacgaatgtaaacaaatattaatgcattctcatcaaatgcttgctcttttatggacatgtacaatgttcatatatggttagcactgccaaacttttagcaaataaaaatacaggatgcctatc

SEQ ID NO: 479792 - DNA, 798 bp, Homo sapiens
cattggtggaatgttacctttgctgtagctttctggctttgtcaaaatagtagaggggcagacaatgactcccccagagcaaaccaggggagagaaaaagcagaaagtacaggagaagttggagaaatcacttaagcatgaatccacagaagacaaggaagaggaaatgaagtccagtgcgtcgaggtcagggcctttgacaaacaccagcccttccacttacccctggtatcagagccattggccaatttacacagaaattattaatagccccaaatatcagaaagatcctgtttgccagatcctgcagcggaggctgcagaacagcaaagattgctgcctgttccttcctctgcaaacttcatcccagaggggcacctgccagatgccagctggagctctcctgtatgaggtgtcttttgacacctgctgggaggtgtctccccatcaggaggcatggggagctggcaggcaggaacgtttcagtctgctgaagctgcgtccactgccaccccttctaccaggtgctctgtcccagggagatgggagttttatctataagccccggaaaggggctgctgcctttctttcagagatgccctgcccagagaggaggactctagagaggcagtctggctacagcagctttgccaagctgtggtgggctccgtccagtttgaacttcccagtggctttgtttacactgtgaggggaaaaccacctactcaagcctcagtaatgacagatgcccctcctcccaccaagctggagcatcccaggtctacttcagactgctat

SEQ ID NO: 479793 - DNA, 1437 bp, Homo sapiens
caccaccacaacaaatacgtacatgcacaagcccacaggtggtgtctcctgtttacaggaagcagcagtactgccacatcagagaacagtgactatgaaagctaagaagaaggcttcatccagtgacagtagtgaggacagcagcaaggaggaggaagaagctcaagggcctccagagagcagcagcagtgaagcatccagtgatgatgaggaggacgacaaaaagaaaaagtctgtccagaagggagttaagccccaagccaagacagccaaagctcctcttaagaaggctaagagctctgattctgattctgattctgactcaagctctgaggatgaggcaccaaagaaacagaaaccaaagacatctgtagcagctaaagctcgggctaaagtcccagccacaccaggtactccagctcaagcagcacctaaagtagccaatggcaaagcagctagctgcaacagtagcagcagcagcagcagcagcagcagtgctgactcaaaggaagagatggcagcagccatccccaagaagactatccctaaagttcagtgcccccgtcctgctcccccatcaaagaagtccttgggaacccagtctcccaagaaagctgtggagaagaaacagccttccgaaagcagtgaagacagcagcgacgagtctgattcaacaaagaaagcagcagagagctcttcagacagctcatattccaacagttctgaggatgatgaagctctttccaagctagccagtaccagcaagaattcctcagataagccagctgccactaccaagtcacctgcagcggagccagctgcaactctcaagcaacctgcaagcagtggccaggagcctctaatgagaaaggctgacagcaactccagtgagaaagagagcagttccagtgaggaggagaagacaaagatgactgtggccccccctaagcccaaggtaactgacaaagcagctccatatctgcctgccaagcaggctcctgagaggggtaaggacagcagctctcattcagacagctccaacagtgaggaggaggaggaggaagagaagacatctaaatccctagttaagaagaagttgcagaaggcagcaggagggacagccccttccaagccagcctccacaaagaaaggaaaggtcaagagcagcagcaattcttcctctgatgactccagtgaggaagaggaagcgaagcccaagggcaaggactctccaagaccacaagtccccaaggccagtggcacctctgcactgactgcccagaatggaaaagcagctaagaacagcaaggaggaggaagaggaggaagacaaaaagaaaaaggcagcagtggtagttcccaagctgggttcaggaaagaagtggaagcagctgagactgccaaagaggcagagactcctccagccaagaaaataaag

SEQ ID NO: 479794 - DNA, 612 bp, Homo sapiens
gccaccggcggcttcgaaagcttcgcagccggaagccgccgattacttcattggagggaaaatgaatcgttcctcaaatgtaccacgtaaaggtattctgaaatcaggtacaagatccttacaaaaagtttgcagagtacatttcgcaaatgcacgaaatgcaagatcattactatccaaccagtaccctgatcagtcagcagtcatccacatcaagtatcgcagttttttcgatgaggcccctgcattttctggcggcagaaataacagctggcgcaaattaaatcttgaaaatattcccaggacaatgctaatgtatgacatagttcattattcagagtctggagtgatctcaaaccgtctacgaaatgaaatgaagtttctgttacagagaccagtaacgcaagagatccataagcaccagctacggattgtttctgaaattaggaatgactcattaaaacctggggctagaaccataggaatcagcagatagctcccgagtaaatatggtctgcatctctcatggatttgtgctttcctatcatttctggcctcccaggaatgtccatagtttcttgccactaccctacacattaaaatattaaaact

SEQ ID NO: 479795 - DNA, 525 bp, Homo sapiens
gaaagaactgtcatatctcataagacttatttactaccaggagaacagtatgaaggaaaccaccctcatgattcagttatctcccacctggtccttcccacaacacgtgggaattatgggagctacaattcaagatgagatttggatggggagacagctaaaccatgactttttcgacctcctcactcttgtacacctcacaagcattggaggcctaatgcaccttgtattagtccgttttcacactgctgatgaagacctacctgagactgggcaatttacaaaagaaagaggtttaattggacttacagttccacgtggctggggaagcctcacaatcgtggcagaaggcaaggaagaccaagtcacgtcttacatggatggcagcaggcagagagagagagagagcttgtgcagaaaaactcccccttataataaccatcagatctcgtgagacttactatcacaagaacagcatgggaaagatatttcccatgggaaacacctgtccccatgattcaatta

SEQ ID NO: 479796 - DNA, 1270 bp, Homo sapiens
ttcagtcacagctttatgatgttacttgtggttaagaaaactgtggatatggttaagacatcagaattttatagatactcccgacagctccgttacgaagttgaccaagcattgaattactttcagaatgttcaccagcagcctttgttggatatgaagtcaagccgcatccgttctgcaaaaccgcaaactacagtatttcgaggaatgattggacatagcatggttaacagtaaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaatgagaatcggagtggtatatgacaagttctggccctgcagcatgcaagcacttttaaagagcatttaggtaataccagactcctaaatcaaggccccttaaaagggaaattgcatgggtaaatgcagagtggaaaagcatatggaatgctttgggaatgatgaattcctcactgacagagctatgagagcagatgtcaagcaaaaacaaaatcatattcatgaatattctgtggatctgcagattactttgttaaaagaggataagaaaaaataggattttacagccccccattgaaatgcctcacaacttttcactaaaatatccc

SEQ ID NO: 479797 - DNA, 1159 bp, Homo sapiens
tgtaggctggaagattggtaaagatggacttaaaactaaaagactgtgaattttggtatagtctccatggccaggtcccagggctgctggactgggacatgaggaatgagttatttctgccttgtaccacagaccagtgctctttagctgagcaaatccttgccaaatacagagtcggagtaatgaagcccccagaaatgcctcagaagaggagacccagtcctgatggagatggtcctccctgtgaacccaatctgtggatgtgggtggaccccaatatcctgtgcccccttggcagccaggaggccccaaagcccagtggaaaagaggatctgacaaacatttctcctttccctcagcccccacaaaaagacgaagggtctaactgctcagaggacaaagtggtagagtctctgccatcttcctccagtgagcagtctcctttacagaagcagggtatccattcccccagtgactttgagctcacagaagaggaggctgaggaaccagacgacaactccctccagtcccctgaaatgaaatgttaccagagccagaaactatggcaaatcaacaaccaagagaagtcctggcaaaggccccctctcaattgtagccaccttattgccctagcattaagaaacaacccccactgtggcctcagtgtgcaggagatctacaatttcacccgacagcatttcccctttttctggacagctccggatggctggaagagcaccattcattacaacctctgcttcctggacagctttgagaaggtgccagacagccttaaggatgaagataatgcaagacctcgctcttgcctttggaagctcactaaggaggggcaccgccgcttttgggaggagactcgtgtcttagcctttgctcaaagggagagaatccaagagtgcatgagtcagccagagttgttgacctctctctttgatctttgaaatgccattgctcccttttggaacactgccttccttactgtgcctacttatcccctgacattcattaatctctaaacttacccagcctggttggtgccaagtctgtctttagctactgttacaataatggtgttaagtaaagttagaggtgggtacaggggagacagaacttaaatccaggtggagagtcatggaaagtc

SEQ ID NO: 479798 - DNA, 619 bp, Homo sapiens
gtgggtgctgttggagacttacttatgatcagaaatatctatgtattctgtatatttacattattgacatgtattgataacaaaactttttatttgtacacatgcagccatggtcccaggagcccagtgatgaggagcctcaacaacaagaaccaccaactgaaagttgggatcctacacctggtcaggagagagatcagggtgcagctgagattcaaggtgctgggaagggaaagaaagaatgtctatggtggggaggaggcctatgtgtgcatcatgccttacgtcatgaccagtaacaggaggaaagaaaacattaggaaaggatctcaaacacttgctgaaatgcctgacctggaaactgatctccaggagctgtctgagtcaaagactggggatgaatgcagagatggtcctgatgtccaggagaaaattctgctaaatttagagcaatttaaaatgccagaaggaggagcctgttgaagcagcctcaaccgtattcttaggaaggttatagtctttcctttgtctagaattaatttcttttttttattattgtactataagttctagggtacacgtgcacaatgtgaaggtttgatacataggtatacatgtg

SEQ ID NO: 479799 - DNA, 713 bp, Homo sapiens
aactgggaacactgcgggttggtgaccatggccctgaggtctgtagaacgcctggcagaggtgtacagtgaggagggcccagtgctgtgtggcaacttctcaactccactgtggagatttgaatgggtggggctctgcgttccaacaaaacttgattttaggggggaaacgggcctagcaaatgggtgggtgacaaaagagcccagtgatgaggaacctcagcaagaggaaccaccaactgaaagtcgggatcctacacctgtacctgacctggaaactgatctccaggagctgtctcagtcaaagactggggatgaatgcagagatggtcccgatgacaaggggaagattctgccaaaatcagagcaatttaaaatgccagaaggagtgatagatgaaaccgaatctgaccatgtaagattttattttaccaacgggaatactttcaagtgtaaaaagagagactcttcatattgatatcaggatgataggtgaaaatcttggacaaatggttaccatacctgaaagaacacagaagggaagaagagttgggggaaggtgagagctaccttcctgtttctgctgttttctaaatacccccatattctggggtagtgtatcctgaaccccatcactcaaaacttagcactgattttatatttctgtatgatatattccaagttttcaacacgacatacaaaatttcccctttt

SEQ ID NO: 479800 - DNA, 749 bp, Homo sapiens
ctggataccacacctgacccccatgactatctctctgatccacctgacattcactccatttccccatatttccttctttcctgttcctcaccctggtcacacttggtttaacgacggcagttccaccaggcctaatcgccattcaccagcaaaggcaggccatgctatagtattttccacatctatcatcgaggctactgctctgcccccctccactacctctcagcaagccgaactcattgccttaattcaggccctcactcttgcaaagggactacatggcaacgcttatgctgataaggtagctaaagaagcagctagcgttccaacttctgtccctcatggccagtttttctccttctcattggtcactcctatttactctccaaatgaatttctggttattgcatctatcagaggcccccctgaggaagtgaaaaaggtcgaatcagacctcaaaggcaaattctttccaaatattgccatctggggaaaagttgttctacgtaagatctaagattaacacaataaacacttctttatgccatagatgatgagcatgaggatgataataaaagaagcaagcatttattgcacatttgctatgtgccaaatgctggtgtgaaacactttatgtgcctcatcctgtttaatccatacaacaaccctaactatttttatttaatgaaaatcttattcttaactgctgaatccatgaccattatttatgttcattggctcaaatagca

SEQ ID NO: 479801 - DNA, 884 bp, Homo sapiens
attcatatgatcaacagctgtttctcaagggtagatcatatgaaatctttaactttcctgctggcattcacctgtgcaagctcccagcttgcttgtctatgtctgcagctcgactttacagacttctctttgttagaaaatgacttgaggctgcttttcattaaaaagaaaagccttactgaggactcccatacccttaatatctgcctaaatgatttcttcttaactcctatatcatcagcaaggtacttctttcaaagagtctgcgaatcctttcagtattcctggtatgtttttgcagtagttcttggagcaaaagttcatgatgtgagtctccacacaatggagactcagaccaagtgggagctgttttcaagtttttgtgcagaggtgctcctagtagtctctgagggtgttttgtatttttgcagggttgatgataatgtctcctttatcatttctgattgcacttatttggtttttctctcttttactttttattagtctagatagaagtttaccaatcttaataaagaaccaatttttgggttcattgatctttttttgtctatgtgtctgtttttatgccagtatcatgctgttttgtttaccataaatctgtagtataatttcaagtcaggtaatgtgattcctccagttttgctcttttttgctgaggatagctttggctattctgggtctttcatctttccacataaattttaggaaagtttttttttctatttctgtaaagaatgtcattgttattttgagaaagatgcatggaacgcatggattgctttgggtagtatggacatttcaacaactttgtttcttccaatccatgggcatggaatatcttatcattatttggcaaataattt

SEQ ID NO: 479802 - DNA, 482 bp, Homo sapiens
tttccatttcctgaaaggcgccatggcagtgcagctcctggtcagactgatagagcagtgtgtggagactcacttcgtgaacttttgctcccaagaactaccacaggaacacaccaggaaagccaagaaaatccagagatcctttgaaggaactggattaccgctgcaaactcctgagacactgaaaaactgtgagcctgcttgctctctcaacagggaggttcgtggtctggggcgagttctcagccctggtcaccggctgcctcgaaatagactcagtgtcccgcacttccctggctacctgtatgactcagcagaagcagccataatcccccgggaatataacaccattagacagggaaccacaccccagcccctacagcagccacagcaagcccggcccaaggataggctgagctcagacatgcctatctctgcccccacctggtggtctttctctacctgctagctgaaggcaaagg

SEQ ID NO: 479803 - DNA, 1981 bp, Homo sapiens
tttacagatattatagtctaccttgcatcccagggatgaagcccccttgatcatggtggataagctttttgatgtactgctgcattcggtttgtcagtattttattgaggattttgcatcgatgttctcaggaccatcagctgctggtctgttggaggttgctggaggtccactccagaccctctttgcctgggtatcagcagtggaggctgcagaacagcggatactggtgagcagcaaatgttgctgcctgatcattcctctggaagttttgtctcagaggagtacccagccattctggatgaaggggtgggttgcccctccacacctgtgggtgtttctcataaggtggaacaagagacttggaaaagaaaaagacacagagacaaagtatagagaaagaaataaggggacctggggaaccagcgttcagcatatggaggatcccgccagcctctgagtccccttagtatttattgatcattcgtgggtgtttctccgagagggggatgtgtcagggtcacaagacaatagtggggagagggtcagcagacaaacacgtgaacaaaggtctttgcatcatagacaaggattttttctaattctttgaaaaatgacattagtgtttgatagaaattatgttgaatatgtagattgctttgggcagtatggtcattttcataatactgattcttccaatctatgaccatggattgtatttccatttgtttgtgtcatctatgttttcttttatcagtgttttgtagttcttccagtcgagatattttaccttctttgttaagtatatttttagatattttatttttttcagctgttttaatgtgtagaaagatgtaaaataagaactgatttcttgatttgattatcagcttggccattattggtatatagcagtgctactgaattgtgcatattgatttttattacctttaatgaattcatttatcaaatttaggagtcttctggaggagtcttttgggttttcaaggtataagatcatatcattggcaaaaaaagatagttcaacttcttcatttcctatttggatgcctttattcttttgcctgattgctctggctaaaactaccagtactaagttgaatagaaatgttcaaagtgggcttccttgtcttgtcccagttctgaaggggaatactttcaacttttccatattcggtataatgttgtctgtgggtttgtcatatatgacctttatgatttgaggtacattctttctatgtctagtttattgaagatccaagtcattaggggatgctggattttatcagttgctttttctgcatctactaggatgatcataggctttttgtttttaatcctgtttttgtggttaatcacatttattgacttcgatgtgtggaaacatccctgcatctatagcatgaaacccacttaatcatggtgaattatttttttaatgtgatactggatttggtttgctagcattctgttgaggatttttgcaactatcttcatcaggcatattagtctgtagtttttgtgtgtgtgtgtcctttcctggcttggttttaacgtggtacttgcttcatagtatgagtcagagaggattctctccttgaccttttggaattgtttcagtagaattggcaccagttctttgaacatctggtagaattcagctgtggatacatctgttcctgtgctttttcttggggggggggggagggatttttttttattactgattcaatctcattacttattattggtctatgcaagatttctatgtctccctgattcaagcttgggagtttgtatgtttccagtaatttctccattttctttagattttctagcttgtgttcatagatgtgttcatagtagtgtcagatgatcggttgtatttccctggtattagttgtaatgtttttatttttatttttgattataattatttgaatattctcttttttgtgaa

SEQ ID NO: 479804 - DNA, 670 bp, Homo sapiens
gcgcttaagacaaactaaaaggatgactctggtaaacacaccaacacgaatgcaaaacagccttgttgatgatatggagttttattgtctgcacggaagatcaaaccagccacaacattcctttatgccaaggtctaatccagagaaagtccctcagctgcaggtctgttggagtttgctggaggatgactccagatcctgtgcacctgggtatcaccagtggaggctgcagaacagcaaatattgctgcctgatcattcctctggaagctttatcccagaggggcacccccctctatgaggtgtctttcggctcctactgggaggtgtctcccaccaggctgcagccttgctggtcgatctcagagtgctgtgctagccgtcatcaaggctccatggacatgggacccgccaagcccggcactggagagaatcgcctgatctgcgggttgctgagactgtgggaaaagcacagtatttggatgggagtttcccattttttccaggattttgaataagtcagcctactgccttctaactcttatggtttctgatgataaatcatatctttaaattattgaggatcacatttatgtgtgatgcattattgcagatcacttctttcttgctcctctcaggattctctctttctcttggctttcagcagtttg

SEQ ID NO: 479805 - DNA, 1648 bp, Homo sapiens
gatggccgaataggaacagctccagtctacagctcccagcgtgagcgatgcagaagacgggtgatttctgcatttccaactgaggtaccgggttcatctcactggggagtgccagacagtgggtgcagtgcaccgtgcatgagccgaagcagggcgaggcattgcctcacccgggaagcgcaaagagtcagggaattccctttcctagtcaaagaaaggggtgacagacggcacctggaaaatcgggtcactcccaccctaatactgtgctcttccaacaggcttaacaaacggcacaccaggagattatatcccccacatggctcagagggtcctatgcccacggagcctcactcactgctagcacagcagtctgagatcaaactgcaaggtggcagtgaggctgcggaaggggcgcccaccattgctcaggcttgagtaggtaaacaaagcagctgggaagctcgaactgggtggagcccaccacagctcaaggaggcctgcctgcctctgtaggctccacctctgggggcagggcacagacaaacaaaagacagcaataacctctgcagacttaaatgtccctgtctgacagctttgaagacagtagtggttctcccagcacgcagctggagatctgagaatgggcagactgcctcctcaagtgggtccctggctcccgagtagcctaactgggaggcaccccgcagtaggggcggactgacacctcacacggccgggtactcctctgagataaaacttccagaggaacgatcaggcagcagcatttgcggttcaccaatatccactgttctgcagccactgctgctgatacccaggcaaacagggtctggagtggacctccagtaaactccaacagacctgcagctgagggtcctgactgttagaaggaaaactaacaaacagaaaggacatccacaccaaaaacccatctgtatgtcatcaattatgagattttttgtgattaattttagctcaaccattatctttagtgttagtgtattttatgtgttcctcatgacctggctggagcaccttgatgctgataccaaatacctccctgaactgttcagttatgataaggttaaggctttgtgtccccacctaaattgcatcttgaattgtaatccccaggtgttgagggagagactcacaaagagactggaagcattttgcccctgccctagagatctgtggaactttgaacttgagagagattatctgaaattggaacttatgtttaaaaggaaagcagatcttaaaagtttggaaaacttgcagcctgacaatgcaatagaaaaaaacaacccattttctggaaagaaattcaagcctgctgcagaaatttgtataagtaaccaggagccaaatgttaattgccaggataatggggaaaatgaaaaaggggcagagtccctttgaagagatatattagtgtcaaaagccaggctttaaaacttctatgagaacttttaatgaataagcataactgattatatagaggtgagaataggaatactggcatgatttggatctggatctaaacaactagggaaacacccagaggaggagaaggtgaggttaatcaagcctaaagaacagaaagcaaggcgtggagaaagaaagg

SEQ ID NO: 479806 - DNA, 870 bp, Homo sapiens
aaccatgttctaactaattctgagagctgcttaggaaattgcctcaacaaatagctatgaaagttgtgggctacagatggataatagtccatttaggatttgtctgcgcagtggatcctaagctgagtctggatgaatggacatggaggagggggaaagcaacaggcacagatgcagaggcaggaattgcagaaggtacacttgatagcacgtggccatatggttgggtatggggcctaattcttgaagtgaaggacctggacctttctgtggctgatacccaaggaaggctgcctaaggataaagagcacaaccccagtcatgtctttttgtggctctcaggccactccaggaagtcagagatcatcaaatccaagggtgttggcaatgggaaagaatacttcatatggaagagggtaaggatgagagcactggacaagaattctgatgcagtaacctcgtttaaattttctacgaagtgtatgtgggagcagctgcccctgtgagtcgtacaggaagtttgttattacctctcttatcccacttaaccaaggtcattcttcttccaccaattttaatactatatatcaaagtaagataaggacatcatcttttcattaatgatttgcctaagaaaatatacttcatacaattttaattattttaatttattgagcttttttgtaacctaatatttggtctatcttatagaatgttccatgtgcacttaagaaggatgtgaattctgctgtttttaagtactgtttcatagatgtctattaattcgagttagtttatagtgttgcctaaatattctatttttgttgttgttgatcttctgtctagtggttctatccatgattgaaaata

SEQ ID NO: 479807 - DNA, 559 bp, Homo sapiens
ttgagcgaagaagacaagaatcagccttcagtttgaagcggaagttgcaggcaatgagggacattgctatattaaaggaaaagcaggagaaagaaatacagacattacaggaggagacaaagaaagtccaagctgagacagctgcaaagacacgggaagtacaggctcagctcctccaggagaaaagattactggagaaacaactgagcgagccagacaagaggctattgggaaagagaaaaagaagagagcttaatatgaaggcccaggccttgaagttggcagcaaagcggtttatttttgaatactcctctggcatcaagagagagaaccagcagttcaagaaggaattactgcagctaattgagcaagcccagaaactaacggctactcaaagccacttagaaaacaggaagcagcagctgcagcaggaacagtggtatctggaaaagccagtcttcaatttctgagattctttcctcagcttggtttattctgctattaatacttgattgccttgtgaaattcttgtattgtgtttttcagatgtctcagattc

SEQ ID NO: 479808 - DNA, 568 bp, Homo sapiens
ccagccattttcacttcttttgtgattcttcacttgcttcaggccatctggatgatggtagagaacatggtaacatgagtgaatttcatgagcacgggcccattgccacacttcttttgttacaaagtgaagttctaaatcagaagcaatgccgtgtggaaaccatggcagtgtgtaaagcattctgtaagtccatggatggaagcaaatctgtatctaatctgatcaccttgggaaatggcttcaaaccaggggctcagtgtttgctgctgggagattgggctctcagtcatggctatagccaggcacgtgagcctaaatttcaggaatcgataacagattttgatgactgcagcaggacacatgtgctcatggccagtaggtcccagtcagatgtagaggacaaggtgctgatcagcaccttgaatcccccaaataatcatcctggtcctctgccccttcctctgccacctgtggctccagcacatccccctccttatggaacatgtggagcaggaggaggacacccccaatccctcatgggggaaaaatcaggataggttatgaa

SEQ ID NO: 479809 - DNA, 478 bp, Homo sapiens
gtagccttcctatcaaaaatccttaacccaattctttaaaatgcatttctttgatcccccaacgcctgcaccttcctctaagccttcttccaaaacctctcacaacggaataattgctcctcctccatctaacgacaagaccaagatagctatcgtaaaagttaaagacttaaaacaaactttggcaattaagacaggataccagttggaatggatcaaatattccatccacacgttaaacaaaagcaattgttatgcttgtgcacacagcaggccagaggcccagattgtcccctttccactaaggtggtcctccagtcgaccaggcatgggctgcatggtagctcttttccaggattctacagcctggaatagtaagtcatgccaagctctctctgctatatcccgaagtctggcaccctgtgggtcagcccccgagggccatccagcttcagtctcccaacactaagttcacttc

SEQ ID NO: 479810 - DNA, 744 bp, Homo sapiens
ccagaaagagactataagggagagtatgagaaatctagtccaaagtgcggggcagctaacatttagaggatggttgatgtgtttgaacacccagagagttgctggtcccaccttgacctttatctgccccaagcttattagcttattcccaatgtctgcccccaagcttatctcaaaatcatcctcttcctgtgaagctcaatgtggcctctggtttctcctttcaagatatagagaaaagttcgccttttaccttttctttatggctatggatagaaaggtattatttcctagtcagaagaagattccatatggaaatgatacacctgtttgtctaagatttttttcttgttccccattaaaaactcttctcctctctcagtctactctctatttgaccaaaggaaacctccatccatgtaaaccataacattgtccatgtctgttgaaaaatacttaaaaacatctattttctgtgccacaaaagaaagttacaaagaaacaagaaacaaaaaaatcttgtttcttttgtgggctacaaaggtaggccccagtgtctgttgttcccttctttgagtccacgtgttctcatcatttagctcccaattataagtgagaacatgtggtatttgattttctgtccctgcattagtttgataaagacaatgggttggaagccatcatcctctacccttatgtttctttgtggtctttatgctttgggaaaatacttcacttctacac

SEQ ID NO: 479811 - DNA, 495 bp, Homo sapiens
gaagaggggcagcggagacgccatctgcgcagcctggattctccagggtatggtcagcaacggagtgcccaagcccctgctcattccatggagtcccaggggttcaggatgcattcgaaaggggtacagactgaagatgaatggctacccatctagaaagaggggagcaggcatccctggttcccttctctgcctgacagatacccgagccaaggtaaggggtaacagatggcacatggaaaactgggtcacttccaccctaatactgtgcttttccgatggtcttagcaaacggcacaccaggagattagatcccgtgcctggcttggagggtcccatgcccacggagcctcactcattgctaacacagcagtctgaaatcaaactgcaaggcggcagcgaggctgggggaggggacacattcaaagctgtgtgtagagggaaatttatagcactaaatgcccccaagagaaagtaggaaatatctaaaattga

SEQ ID NO: 479812 - DNA, 546 bp, Homo sapiens
cgtgggaattcaagatgagtgagatttgggtggggacccagccaaaccatgatgcaaatgctgatgcacacaaaaacctggatgaacttcgaaagccttatgctgagcaaaagaagactgacaaaaaggtaaccaaagaaccaggagaatgcaataaaacagaagctaaaagaggagaggattttaaaggagggatggtaaacagcaaaagaattcatagagagtttgaagatcacaatgttaaaggtaaaatcttagatgaaaaaccagatctgtgtagatttttatgccaacgtggatatggtgaattaagagcaaagccaaaaggcctaacaggattttgcagtggcagcttgaagcaggagaaaaaacaaacagccaaagcttctaatgtgaacctttttcatacttttacttgggctatctggggtaatcctcttagttaatctttcttggcctcagtttcctcatttgtataactaaagtgttggattccattatttatcctccaacttctactgagaaagaataaataaataagtatgg

SEQ ID NO: 479813 - DNA, 1278 bp, Homo sapiens
cagtggccaccgtcttcaccgtcgtcacctcagcctagtcgccactccagttgaggcactgactggcgtcatgtctgccacaggggatcaagacctgatccaagaggaccaggaggctccagtgaaccaggagggagcgcaggccgaggccggaggtgaccgggagggcggtgactctggccccgacagtggcaacactgtggccggagtcgcagggcccatgagaggcctcggggaggaggagggtgagcaggcggcaggcttggccgcagcccccgggggtgggaacgccgaggaagactcagagatcaggatagtagtggagatggtggaggaggaggaggatgaggaggaggaagaggaggaggaggaggaagagaggaacgaggcggacaacttcgacttggtcgcggccgcccgtcgctaccccataagaggctttcgcatggagtttctggacatggtccactcccttctcctccgcatctatcacaacgaccacatcctgatcaggatgcaagagccccggctgttgctggtgcatgagaggctgggcgtgggggccgcgggtcctgagggcgagggcctgggcctgctccaggaggccgcgttggtcccagagcctgaggtgccagcagacctggccgagatggccagggagcctgcagaagagcccacagaggaggcctcagagaagcccacagaggaggccgcagaggaggagctttcagaggaggccgcagaggaaccgcgcaaagaggaatcggctgcagaggaggagtccgctcaggaaccggccacacaggagggtgctcccctgaaggtgtagtaacagtctatctgcagtggcggggaaacacggacccgtgcactcaaggtttcctagcaggccggcggtgtgcccacaagtggtgaatcatgtggtgaaatgggggtcggactcgggtggtgaagtaggggtcagggcctcctgaaattaaggccaatgtgtaccatgagtcgagccaattctctaacggatctatgatttttgagaaacatgccgcctctagcaccctgtgttgagagaaatctaagatatcaatgccatttgggggcaccaatgaatggcacgtagatagggtcatgagggactcgcaggaaacaaggacaacggaaagcaaaaacgccaatggcgagcatctttttgtcatggctttcaaaatgtaagattcttaaaagtgatccccaatattgagtgttacaggccctggtaaaatatacattctggagtttgta

SEQ ID NO: 479814 - DNA, 733 bp, Homo sapiens
aacaacctttccaagggatcctgccagatcgaccactctcctggtgcactagtgttttcataatgatacaattagatgtaatcagagctggccctgaaaatcgagagcatttgatctccacaggcctgattggctctaacggcagatggaaggagcctcaagtctctcaatcactgtcaaactgtgaggtggggcctgacaggagcagtggaggaaaaggtggtttaaggtcgtcacccaacacaggagtcatttgccctttctaccatgcagctcacacaaaggcaaatcccagtggagaatcaggaaagcaactgagagctgaagagaatctaccctggtgtccagaacgccttccacccctaaaagagggccggcagaggaaagaaacctggagagcacacacaaatgaggatgatctaagaattcacatcatgaaaacgagaatgatgacaataccactgccagcatgaccaaaaaaaaaaaaaaaaaaaaaaaagacagacaaattattgtgttattttagtgacggatggaagaacacataagactggattagggagaaagagcgatgtaacatacaatgacatccagtgtgcttcagagtgtttaagaattatggacactttagccatgaacagtctataggaggaatcattgatacaaaggacccgattgactgacaaagcaagccttatgtatagaaaggaaatgcacatttctggaaacctgg

SEQ ID NO: 479815 - DNA, 881 bp, Homo sapiens
tataattactacctttcaattctaaggtacaagattttgtcattccggattggaggtaaatgtcaaagaatgattaactaagatcaaaatgatatacctttttctactcagtattcattatacaaatgattttaaatactgggtgtgtgcccttaatattcagggctctaaaaaagaagcctttggcaactaccattctattctttacctccatgagattcactgttttagcacccatatatgaggacgtggatgaagctggaaaccatcattctcagcaaactaacacaggaacagaaaaccaaacaccgcgtgttctcactcataagtgggagctgaacaacgagagcacatggacacagggaggggaacatcatacaccggggcctaatgtaacaataggagaaaacagaagtaaagaaaacaaaaatctgggtgctaatgacggtgacagcaggaaaaaggaaggatctataaagatagtacacatagctgcaaacacagttgccaagtaccagcatgaaaaattgagacaacatggtctccaagggcagtgtctatctctagacgactatgcctatacagagtttccttctgtaaagagaatatccaccgaggttccccagaaccaaaacttcagactaaggtttcagcccacatttaggaggaacatggatggagctgaatgctattatcctcagcaaactaatacaggaaaagaaaaccaaatactacgtgttctcacttataagtggaagctaaatgatgagagcttatgaacacaaagaaggaaacaacagacactgggggtctacttgagagtgcatgtacccattaatatactaactaacatactatatctatcatttatatttatattt

SEQ ID NO: 479816 - DNA, 506 bp, Homo sapiens
ggtgtatcggcggcatgtgggatccagttcatgtaaggagggatgcggctgcatggtccaaattccataactcaggacttcctagaagggtttaaggaggcagaggagtttggctggtttgttgttttcatgactcaacccactcattttaccagcaatcaaaacgagcatggattctcactgcacctgctcagcagagagggcggcatccaaaccagtagatctgcaactgtggcttctgcaacaacagcctcagcatcacctatgcccatcctagcaacaaagatccccagactccgctccagacccaatggagcagaaatgttactaggaggagagactaagtctgctggtccacatagactgtggccacccctcccactaggtgctaaggcccagggagatccaaattctgtccctgagcctctggatggagttattggagatcctgaaggaaagccctgaccattgaggaaggatgggtcagggttaggcctgaagaggca

SEQ ID NO: 479817 - DNA, 539 bp, Homo sapiens
atcctgctttttctcactttctgtgggtcacgcagaccacctagcaaaagtttgctgcagcggtggggccctcatggagaacctctgccagggcagtatggaagggaaatgtggagtcggagcctcaacacagagttctactggggtactgcctagtggagctgtgagaagagggccaccatcgtccggaaaccagaatgatagatccactgacagtttgcactgtgtgcctggaaaagccgcagacagtaaatgccatcccaagaaagcatcaggaaggaaggctgtaccctgcaaagccacagaggtggagctgcccaagaccttgggaatccacatcttgcctcagtgtgacctggatgcgagacctggactactgcctatgttcactcaagaccccagggctttacaatcagccaatggcaaagccagccaggcctgtgtttttcccttcagggtgtcaagattccccaggtcccacatgggtccagatgtgctgtccaggggtcagggactatagtcaaaagccttagaagtct

SEQ ID NO: 479818 - DNA, 865 bp, Homo sapiens
aaaaggagagtcgttatctgcggaagatggcaagaccttgctccaaaatcctagaggcctttgctgtgattcacctatggggacctgccaaaggctccaaacagcacctctatctgccactgacacctcaagcactattggatctgctgggtcatatggcccaagtggcagagcagcttgcacagcagcctgaacctgttgcagagctttctcctgttctggaccccactcaaaactggcagctttttcgtcagggacccaatgtggtgattctgccagctgctcagtatatctatgccaattatgcattctggcactgggaaaatgacaacaggatgagtctgggaacccactggacctacttcaatgccctcactttaacagtagacacctggaaaggctgtgcatgcaccttttgttgcagacacagccaggaccgatactttgcatccttcaatccaatcaagttgacattcaatattaaccatcacagtccctaatttctttcagtaatgttttatggttttttgatattccaacagttcgattgtaatgtgtttcaatgtgagtctcttagtttttcctatttgaagttcatttagcttctttggtgtgtagattcatatattttatcatatttaacttttcatccattagttatttatttaaatattttattttcccatttctcttctccttctggcattcccataatgtatatgttaatacactttttgatgtttgacatttacttcagtttctgttcatttctttcattattttttctctatattcctcacactagatcatttaaattatcttcaattttgctgattcatttttctgcctgctcaaagttgttgaa

SEQ ID NO: 479819 - DNA, 615 bp, Homo sapiens
tggcaaagggatgtggaggattgcggtgggcctggagaaagctgtactatggggagtgatccggcgggctggtgcatggctgtggggctgtcccactggagctctctgccagccaggcataatccgccagtgcaggagctatgatgcagaaaccctgggcacccaaggctgccctgcaagcaggcattaccaagctggggcctcagtagaagccagtataacaagggatgctcaggccagactggttctgtctaatgggcaagactgctcgacagaatttaggtttgacagctctcccagtgctaaagtcttctatggaaacaagttgagcctaataactggtagtggacttgccctcctttcagaaaaaattacaaaactggaaaatacagataaaatactgtctgcagacgttggcaaacatgtagcatagaaccgtaatcagtgaagggatacaagaagcatggcatatgtttatccatcattttatgggtcataatttttggcttctttgcatatctaataatttttcactgtatagtaggtatctgtgaatattatggtattgagtgtctatatttgttgtcctacattagcaagatttgaattatattt

SEQ ID NO: 479820 - DNA, 891 bp, Homo sapiens
cctgacagtaggctccggagggaacacatgcaaagtggcaccggtgcccacctaagggcagagacatctggagaatgctccagggttgcacagcggcggccgggcaacggcgctcctcacttctcagacggtggggcggccagggagaggcgctccttactttccagacggtggcgcagtggtgcagaggcattagtcaagtgcggccgccaggcagaggcgcatctcacttcccaggcaggaccgccgcagggcagaggtgctcctcacttcccagaaggtgtggcagccaggcagaggcactcctcacttcacagaccgttgggcagccaaacagaggcgctcctcacttcacagacggtagggcatccaggcagaggtgctcctcacgtcccagtcggggcggcggccgggcagaggctcacctcacttcccagatggtgggacggccgggcagatgtgctccccacttcccagacagtggggcagtcgggcagagaggctcctcacttcccagatggtggggcgtctgggtagaggcgctcctcacttctcagatggatgccacaattgctatagaggaagaagagccagagggataaatagaatattaaattcccaggaaatgtgtagaaagaaagaagttaaatggattagagaaatttgtaaggtttgggaatttctctgttatcttttaaagtaaactttctaattctatctctttctctaccttcacttaatggctaaataactcttagatttgcccttttgagggtattttctagatcatataggaatgcttcgttgtattttattcttttttcttttgtctcctctgactgcattttcaaatagctcttaaaactcactaattctttcttctgcttgatc

SEQ ID NO: 479821 - DNA, 3916 bp, Homo sapiens
gattgatatttggctccttgttgcctatgcaaacttttgcaagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaattcctttcagattaaggccagtattcagtaatcagttcctcctggagaatgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgatgaaagtaagtgcaacggatgcagacagtgggcctaatgctgagatcaattacctgctaggccctgatgctccacctgaattcagcctggatcgtcgtacaggcatgctgactgtagtgaagaaactagatagagaaaaagaggataaatatttattcacaattctggcaaaagataatggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttacaactattcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcagtgaccaatgctacactgattaatgaactggtgcgcaaaagcattgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacatgcagaattctgaatgggctaccccaaacccagaaaacaggcagatgataatgatgaagaaaaagaaaaagaagaagaagcattcccctaagaacctgctgcttaatgttgtcactattgaagaaactaaggcagatgatgttgacagtgatggaaacagagtcacactagaccttcctattgatctagaagagcaaacaatgggaaagtacaattgggtaactacacctactactttcaagcctgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaattgttcctcaagcagttcagatccctacagcgtttctgactgtggctatccagtgacaaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagaaaatatattgaaaaaaacttcaacacaaagggttgtagcactgtcctcagtaccattgtgggcatgaggatcagaatagtctgggctagatacatcacattaaagcttttcagaatctgataaatagctctaaatactaatgatattgagaagcctagcttcacttgggaaaatctgtggctgttcacagaaattcagcaccaagatattccccccatactctaccaggccttcaggtcctcataaagaaaagtgtcgttttcagattaggaactcaaaattattttggtgcatcaaatctacaaatgctagcaaaataactgagcactgaaaaagaaattatgtatttaaaaattcaaatgcagtaggtgtcttctttttaaagaaatatcatacaaaatgggagaagtgacagccaatacaatacaaattcattgttccttaaggaaatacttagagtggaataaaatattactgttagcagaaggcagaattattccaatttattttaaacagtgagaaatgcattttcaaaatgagggtttggggaatatttacagttagttcattactcatctgtatagaaacaggaaagtggaaaataaaatgttctagtagactataagagacaagggaattcatctgaaattttatgttttataaagggaatcaaatactttctagttctcataatttctcattctccttgatcattctataggttgtttttctgacttggatgttctgaaaatatatggaacatttattagataggagtatgaaatgacaatcaactaattttctcaagatttgaaacttttgtttctaaaaaataaactaaattgtgcctttttctaagtgtttaactgtgccatggtgccattcagaagaataaaagtctgcccaatttattgtgacttttcctgcataatttctatgtacattaaacaggtttataattcacttgttcttagacttcatacatataattagtcatttgtcatttatatatttcaaaatcactgcttcagagaaataatgtagaagcatcatggaggttatggctttctatgtacatataagatctttacgtttgaggatcatatttaaagact

SEQ ID NO: 479822 - DNA, 949 bp, Homo sapiens
acccgattagttagacacagagccctgattgtttgcagcatgataataagctctaaaccagggaactatatcagttgcatagacaatgaatccagtctggaagataaattgttcactgaggccaagaagcaggcttcagggtcaatcaaatacttggctgctattttgaaatgcgtgttactgtttcctgcttgtccaggtgagattgacagcagtctccaacttcttgttcactttctggtaaatgaggccgccaaactctgtcccgtcattcacattagtgtgaaattggaattcatcagtcttgcagccaactgcaaagttgctctgggtcactccggactttgcagtctcaaaattcatctggtagccggccagccagcccttgtaacccagcatcagagcagcccggatggaaggcccagcaatgaggtggctatggccggggctgctgtgcggaggcagagaactaagtggagccagctgcggggcccaactcccgtttttaaaaccatcagatctcaggagacccattcactgtccggagaacagtacgggaaagacccacccccctattcagtcatctcccatcagttccctcccacaacatatgggaattatgggagctacaagatgagatttgggtggggacacagagccaaaccatatcaaccaccaataaagccaatttaataaaatgaagaatatatgtgtatgtgaaaaatactatatgttataatctgtaaacaaaacatatcatagaaaattgctcatatttatagagatatttattatatatgtagactgtgttcttattgcgttattaatatctaaagttacattcgaagtctttagtttaatctggaaaatcatctcaatttactactgcatacttcatatgaaaattgcttttcagtttttttactacaaaatatacatctggatatct

SEQ ID NO: 479823 - DNA, 4121 bp, Homo sapiens
tcttttctgcactgttgtcatgatggtgaatggtctcacaagaattgatggttttaaaaatgggagtttccccacacaagctctctctttgcctgctgccatccatagacatgatttagggtatcgggtggaagaaatttctaagcagcaaagcattcaagaggtgactcaggtgctgttaaaggcattcaattttataagggaagcagaggataaaagttcagaaaatttggagcctgacaatgcgatagaaaagaaaaacccattttctgaggagaaattcaagcgggctgcagaaatttgcgaaagtaatgaggagccaaatgttaatccccaagacaacagggaaaatgtctccagggcatgtcagaggttggggctctcatggagaacctctgctagggcagcgcagaagggaaatgtggggtcagattccccacacagggtccctactgtggctccacctagtggagctgtgagcaaagggccacagtcctccagaacccagaattgtagatccaccgacagcttgcacagtgtggctggaaaagctgcatacactcaacaccagcccatgaaaatagccaggagggaggctgtaccctgtaaagccacaggggtggagctgcccaagaccatgggaacccacctcttgcatgcaagacatggaatcaaaagagataattttggagctttaagatttgactgccctggtggatttcggacttttatggggcctgtagcccctttgttttggccaatttctcccatttggaatggctgcatttacccaatgcctgtacccccattgtagataggaagtgtgtatctcttgggagacattctgacaattcctcaaaatgttaaacataggttactatatgacccaacaatttcacacttttctatatactcaagagaatttcaaacatatatttacatattaacttgtacacaaacattcacaacatcattattcataatagctacgatatggggaatgacccaaaagtccatcagatgctaaaaggttaaccaaaatgtggtatattcataaaattgaatattgtttggcagtaaaatctatgaattactgttatatgctgcaacattggtgaatcttagaaacatgctaagtgaaagcagttagacacaatagggcatgaatcgcatgaatctatttatataagttatccagaataagtcaatccatagagacagaaagggaattaattgttgccagggccttgcaggagggaagaacaaggagtgattgctaatagatacagaatgactaaaatattctaaaaatttattgtagtgttggtttcacaaccatcacagtttatttgtatatatattaggatggtacaaaagtaattgtggtttttccattaaaagtaatggcaaaaaccacaattgcttttgcatcaacctaacctaatactaaacaccagtgaattgtacaatataaaagggttcattttagggttaattttatgtcttgttaattatatctcaataaagctagtataaaaaaagaaatggagtgctaatactaaaaatgaataaataagtcaataattgacagtcaaaaatagtgtgatctctttcaacttttatagccatcatcattagtagttgtaatagtagtgatagcagtagcatttcattgttattgactggagtatttgctcttggagatataaatttatttatatcagagtgcaggagagtaagattgcagccatttctaacaaagaataatactagatgaagacggatgttacactaagctcagggcatacaatgcaaatgcacagagcataattatttttattttagaaaacttccagtttaaatttactttctatattaatttgaatatctatgtgactctttaataagtacagtattaaatttatttttattctgatattattgtgttaataagaccctttttggaaataaataatgcatcatttagaagtaaaatctgtatgtgttatagaattatgaagcgacaatatctccagttgagaaaactgtgtagagataaagaagaaaacataagaaatataaacatggtaagtaaacggagctgagtttttcaaaattagtcaatctttttaatctaatcaaaaatattaaaatatgtatcacgtgatgattcaatttaaaatgcacactcagaagctatcaactttttgcctactttctttctttatggctaggaatgttagaattgttatagttatcaaacaaaaacatttctaaaacaaattctacaattactttgaaaaaataataaagaaagcaaatgctatgtaattttatgtgcttgaatttgaaaataaactgtataaaataccagacaaacagatttgtggtagtaagctgacaagagtaactagtgagtttctgcatttttcaaatgcttgaagtaaatacatctataggctgaatgtctgtgtctctgctccgaaatttatgttgaaatcctaacccacaatgtgatagtattaggagttatggccttctgtaggtgattagcttatgacatcagatctctcatgaattgcattagtgtccttataaaagagagcttagagagcttccttctcccttgcctccccaattaagtgaagtcacactgagaagacagctgtctctgaatcaggaagcaggccctaaccagacattaaatttgatagtgccttgatcttggacctctcagtctccaaaactgtgagcaataaatttctgttgtttctaagccaccaagtctataatattttgtaatagttgcccaaatggaatgagacaatatcatatagctaaaagcttccataaagagttcacagcaaaatgaaaaagtaaccgtatcaatgtgagtgatttaaaaacaaaaaacaaatttttgtataaattatgaaagctaaattgttctacattaaataattctataagatgctattctataaaacttgtatttagtctaatgatgtccttaaggaaattagtcattatattacttgcagtctgattcatgaggattttccatataaatttcttcctagtcttaacatcaaaaatatttgtgcatttttctgagccagtctcctgttttcatctgataggccctattaactatgttttggtttctctagtatgtgtatggatttaatgatatgtatttttcatacaagcttcattctcagatatgttttatattctactattgtcatttttttctttgtcatagaatttataatatttctctccttttaaattttcttggcttacaactctaagggggtccgcatgagagggtcgtgatcaattgagcaagcagtggggatgccaatgggtcataaattcaatctcttaattccatgtttcttggagattttgtttgtttcttgtcattttttaaattcttgtctgactgtcttatttcagaaagccaatcttcagagacacaatgctgagagcaatgctgtccagtggaacatcctgcaatgatggtactgttctttattggtactgacaatagagtagctactacttacatgtggttgttaagcaactgaaatgcagccagtgtgactgagaaagtaaatttttaatcttattttattttgactactttctatttaagtaaatacatgtgtctgtgttgcatggagtggatatagagatcaattttaagcaggaaaaattcataaagaagcctagtatgtccctggtagaagttgaattatcttccaagccctcagatttttcaccttccactaattaaacaaaatattatgaaatcctaaagtttcccagagttggccattggatttcagaggaagggtaaggtgaaagccaagtgattgaggataggtactttccactgctttctactcctatactttcaaaaaagagcagaattttgtgtatttggtaaattaatttttcacttaacttatttgcataaagatctgtaccacttgaaaattttgaaaaccactaccttgtacaacagattgtacccatattcagaaagcagtacacgatatgtttccattatgtggctgtacatatttataggaagggaaagttgctattcatgc

SEQ ID NO: 479824 - DNA, 1050 bp, Homo sapiens
gcagcgaattaagaaaccctgctctaagtcttttgaagatttaagaaaagcttagtgttgtacatgatgtatgacaccaacatttctccttgtgaggaccgtaggaagctttcaatcatggcagaagacaaagggcatgctgacacatcagacgggcgtctgcctgtggagcaggcctctttgtgggaacccaggcttttccatacattttctgaaatccaggggagctcaagattcttctaccctcagcaaggctatgtaaaaatcaatgctatggatgcctgtggggtccaagtacaagagaatatagcttttggtgtaccaaaggaaggaggctgccttacatctatgagtgactcagcttgccaatttctgcagagggagccagcagggatttttgacaagaaatgtgttgaatttgtaaatgtattttcaaggtattaccatcatagtagtaataagactttcaattcataaacatggaatgtctttatatttaaattatctttaatttttaatgatattttatagttttcatgcacagtatagttttctcatacttctttttttacttttattcctaaatatttaattctttctagtactattataattataattattttcttggtttcctttttgataataactatgagtttccatacatgcccactttcaggttgagaaaatttctattcctagttttaaaaattaatttagtgtttttcatcatgaaaggacattgaattttgtcaaattttttctgtatctattgagatgtttctgtatttcttgtcctttattctattcatatggtatattattttattgattttcatgtactgaattaactttgcattgctgggataaattctacttggttatggtacgtaaacctttttatgtgtggccaaattttgttttagtattgtcttaagaatttttgcatttatattcatacggaatgccagtctgtggttttgtggggtttttgatgcctttgttatatactgaatacttgtgtttccccaccccctaaattcgtatctc

SEQ ID NO: 479825 - DNA, 715 bp, Homo sapiens
attagtcccgtgtcaggacagcactgagtttaatgcctcacaatttctgtgttctccctcctcaatacccagagatgccctctgtgccatgcctctgctgccagggggtgagggaggggtggagtggcaattcaagactgttttttaaaaatatcttcagtatctctttcagtgatatgaagacaaaaacagatactatgagaactcagctgatatttggttcttatgaagatgttcagatgtgtctggagtttcttccttctggtgggttcatggtcttgctgacttcaggagtgaagccgcagacctttgcagtgagtgttacagctcttaaaggtggagtgaagctgcagaccttcccagtgagtgttacagctcttaaaggtggtgcatccggagttgttcgttcctcccatccggaggtgttcgttcttcccagtgggttcgtggtctcgctggcttcaggagtgaagctgcagaccttcgcggtgagtgttacagcttgtaaaggtagtgtggacccaaagataatcatacattttaactctagaatttttacttgattcttttgttataattctaattatttattgatattctgtatttggtgagacattgtcattatagcttctattacttatttaagcataattttctttcacttttcttgaaaattctaaattgtaggtatgtaatatagcaactgtgtttactt

SEQ ID NO: 479826 - DNA, 986 bp, Homo sapiens
ctgctagttgctagctgcaatttggtgagggccatctggaactaatgtaatggcttcatactccctcctgaggcacctttgtgtcccaagctttcatttgaagccctggaatggaacaccagatataaggcagattaccgtgggttttgagggccacagtacaggccagggagggcctgaaagctggggaccgggttgctggtcccatgaactgcaatgtggacttgtgatgcctattctgggcccacccatggctgcccatggcttcccatggactactagagcagggcagaggatggtcagaggattaacagggcagagagatgatgggaccaccagctacagagaggaactaccctctctgctgatagctggaggtgatggaaaatccagttgcagagaggagctaccctgtttgttgagagctgcagagacaacctgcccacacggaggagctaccctctccagggcctcctctttgccaagaatggcagacatcatgacagccagttgcagtgaggagctgcactcttcagggcttcctctctgctgagaactgaacaaatgatggataacctgcctacagagaggagctacccactgagggtctcctctgagctgttgtaacactcaataaagctcatcttcctcttgtttaccctttacctgtctgcatacctcattcttccttgatgcaggacaagaacttgaacaaaggcgccctagtcacagaagtttctgatcagaaaattgacactctaatggtgccctaacaattatgtaattattgatttatttcagctaacaccctactggttatagcaacagatgcaaaatatggtaaattaatttgtaaaagatcaatgtaaagtattatgtcttcatgttgtgactgatcttagcccacttgatcatgtgagttattagtgataataaaatgttctcagaatttcaaatattaatgaaaaagggaatcttgtaaagta

SEQ ID NO: 479827 - DNA, 2651 bp, Homo sapiens
taagaagaagagacatcaggggcatgcatgcacagagaaaaggccatgcaaccacatgcgaaccattacaccaccacctgggctatgctctccggctgccgctgccaccaccccgcccccaccttcgcctccccctccgcctccgcctgcggtgcacattaaagatccaaagtcatgactgactccaagtatttcacaaccaataaaaaagcagaaatatttgaactaaaagctgaactcagcaatgaaaagaaagaaaagagaaaggaggctgtgaagaaagtgattgctgttattaccgtggggaaggatgttagttctgtctttccagacatagtgaactgtatgcagactgacaatctgaaactaaagaagcttgtgtatctctacttgatgaactatgccaacagtcagccagacatggccatcatagctgtaaatagctttgtgaaggactgtgaagatcctaatcttttgattcgagccttggcagtcagaaccatggggtgcatctgggtagacaaaattacagaatatctctctgagcccctcctcaagtgcttagaggatgaggatccctatgttcggaaaacagcagcagtatgcgtggcaaaactccatgacatcaacgcccaaatggtggaagatcagggatttttggattctctatggggtctcatagcagattcaaatccaatggtggtggctaatgctgtagcagcattatctgaaatcagtgagtctcacccaaacagcaacttactcaatctgaacacacagtacattaataagctgcggacagccctgaataagtgcactgaaggggccagattttcatgctggactgcctgtctaattacaaccctaaaaatgatcggaaggctcagagcatctgattctgactactacaatatgctgctgaagaagttagcccctccacttgtcactttgatgtctggggagtcagaagtgcactatgtctccctgaggaacatcaacttaattgtccagaaaaggcctgaaatcttgaagcaggaaatcaaagtcttctttgtgaagtacaatgatcccatctatgttaaactagagaagttggacatcaggattcatttggcatcacaagccaacattgctcaggttctggcagaactgaaggaatatgccacagaggtgaatgttgactttgttcgaaaagctgtgtgggccactggacggtgtgccatcaaggtggagcaatctgcagagcactgtgtaagcacattgcttgatctaatcaagaccaaagtgaattatgtggtccaagaagtgattgttgtcatcagggacatcttccgcaaatactccaacaagtatgaaagtatcattgccactctatctgaccctgtcatggctaaagaagtagtcttgtctgagaagccactgatctctcaggagacggaacctattgagccaactgcgttggaggagctaatctgccacattggttctttggcctctgtgtatcgtaagccttccagtgcttttgtggaaggaagtcatggaatccatcgtaaacacttgccaattcatcatgggagcactgacacaggtgacagccctgttggcaccaccaccgcaacgaacctggaacagcctcaggttatcccccgtcaaggtgatcttctggggagtcttttaaaccttgacctcagtctcccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagaagtggactgaatgacctgtttgaactctccacagggataggcatggcacccggtggtttaactggtgtcatccccagcactcctctggccatccatacaccactgatgccaaaccagagcattgatgtctccctgcctctcaacaccttgggcccagtcatgaagatggaacctctgaataacctgcaggtggctgtgaaaaacagtatcgatgtcttctacttcagctgcctcagcccactcaatgtgctttttgtagaagacagcaaaatggagcaccagtatagtttggtagtttgtaattgagagctcatttcaaaagcagaaaaagacaaccaatattaaagcaagaaaaagtgtcattgaaaaaaataataaaaactttctcaactttcaaacagaaacacctacaaagaatcagcactactcatgttcctttctgactggtctttggtgttgattcatgaaacttaagccgattttattttctcacttattcaatattgggacttcatttgtagatttatgtgcaaactgggtttttcttttgggcattttatttctgaatttttcaaaagaacacaaattattcttaggtttggatgcctaacatagtcccaaacttggaggctttgttcattttttaaaattattttttttgatggattgggttaattcaaaagcctcatctttgagccctgaagttttttcttcatcttgtttgattctattttttagactttccagtgctttctgcatttctctaagtgtgtccttgatttccaggagttgtgattggtttttattta

SEQ ID NO: 479828 - DNA, 2504 bp, Homo sapiens
tgcgctaaaatcacagaattcaacactatataattcattcatctcttatactatgataccagagaagcccttggataagaaagaaaagaagaaaggttcacagttgaacacagtcaatctgtacctgtatgcatctggtggaagcctgcatggaactggatgctatattggtggcgggaataagcatgttggagaaaccaaccccacaccacccggcgggtaccccaagtccagcggagacaaaggagttagaaagaaacagaataagagttcaaaaggcgggtccaggggaccggagtgttggaggcttgctcagggcccagagctcttgggctccgcctatttattggtttacaagctctttgttcttagggcagatgggaaggaggccgcccatggctccctgtgggtgtctcgcacagggaagaccaactcatctggcaccctagaaactctctttcccacatcccaactactggggaggctgaggttggaggactgcttgagcctcacaagtgaggctgaaatgtgccaagatcatgtcactgtactccagcctgaggaacagtgagattgcctcaaaattcttttaaaaagattttgtaatttcagaagatttcaacatgtattatcttgtgtaatatttcaaaatgtattgttatgttatacagtccataaatacacatgatatttaaatagtcactgtagtcgcaataaaatgtattgttatgttatacagtccataaatacacatatttaaatatgtcactgtacatattattttatgtaatatttcaaaatgtattgttatgttatacagtccataaatacacatgatatttaaatagtctacagtgactatctaaagtgagcattagagctcattttgtctctaatgctttcaactgacttttactttgtcattaatatagctatactgctttcattttgtgatttgtttccatttatttgatgtaacttgcctagtcttttactttctactttttcagtttgaggtatattatttttaggtaaaatatagttagaattgtttttcacccaattggtgatttttagtttttaaaattattgaataggtttgccaatttttatttaaagtcttaagtttggtctcacttttgtcatcctcttttaagccccattttctatatttatatagtccttcatttattttctaacttgttctgcataatctgtgctttcttttccttttctctctagaaatttagaaaatgtatcctctctttttagtgccactagtggttatttttgtaatttaaaaagaatgcatagggctgtattcatttatttgtcacttttagaaataaaattatatacattgagtttatctggaacataagaatattagtactttaaaatttcttcccaccttttaccttttatcccaggattttagattttgtacttttgttcaaaactaaaatttaaatctggtaggaactggtagccataataatttaagtttattagacaaaattcaatgttatgctaatttgaatgcatatcattcctttcataactcaacttttctattgactgatttattgatttttattctatttttcagttgcatagattatagattatgtctttaagtaaatttatcacaaaagggacagaattggggtactttagtttttgtacatgtaagaatatattaaatatttattctgatgcctttacacatgtatgacaaattagatgaatataaaatttggggatcatacccttttacctaaaagtagatatctcttaggtatctatttccttctgggaactaatgttgctgaggaaaagtctcattagaatgttctgtttcatatgccagaaattttaaagtttttatcttttcttgaaattttataatatataataaatttcagtattggtgtttgtccatttttattactatttctttactcatgaaaagcccatttgaactgccaaatcactttttttttttttgttttgagagaatgtacttccattaaattattgagaattttttcctggttatttgttctggtcctatcttcttgcatatcagttgttgatatgtcaaatctctattatctgtattctataactacattttcactaataacttccaattgttaatgtgtgctacttcattcagtataaagttgtcaagtgtattactggtttcattttacttattttgttttttatatttatttttatttaggatttttgaataaaaaattatgcctaaattttttattatatcccagattacattctttaaatccttatttgaatatcatagaagcttatgttgacatttttaaattacaaaggatgaaacttaataaattcatcaagtagttgttgaaaatgtatatttttttccatttctttgatagagtaaactctatgatcattcagagcattataattgctttagcttttctaatgaataaagtcactgtatattactactt

SEQ ID NO: 479829 - DNA, 1550 bp, Homo sapiens
gtcagggcagaagaagggtattttaaagttaatggagaaaaatataaggcaactctcacaggttgcttgatggcagagaaagaattcaaaatgggttgtaaggcagtggagacaaatcgcaacatcaacaacgcatttggcccaggaactgctaatgaacgtacagtggaacaaccgatgatgaccagctcagtggttggactgagaagaagctccaaagcagctcccaaagccaaacttgcaccaaaaaaaatggccatggtcactgtttggtggcctactgccagtctgatccactatagctttctgaatcccagcaagaccattacgtctgagaagtatgctcagcaaattgatgagatacaccaaaaactgcaatggttgcagctgtcattggtcaacagaaagtgttcaattcttctccaggacaattgccaaccacacgtcacacaaccactgcttcaaaagttgaatgaactgtgctgcgaagttttgtttcgtccaccatattcatctgacctcttgccaactgactaccacttcttcaagcatctcaacaactttttgcagggaaaacgcttccacaaccagcaggatgcagacaatgcttccgaagagatccgagctaaatcagaagaaaataacaaggaagaaaaacctgatagtaagaaggtggaggaagacttaaaggcagacaaaccgtcaagtgaggaaagtgatctagaaattgataaagaaggtgcgattgaaccagacactcatgctcctcaagaaatgggagacgaaaatgcggagataatggaggagatgatggataaggcaaacaataaaaaactggctgctatcgaagccctaaatgatggtgaactccagaaagccattgacttattcacagatgccatcaagctgaatcctcacttggcccttttgtatgccaagagggccaaagagcatgagagagcccagagggaggaagaagccagacgacagtcaggagctcagtatggctgttttccaggtggctttcctgggggaatgcctggtaattttcctggaggaatgcctggaatgggagggggcatgcctggaatggccggaatgcctggactcaatgaaattcttagtgatccagaggttcttgcagccatgcaggatccagaagttatggtggccttccaggatgtggctcagaacccagcaaatatgtcaaaataccagagcaacccaaagaaggagactatccccatgaccagtactgccccaggcccacagcaagtactgcttttctaccactgatgttcactcatggtctacggacccttcagttagcttgtagcaaatgctgccaggcctgggtctctcccttcggggcaatgggatcccttctaatcagggtgagtccagaaatgctttctagaagccaaggcctgaaatcaggcagcccagaagcccactttgtgttctattttactacggctgagctagtacctaaactgcaagataaagtctcctttactcttccctctcctttactcaagcagaaggagtct

SEQ ID NO: 479830 - DNA, 693 bp, Homo sapiens
gccactgaattccatttgacagcgctgagttcaatgtctcacaattgctgtgttcttcctcccccagtgcccagaaatatgctccacaccaaactgcagctgcaggaggaatttgttcccacagttatggaggctaataagttccatgttcgctgtctgcaagctgaagaaccaaggaaagctggtggtgtaattcactctgagtccgaaggcctgagaatgggagtatctacgcttatgagtatgcagtttgagagagattttgacaaaccaaagattgtccaaaatggagtgactaaggaggaaaaagtgactctggcttttccctttctagacaaaggcattctatgccaagacattgagttaaagaaggccttttcttgctattctttagtaaagtcttgtgtacattttggttgttggtatcataaaatcttccagaaagtgaaacttggattccacaaagagaaaagaaataatctttagaatcaacaaaggcactgtacaggtcatttagttggcaacttgaaaataagagtatgagtacaaaatgtaattttattcctccattccattaataagaaagcagctcactagttagagttctaacataatttttaaaaaattacttaatgggtatggtgtacattattcagatgatggatatactaaaagccaagacttcactgttat

SEQ ID NO: 479831 - DNA, 1766 bp, Homo sapiens
gctgctaaagttacccggaacgggagtcattatgacccttatggtaccccgagaggaggaatggaaacttttcttaactgagtcgggccaagagataagaccagctctggctaagtggtggccaagagtgtgggcagaagacaaccctccagggttggcagtcaaccaagcccccgtacttatagaagttaagcctagggcccagccggttaggcaaaaacagtacccggtccccagagaagctcttcaaggtatccaggtccatctcaagtgcctaagaacctttggaattatagttccttgtcagtctccatggaacactcccctcctgcctgttcccaagcctgggaccaaggactacaggccggtacaggatttgcgcttggttaatcaggctacagtgactttacacccaacagtacctaactggtacacattgctggggttgctgccagctgaggacagctggttcacctgcttggacctgaaagatgctttctttagcatcagattagcccctgagagccagaagctgtttgcctttcagtgggaagatccggagtcaggtgtcactactcagtacacttggatccggcttcccaaagggttcaagaactcccccaccatcttcggggaggcattggctcaagacctccagaagtttcccaccagagacctaggctgcatgttgctccagtacgttgatgacctttttctgggacaccctacggcagtcaggtgcgccaagggaacagatgctctactccggcacctggaggactgtgggtataaggtgttcaagaaaaaagttcagatctgccgacagcagcatgactgtgtagaagtgttggactcagtttactctagcagacctgacctccgggaccagccttgggcatcagtagactgggtactatacgtggatgggagcagcttcatcaacccacaaggagagagatgtgcagggtatgcggtggtaactctggacactgttgttgaagcccgatcgttgccccagggcacttcagctcagaaaactgaactcattgctttaatttgggccttagaactcagtgaagaggctcgaaaagcagcatctgcccccttccgggcatcagtcacagcccccctgctccctcaagcacctgatcttgtacctacttattctaaagaagaaaatgactttctccaggcagagggaggacaagtgatggaggaaggattgattcggttaccagatgggagagtagctgtgccacagctgctaggagctgcagttgtactggctgtccatgaaaccacccatctaggtcaggaatcacttgaaaagttgttaggctggtatttctacatctcgcatttgtcagcccttgccaaaacggtgacccagcggtgtgttacctgccgacagcataatgcgaggcaaggtctagctgttccacctggcatacaagcttatggagaagccccctttgaagatctggatccaggtggacttcacagagatgccaaagtgtggaggtaacaagtatttactagttcttgtgtgtacctactctgggtgggtggaggcttatccaacacgaactgagaaagctcgtgaagtaactcgtgtgcttctttgagatcttattcctagatttggactgcctttatggatcggctcagataacgggccggcatttgtggctgacttggtacagaagatggcaaaggtattggggatcacatggaaactgcatgctgcctaccggcctcagagttcc

SEQ ID NO: 479832 - DNA, 615 bp, Homo sapiens
tgtgttagtccattttgctgcctcagtaatggtagtctggggaaggtacactcacaacggtccccagtggggaaggcctctgctgcatccacaacagtcgacagggcccatgtcttacaatcctagtgaaggggagcaaacctccagagatccacattcaaattatccggatgccagggttggggcccagtcctgcactcaggtgcaaggaaaatcatacccaggtgatgtcacaggtgggagttggatggataatgcagagaggaaaatgtctgccgactctggtttagcaatggacttaggagcacagtgtgtggtgacttggtggtaccccactgtgatgatgagcaccccactgtgtgatgaacggcagaagtggctgtggggcatgacgagccgcagacaaaactcctcagacaccgagttaaagaaggaaggggtttattcggctgcgggcattggcaagactcctgtctcaagagccgagctccctgagcgagcaattcctgtcccttttaagggctcacaactctaaggggttgtgcgtgagagggtcgtgattgattgagtaagcaggggattttaagccagcaatagtaaataaaagacaaagaa

SEQ ID NO: 479833 - DNA, 612 bp, Homo sapiens
tctggaaagggtagtgtgcgggagtggggatatgcaactctttccaaagatgctgttgagccattccctggtggggttttcttgtgaagaagctatactgcatgatcatagcacagcctccatctggacatatgacatatcatatgttcattatgatgtggaagaatacatacctgaggctgaaggcccaagagcccccaggaggccaccggtgccaagtctcagagtccaaaagccaaagaacctagagtcatatgtccaaggcaggagagaaaaatgtatcccattccaaaagggaatgagaaagcagagaaagagaatcccccttcttctgattgtttttcccaacagggcccacagcctatttgattgtaccttctcacattgggggtgtgtctactcacacaccaatcaaccttggaaacagcctcacaaagacagagacacctgaccatgtgctataaaagaaaaaacccattttctaggggggggtttcaaacatgctgcataaatttgcataagtaacaaggagttgaatgttaatagtcaagacaatggggaagatgtcttcagtacatgtcagaggccttcacagcagcccctcttatcaca

SEQ ID NO: 479834 - DNA, 805 bp, Homo sapiens
agggccaaagtatgcaaaccaattcccggatctctgtgggtgcccaagtggctgctctgctgagactgcacagctctgtcttcggatccaagaccctgatggtgtgggctcacgaggggatctccttacctgcatgttgcaaagatccgtgtgctaagtgtggtttcccaggtggggtcacacaattactcaccacctcctttcgctggggatgggagctcccctggctctgtgccactcccaggtgggccatcgccccgctcagcttttcctcattctccatgggtcaagctgtccaattaatcagtcccaatgcaagagcctggatacttcagttgaaggtgcagaattcacttgctgttttctttcctcttccactgaagctgccctatcagcttttggttgctttaactcagactggcacatcagagttaaactattatcttgcttaagccactgtaattttggggtcgctgatattaatgaatacaacatcttttcctcttatgactttgcttttttaatttttggttttcttatttcaataggcttttgtggaacaggtggtgttttttacatgtatgtatacattgtgaagattttctcccaccctgtgggttttctgttaactctgctgattatttattttgctgtgcagaagcttttaagtttaactaaattattgatctaacattcatttaggcattgcaagtgagttagagattcaactttcctttttttctaagccccaagccggttgtaccaacactacattaaggtttttaacattaaaataaatatcatt

SEQ ID NO: 479835 - DNA, 623 bp, Homo sapiens
tctgtgagggtaacacgatggcacacgtttacctatggctcagaagaagaaagatgttggaaagtttggaacttcctagatactttttgaatggctttgaccaaaatgctgaaagtgatatggacaatgaagtccaggctaatgtggtctcagataaagatgaggaacttgtttggaaatggagcaaaggtgacatttgctatgttttagcagagagactggcggcatttagcccctgccctaaagatctgtggagctttgaacttaagagagataatttagggcatctagcacaagaaatctctaagcaccaaagcattcaagaggtgacttgggtactgttgaaagcatttagctttgtatatttacaaatacatggtttggaattaagaagcagcttccccatctccagtagtggaaacacctgcttgccgactcatgctgccatcaacctttccacctttttctgaggagataaactctgtgcttcctaagatctgtaactagactaaagtcccagtaagccccgaggtgaggttcagagtgtgacccatgaggaggtgcactacacttgaaaagaactgcttgaattttctaatttatatgagaagaaatctggaaaa

SEQ ID NO: 479836 - DNA, 1783 bp, Homo sapiens
accttttcctctccaagccatgcttgaggagcccttctgcccactgctgcattgtgggagcccctctctgggctggccaaggctggagccaactccctctgcttgcggggaggcagtctccagcttgctgtactggccagcagggattccaagccagtgggtttttgtttgtaaagttccatggaaatggggcctgctgagcgaggctgcttggctctctggcttcagcccccttcccacagcaatggatggatctcctgcctcactaaagttcccagagccaaagtatgcaaaaactcctgtgtctcagtgcctgcttgacaggccacccaccctagcagctgtcattagtttgcccagctctgtgcttgggacgcaaggccctgatggaaagtttgactcaaaattagccttattttcctcacagaattgttgagtggctttatattattttaatctttgacgcttaatgatatcagaaataaactgagatctagaaaaaaaaaagatcctctctaacatattcaatttcttaagcacatttacatctttgatcattaatgaactcagcacaaccaagtgaacctggattttgaggggaatatcctatattaatataggaagaactaaacaaataatacaacttaaatatacagagctgttttcttaatgtgactattagatttgatttcaatagaatttatcttatttcaaattattatttattcgacaaaagttacttaatcgtggagtgacagaaaaacattttgaaaccctaatttctacatttttttattttgaaattaacatatgcgacatattctttagaataaagcacaatctattgtatacttatatttgtttttgcactttcgacattttcccatcaattatctcacagaacttggcagagcaccaaattaatcataatctgtgttgtgggctcttgtatctattttgggggcatcctgttttattattttccatgggagattgcattttcttgaattcagaagactattagagatttatattcaacttgatgcttcacagtgactcattgtgtataccatctgaaatgcatggccagagatttaataaataaagaacagaaatgtcaagcttaattctaaatcatcatgtctgacaaacatttagcaaactttgcaagatttttatgcttcattgtgttctacggaaacagatgaatttatgatttagtctcttttgcattttagatgcttctataataaacttggcagacaagtaattactaccttttgacaatggatgtaatgcacagttgagttgcagtataagaataataagtacataaaataaactcaccagctaaatagtgtattactgagtccgatataagtatgcctcctagaagaaaatcttttttggcatgaatattcctaaagagtatggtcaatcacagaaattaaatgagaatactgaatttccagatgtataattgagtaattttctcctcaaattactctgtgcatcttaacaagatgcaattagtatattctcaactcatattttcagataaatgtactgttacattccctaaaagtataagacaattaactatttactagtcaatattaaatgtccttttattaatgacacattttataggaagagagaaattcattcatgcctttaacatactttaaaaattatttttatatagcaacttttattagtttaatataaaagtagaaatataagatataaattatagctgctgcaaaatagttttgaaaattat

SEQ ID NO: 479837 - DNA, 926 bp, Homo sapiens
atccatcaagtgcaaggttatagggatgattacccttatcttgtctcctgctaagtcatggaattttgaagtgtactggggcttggaggctaagtttatttgtggaattaagggcacccggatttcaatgctggcactagctaaatgccttgtggtgaggaagaagtctgctgcagaggcagagccctcatggagaacctctactagggcagtaaagagggaaaatgtggggttggtgtccccacacagagtccccactggggaactgcctagtgaagctgtgagaagaaaacaaccatcctccagatcccagaatggtagctccactgacagcttgcaccaagcacctggaaatgactcaggaattcaacaccagcccatgaaggcagacatggggactgttctccgcagagccacaggtgcagagctgcccaaggccttaggagctaatctctcgcatcagcattccctggatgagcctttcagcctgccgctgggctgtgggggaccctctctggggctggctaaggccggagctggctccctctgcttgcctggacctgtggaggcagaggcgtgggcagaagccggggctgctcgcgcctgcagggacaggtttcgggtgcgcaaggacttggcgggcccctcacatttggcctgccagtgcctgctgggcttcattggggggatgagctccctctgggctgctggagtgccccggctaggtgccacaaagtcccgggcgagtgccattgagagctgaagctgggctggctgggcttctgggtcgggtggggacttggagaacttttctgtctagctaaagggttgtaaacgcaccaatcagcactctgtgtctagctaaaggtttgtaaatgcaccaatcagcactctgtgtctagctaaagggttgtaaaggcaccagt

SEQ ID NO: 479838 - DNA, 1421 bp, Homo sapiens
ttctcataagatctgatggctttataagtgtttgacagttcctccttcacacactcgctttctttctcctgctgccttgtgaaaaagatgcttgcttcctcttccccttcggccatgattgtgaaaaacttaaaagataatattcctggcatcaacttcaagaagtatggaattgctatctctggggttggggccaaggaatctgtacataatcttcagttattctggagaaagtgtgcttcttatgcagcaaatagacatgtaaatgtgcttactgatggccaactttgcttgggattcatcaccaggttctctcatcatctatatatattcttcctggattatcctaactgctctcattgttatcaccaacaaagtaatagctcttcaaacaccagctcatacattctactaagtaatccgaccgcctactttacatcttcaagatctcttgacttaatatgtctaaaacagaaaagattatcttctctaccaaatatgatctgctgctatattaacagatgacctgagtcaagttgtaggagtaggttgtcaccaccattttctgggtttcccagagtattaagtttccataatgtatgaaataattaaaataaaggtgcctctgatttacaaacactagtgtgtgaatggacccatggcaagtaatttctttcagtgtgatttgataccagtaaggtcattagaaacttctcattgagagctatcaaggtttgaattttccccttctgtaacagaacttgtcatcaatgatacttgtcttatcctctgataaagtatattctttagggcaatggtttcaaaaaatatcatgcgtaagaatcatccaagtgcttgtaaaacatatttctggacctcactctcagaggtggttcagtgactctggagtgaggcccaggaatctgaaattttttataactatttcaagtgattatgaaaatatagtcaatgatgatactccataaaatactgctctagagctatctgacgcttatttttcggcaacaccttctctcaggaatatgagctaagcgttagcttttcactgactgcagcagttatagaagaagagttaactaatgttcttgctctcctgagcataagagagaattttatgggtatgctcttggtagttaaatgagcatgttgattaagggtgaagagggtgagaggaggactaatgctacaaatataatattgtgctatggcttaaccttggcagatttttcttttaaagtttttgttgttaaatattacacaacttttagataagattttttttccaatattttcagttttgaatatacttgttttccaagtagcatgatgagtaccttgacggtagcatatagcatgatgggtgctttcagatttatctaattttttataactctgtgaag

SEQ ID NO: 479839 - DNA, 2939 bp, Homo sapiens
tacgtaaacaaaatcaatcaatttgctaagggacgtaattcaaggtacaaagccaggattcacaggtccaggaatcaggggatggaagtggaagtggcactactcaccatcgcccctggtgatccactagcaaaatttttgcttcctgttcccacgacattagaggagcctcacctcatggccactgctacctcaggctcacaaggaatactgccagattaccaccaatgtttccttaaggtccaagggctcttcagtcagcttgtgttgaatgctgctggcctgggactcacccttcagggcagtggctcccctctgccctacaggcacaaaaaagttttcagcactatgctgccagtgccggtggatgtgggaggggtgacatcagcaattcaacactgtttttgctacctcttcagtgcctctttcagcgaagttaaaaccaggtactcatccgacaaattagttcagcctgacgatgggtaagcttatttacgctgtatcaggaccctggaaggacttttagacctttactgtgcataattggatgagactctttcatgctattgaaagaaatactgacagaaggcaaatgtcagtatccttgaagcaaagcaggcgacttatttagcctgggcagcatgatatcaatttgactgtttgccattagaagggtccaaggtacttttcattatactatgctgccagagaggctttaaaaagaagcatgtctggaataccgcctattcctatttaatagatggtgtactcgagatccaaataacatattacttctttacctccagctctagatcacacagaaaggttgacaactaatatatctttttagagttggcgatagataacaatgatattgtgttctttattgtaatagtcatatttaaaatcatgaactgttattttttaaaattaaccaagtaagtcacaatcattgcaaaaaagttgaaattactgttaagtttagcttaaagcttcttccttacatattttaaatttggcctaaaggttcctccatacacagtgaaccgtaacctaactggaagtgtaaacagactataagatactcttgtagcaatcactaagtttcggcaaatcacacagagccaattatttaaacggtattcaaatgaggcaaacactaagctgtaaccaatccagctgtttctgcacctcacttctattttctgtatgttattttctttttctctgtccataaatcctctctaatcatgcagcagtgccagagttgctctgatcctattctggtttgagggtttcctgatttgcaattcattcattgctcaaactctgttaaatttaatttgtctaagatttttcttttaaaggtatatagatacatctgaagtaaaaaaaaaaaaaaaaaaaaatgaaagttctagtctcccagctcatccttgaaggtgaatgaaaattaaaagtttgggatagatcctttcagacttgttgtgcttatataaatacataaacagagaaacatgcactacagtatgtatgattcaattaacatctggtttatgggtaatattttcacttgttaatgtattactggacatttaagtagacttgtcattgttgcttcacaaacaaggctgaaatggacatccttatacatacatccttttgcactcttgaaagaatagagagacgtagaagataattgctgagtcaaagggaatatgtattttaagttaggataaaacttctcaatttacttccatatatgtatatcccactaagagtgtttgagtgtattctttattctacactctccccaaagaggaatataccagttttgtttttcttcttcattcttacagaataaaataatatttcaataaactttcaaatattttatgtaaaatatattgctgctttaattttaagtctaaactcccatctttaaaaagccgtcatttatttaattctaaattcccttgaatctttaacttttcccctgagtatacttaaaaactaataataatatctgattgtctccttaccttcgttttctgctatttgaacattgtatgcctagatgtaggattttggtattttttatgctaggtgttctctgagcttcctgaatctgtggttttgtgtctttcaataattttgaaaaattctcaatcattattactttatacatttcccatattcttttattttttaatcttttggtattcccattatgtgtattttataccttttctcccacttataagtgagaacatgaggtgtttggttttctattcctgcattagcttgctggggataatggcttccagctctattcatgacctgcaaaggacatgatgcatagtatcatgcatcatgatatgattccttttcatggatgcatagtactccatggtgtatatgtaggatattttctttatccagtcaattactgatgggtgtttgggttgattctacatctttgctagtgtgaatagtgctgcaatgaacgtatgcatgcatgtgtctttataatagaatgatttataatcctttggggatatacccagtagtgggattgctgggtcaaatggtatatctggttctaggtctttgaggaattgccacgctatcttccacaatggttgacctaaattacattcccaccaacagtgtaaaagcatatctatttctccacagcctcaccagcatctgttgtttcttgactttttaataatcaccattctgaccggtgtggatggtatctcattgtggttttgatttgcatttctctaatgatcagtgatattgagcatttttcatgtttgttggcctcatgaatgtcttcttttgagaagtgtctgttcatgtcctttgaccactttttaatagggtcatttgttttttcttgtaaatttgtttgtttcttgctgaacaatatc

SEQ ID NO: 479840 - DNA, 880 bp, Homo sapiens
agattgtgtggtaatgagagaccgccaaacaaaacgttccaggggcttaggttttgtgacttattcttgtgttacagaggtagatgcagcaatgtgtgctcgaccacacaaggttgatgggcatgtagtggaaccaaaaagagctgtttctagagaggattctgtaaagcccggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatggtcacgatacagttgataaaattgttgttcagaaataccacactattaataggcataattgtgaagcaaaaaggccgtttctaaacaagaaatgcagtctgctggatcatagagaggtcgtggaggtgggtctggcaattttatgggttgcggaggaagctttggagatggtggaggtaattttggccttggtggaaactttggtggaagaggaggctatggtggtggaggtggtggcagcagaggtagttatgggggaggtgatggtggatataatagatttggaggtgatggtggcaactatggcagtggtcctggttgtagtagtagagggggctatggcggtggtggaccaggatatggaaaccaaggtggtgggtatggtggaggtggtggaggatatgatggttacaatgaaggaggaaattttggcggtgagaccttgatatttccatgatttcattttattctggagataacaactaaaataatttacatattagattcttggcagttcatatttagtagtagtggttagc

SEQ ID NO: 479841 - DNA, 837 bp, Homo sapiens
cagccagatattatggtatggatgtatagcagtacaagatttcagaggatgtatggaaacaactggctgcccaggcagaattttgctgcaggtgtggggccctcatggagaacctctgctagggcagtgcaaaaggaaaatatggggtttgagcccccacacagactctccactgggccagtgcctagtggagctgtgagaattgggccaccatcctccagacctcagaatgatagatccaccaacagcttgcaccatgtacctggaaaagccacagatattcaatgccagcccatgaaagcagccagtagtggtggctggaccctgcaaaaccacaggggcagagatgcccaataccatgggaaaccacctcttgcatcagcaaacatctggggagtcatctgccaatcaccttgggagcctgtaggagactggcttcaaaaatggcccttacctccaacagaaaacaacaacagcaacactggcttcatgagggaaggcattgagagtggacggaggaaagacacagaaactaggttgaaaggggagaaagctgggaaccctgcacagggttaccatgaactaggactcatttctggcccacaatggctccaggggaataggtaaatcaagaatttcttcttggtttggatcccttgctggtgagctagtgtgattttgggggggggggtgttaaagatccttgttttgtcatattaccagaattggttttctggttcattctcatttgtgtagcctctgtcagaaggaaggtctagggctgaaggctgttgttcagattcttttgtcccacaggtgtttccttgatggagtact

SEQ ID NO: 479842 - DNA, 732 bp, Homo sapiens
gaccacattagttccccagcaatgtttcttaaagagatggaaatgactgaaatgacagaaatagcattcagaatattgataggaacaaagatcatcaagattcaggagaacattgaaacccaattcaagaaagctaagaatcacaataaaatgatgcaggagctgacagacaaaatagccaattctccaagatcagatgaaagaaaaaaactgttaaagacagctggagagaaacgccagtcaggcccctcttctgcaggtctgctgcagtttgctgtaggtccactccagaccctatttgcctgggtatcaccagcggaggctgcagaacagcaaagattgctgcctgctccttcctctggaagctttgtcccagaggggcaccggcctgatgccagccggagctctcctcagagctcgagcgctgtcccggtaaaaccctctttgtcaggatcagctgctctcttcagagctggcaggcaggaacatttaagtctgctgaaggtgcatctacagttgccccttccctcaggtgctctgtcccagggagatgggagttatatctataagcccctgactggggctgctgcctttctttcagatatgccctgcccagtgaagaggaatctagagaggcagtctggccacagccactttgcagtgctgtgttgagttctgcccagtccttagcactgtgaggggaaaaccacctactcaagcctcagtaatggc

SEQ ID NO: 479843 - DNA, 1353 bp, Homo sapiens
tctggcaccagacacttctgtgaagtcgagttaggggccatgggccctttgcatttctttgcggacatgaatcttgttatttgtgtcctacttttgtccatttggaaaaataattgcatgactacaaaccaaaccaatggatcttctactacaggagataaacctgttgaatcaatgcagacaaaattgaactaccttagaagaaatctactcattttagttggtattatcatcatggtttttgtctttatctgtttttgttatctccattataattgtctgagcgatgatgcgtccaaagcaggaatggtcaagaaaaaaggcatagcagccaagtcatctaaaacatcattcagtgaagccaagacagcctctcaatgcagtccagaaacacaacccatgctatctactgcagacaagtcatctgattcatcgagtccagaaagggcatccgcacaatccagcacagaaaaattaatcagaccctcaagtctacaaaagccatccataccaaacagtgcaggaaagttaactaggccatcatatccaaaaaggtcatccaagtcatcatgctcaaaaaaattaagcaagtcatctcacctggaaaaggcacataagaaaggcagcctagaaaaattatgtaagctagactatgcgtgtaagctagccagttcagataagccagtcaggccacctcagctattcaagccactttattcatctcatccacaaaatgaaatctcaccatccaagccattcggtccacaggaattggctaagcctcccaaacattttaatccaaaaaggtcagtgagtctaggcagggcagccttattatccaactctgaattagctgaaacttgtcaaccctacaagaaaaaacatcttgttgccaaaacttataggcctttggtcaatgatatttctgaggcaaaggagaaaaacactcaaaacctacatgtttcaagcaaagtcaagtcctcttccaggtcctttcgtaagttagattccaggaacaatgcatacggtgatcatgtgaatgacagtgatacgatgaaatattatagtgaggttgacagtgataaagttataatcattacgtgtgacagagggtacaatcaagtcacctctgaagtaaccctaaatgattaggagctcaacaaaaataaaatccaagtgtgaaagagcaaacttataccaactattttatgctcatcatcccttaagaaaccagtagagggaaaaatcactatcaagatcacccatatctgtcttggaggcgatttattttaaaaatatcaataaaatgcatgacataaattactattgtaattattatttcattttaggggg

SEQ ID NO: 479844 - DNA, 522 bp, Homo sapiens
ggtcgggagtggacctccagccaactccagcagacctgcagcagagggtcctgactgttagaagcaaaactaagatacagaaaggaatagcatcaacatcaacaaaaaggatgtccacacagaagtatcacaactcctcgctagcaagggaaataaactggatggagaacgagtttgacaaactgacagaagtaggcttcagaaagtgggtaataacaaactcgtccaagataaaggagcatgttctaacccaatgcaaagaagctaagaaccttgaaaaaaggttaggcaaattgctaactagaaaaaccagtatagagaagaacataagtgacctaatggagcagaaaaacacagcacaagaacttcgtgaagcatacacaagtatcaatagccaaatcaatcaagtggaagaaaggatatcagaggttgaagatcaacttaatgaaataaaccatgaagacaagattagagaaaaaagaatgaaaagaaacaaacaaagcctccaagaaatataggact

SEQ ID NO: 479845 - DNA, 633 bp, Homo sapiens
ggcgggtcacccccagttcaggccaagatgcaggttacggatggggcccggccaaacccggagcgccacagtagaactgcgtctgatccgtacagcggcatccctgggtgtgaggactgtgaggacggagttttctctcctcaggacccacccaggaggggccatggcttcgagacacctgaggagacctggggccacgtccgcgatgaggacatctctgggacacctggggctgcatctccgggacacctggggctgaccctggttccagcccagaaccagctctccagggcccactcagggaaagtttatgagttgaatgaagaggtgtccaggccacacaggagaggcatcccaattgtggggcgagtcggtggtattagagagcaacttttatttaagcagctgtgcacagtggcagcagaggtactgctccttatggagcagggatgccccataggcagtcagcccagagtagcagctcagaggcagttctgcacacatatttatacccacttgtaactatatacaaattaaggaggaggttatttagaaatttctagaaaaggggtggtaactttcaggtcattgccatggaaaggggcagtaatttccagctgttaccatgagaac

SEQ ID NO: 479846 - DNA, 1445 bp, Homo sapiens
gcggaggatgcattgtcaaaggacacccgaggataactgaaagaagctcgatttaatgagcgcagaggcatgatatgggctgaatgtaaagaaatttggactcaaggccccaaggaatatttgtttgagttgtggaacatgcttgattttggtatgttagcaattttatcagcatcattcattgcaagattcagggcattctggcatgcttccaaagcccagagcatcactgatgcaagtgatactttgaaggacttgacaaaagtaacattgggagataatgtgaaatactacagtttggccaggagggagtgggacccctcggatcctcgtatggtgtctgaaggtctttgtgcagttgctgtggttttgagtttctctgggatagcttgtattttgccagcaaatgaaagctttggacctctgcagacgtcgcttggaggagcagtcaaagacatcttcaggttcatgctcatattcattatggtgtttgtggcctttatgattggaatgttcaacctctactcctactacattgatgtaaaacaaaatgaagccttcacaacagttgaagagagttttaagacactgttctgggctacatttgtgctttctgcagtgaaatcagtggtcatcaactatagccacaaattcattgaaaacattggttatgttctttatggagtctatgatgttacaatggtcattgttttgctaaatatgttaattgcaatgatcaacagttcactccaggaaattgaggatgacgctgatgtggagtggaaatttgcaagggccaaactctggttttcctgctttggggagggggagagcacttcctgttcctttcaatctggtgccgggtccagagtccctgttttatctcttgctgaagcttaaagggtggatttctgagctctatccagggtcataaaaaaggtttccaggaagagatagagctaagtaagtagagctaagtaagtagagctaagtaagtacagctaagtagggaaagacaggaacttgcaggaactaacaggtaccatagggacagacagggacagatagagatagatgaaggctagcaatataaggtcagtgccctaaagaggtactgatcagtgccctaaagaggtacaaaagtaaagactagtaatataaggtcagtgccctaaagaggtactggtctgtgccctaaagaggtacaaaagcaaagactagcaatataaggtcagtgccctaaagaggtactggtcagtgccttaaagaggtacaaaagtagagagtagtgaagactagcagagatttgcagggacagacaggaacattctgaattatggaaattagctatggctcaaagtccaatcaaaatctgagagggcaaatataaaaggaatagagaggaggaggcaaggaaggataaaaatgctctttcttttctctcc

SEQ ID NO: 479847 - DNA, 585 bp, Homo sapiens
tcaggatctgtgttgctcaagctggctggagtccccggcagggatgctccacagggcaggcctaagccacctaaggggctgccttgaccatccattaatcacctcacttcccagtcagggaaccaagaaatgtagcaggacaagccgcagacaaaacccctcagacatcgagttaaagaaggaaacagtttattcggccaggagcatcagcaagacttctgtctcaagagccgagctccccaatgttgaacacaatgatgaaagtgagcatcagtgctgtgttcctgatcttaaagctttgggtgccaacaattcaggtggtgattgttatgggttttgcataaaggtgttttatcatgtgaagaaaattcgaatcttcagcttattggtggtttttatcattaaatacgttgattatctttaagtactttctgtaacagttgagataaacgtgtttttcccatcattttaattatatagtatacggaaaaggaatggctttagtatgttgaaaaacctttgattttctgaaaaaaaaaaaaaaaaaaaaaaaaagacctcttcattgtggtgtataatgttttc

SEQ ID NO: 479848 - DNA, 553 bp, Homo sapiens
agggagcaggggaggcggggagaattcaaaatgggccataaagcagcagagacaactcgtagcattaacaacgcatttggtgcaagaacttctaatgaacgtacagtgcagtggtggttcaagaagttttgcaaaggagacaaaagcctggaacatgaagagcatagtggtcggccattggaagttgacaatgaaaaattgagagcaatcattaaagctgatcctctcacaactacaagagaagttgctgaagaaatcaaagtcgtccattctatgatcatctggcatttgaagcaaattggaaaggtgaaaaagctcaatacatggatgcctaatgagctgagtgaaaatcaaaaaaattgtcgttttgaagtgtcttctcttattttacacaacaacgaaccatttctcaatcagattgtgatgtgcaatgaaaagtggattttatatgacaaccagcgatgaccagctcagtggttggactgagaagaagctccaaagcaatttctaaagccaaacttgcaccaaaaaagtcattgtcactgtttggtgg

SEQ ID NO: 479849 - DNA, 919 bp, Homo sapiens
agcagggatccttgaggtgttgaaacacttcttcatctggattgtggttcattggcgcccatggtacagatggaggcgaatttggagactgtcattaggatttccatctggccagcgccatcttccacccaatcatagtggcggagccgggcgggggaggacgggagccgggccccccgcttgcaccgtagcccgcgggtggaccccgagccgccgccgacccacgcaccgagcccactaggcctccactgccgtcatcgccgccggctcctcaggtactcccggccctagtccccgtcagccggccgcttttttttttttttttttttgagttttttttttttttttttttttgacttacaactgggaaggaccaaggtggccaactagaagcagcaatgatcagaggctcccatcgaaaagatcccaaacagcatggaatcctgcattggaaactaaggtgcaggagggaaccagataaagggggcctgaagttaaccccctggcaaaccacagcagccctacagaagagggacctgactattgaaagaaaaataaacaaacagaaagcaacaacaacagcatcaacaaaagtccccacagaaacttcatccaagggtcaacagtctcaaagattgaaactagacaaactcatgaagatgagaaagaatcagcaaaacaaacaaaatgctgaaaacccaaaaggccagagtgcctcttctcctccaaataattgcaacacctcccagcaaggacaagcaaatgctaaggaaattcatcaccacaaggcctgcttgcaagagctcctgaaggaagcactaaatatggaaaggaaaaaccagtaccagccactgagaaattcaccaaaacataaaaactaatgacactatgaaaaaacagtatcaactagtgtgcaata

SEQ ID NO: 479850 - DNA, 867 bp, Homo sapiens
tccgcggcttcattcttaaagtcaccttcttggctggagcacagccatgttctttacagtaacagagcgcccctgcacagagtccccactggggcactgcctagtggagctgtgggaatggggacatcaccctctagacccaagaatctggcagaaccactggcagtttgcaatcccagcctggaagggacacagacatttaactccaattcatgaaagcagctacagggtcaccctgcaaagccgcagaggcagagctacccaaggcctagggagcccaccccttgcactagtgtgccctggatgcggccatggagtcaaggattattctggagctttaagatttaatgactgccctgcaggggtttcagacttgcatggggcttgttgtccttttcatttggatgatttatcccttttggaatgggaaagtttactcaatgcttgtaccaccattgtatcttggaaataaataacttggttttatgtgaaagaattgacgaggtccctatgaagactgttaaattccacctttgaagtcaatatcagtttccagacacatgtgtgtgtggctgttcaaataatttaatagtaggtattccttggcttcaaagagtgagataactattaatgtttttgctcccaaaatcatgtagtgtattgtctacaagctaggaagatcacacactcaggtttgtatgtaatatttctgatttatgtctttttttccagggtcttgtttagttttacttttttttatacattttcatttttaattaagtattaatagttgcattaaaatagtctacaatggattcattagtcttttttctttttttgagacagagtcttgctcttgcactgtca

SEQ ID NO: 479851 - DNA, 3101 bp, Homo sapiens
cggcttcattcttgaggcactataaacaaaatggtttgggcgtttccttgagtgtttacgggccctcctcagtaaggttacgatgaatgtttttataccacttccttctaaatgcccctggattcatctccagctcggcagccctttgtactgctgcatcgactagcagcaggaagctgctgaagtcggcgtgctcctctggagacacaagttctggagaagacggggatgtgacagaaaccttgacctttttcttcggctgggctattccggtgagcttctggctaggggccgactccggatctggttgcttctctcttgacatctggccctttggcaagggccacaggggcaggctttgtacattgtctggaccactgggccctgacttggccggcacagacgcctcggccttaaaccgatgcttatacatccagtcgcggaggatcttaacggactcggctggcaagtttcccttgcgcttcttcttgtgctctgttcattaaatatttgttagcatttaatattaacatctattagctttctgaaatacctattacaattacattttagaggtatctctagtgatagcaatatatatttttaagtttttacagtctccatagatttcgtattctaccactttgcaaaaaatataagaacattgtgcttggatatgttcattctctatacctctatcttctaattttatagttttcatgtgtattatatcgaaatatgttcaaaactatattaaaatgttataacttttgtttaaatcagttacgtgtctatttaagtaattaagaggaaatatagtctgttagtttcctgacatcttcagaattttctgtgttttctgttcataactaaaagtctgatttacatctggaataattactcttcagccagaaaaactttctgtagcagttattctcaggtatttatagagatgacagattttcttagtatttagtttttattttctgagtatgtcttcacttcacttccattattaaaggatatttttgctagatatagaatcagattttcagttaatggttttatttattgttgagcccattaaaaatctccctccactgcctttccattttcattatttctgaattatagtgataactgattcacatttttcatggccttttaaggtcagttttcaaatgtctgaacatgatttattttctgtttgttgtctcttcttcatgttttctgaatttcttaactctacacatatatgaattttcttaaaatgaagattttggtctttatttcttcagatagtatttctgtcccatgctgtcactcctcattttctgataccttcattttatatattttagactttttcacactttaccagagattattgtagatctactcattttttaaaatattttttctctatttttctgattggataatttatatcaatctatctattttttctttattttcctgattggataatttatatcaatctatctttaagtgaatatttgtgtttaaacttttcttttcctagtttcttaaggtataaaattagacttttgatttgagatttttcttcccttttaatataattgcttatagttctaaattgtcttcttattacttttttttgctgcatctcataccttttggcttgttgtatttaattttcatttctcccatgatttttaaaatatttttaatagttacttcctagatctattggttggtcaagagtgttttttttcagttttcacatatttgtgaattttccattgttcctttcgttcttgatttctggttgtattccactgagttcagatatgatatttgttgaattttagtctttaaaaatttattgaaacttgtttcggggtgtaaaatatgaaatttcctgaagattgttccataatcacttgaagaaaatgtatattcagttgtcaatgtgaggagcattctgtatgtctattatgtcaacttggtctgtagtactatgaactttcctagtctctaccaattttttgtgtgctctttctgttatcgaatgatctactcctgtttatgtctccagctattattgtagaattttctatatatttgttcagttctgtgaatgtttgctttacatactttggagctttgatgtttggtgcatatttgtttataattgttatatattcttggttagttaaacctcctatcaacatataatgttctttttttgtctcataacagtttttttacataaagactattttattctaatattagtatagccactactacacttctttggttattaatttgcatggaatatatttcccatctttttattttccactataatgagtttcttgtacacagaatgtaattggattattttaaaacaattcacccacttatctatgcctttcaattgagggatttagtccatttatattttttaaaaatccttataggtaggggcttatattgcaatctcgttatcattttctatatgcttattaatttttgcattcatcattccctccattacttcttctttctcttgtttagttgagtttttgttatagcatgttttaattctcttcttatttctttttgtgtatatttcatagatattttccttgtggttattatagggattgaatataataccttaaagtcacaacaatctattttaaattgatatcaattaaactttatttgcatatatagactctactttatctctctgccctactgctatgtattattaatatcacaaagtacatctttatatattgtgcattcattaagatagacatacatttttatgcattttgtttttttaaattctgaagaaaaatttatattacaataatcttggttttcatactgttgatgtatttaacgtcactaaatatagttatattttcatctggcttcacattaacatgtagtatgctttcattttggcttgaagaactctttctagcatttcttgtagggcatgtcaggtgtattttgattgataaggtatggactaacaattctgaaactagtataaatgcgtgctagaataaacaagtaaatgaatgtcagatgatgat

SEQ ID NO: 479852 - DNA, 633 bp, Homo sapiens
cccttgagtaaacacagttttatatgtggctgtgcagttcgaagtgcaggccactaggtggtgtttatgggttgtggggttacactttcaggagaaatgctcaggtgaaggcagggcagcagtgctgtgggcctttaactgcagaaaccaggtcccctcagctggagcaacagagactggcagctgtggggtgtgtggcacacttgcacttccctcctacaaaagtagctctgggttttattaatactcttgggggcatgcacatgtgctgggcctccttgctctctctctggccctggagtggcaaggacttagccagtagcagtggcagctgcaaggggcttgtcagcgacctctgggagtgtgctctcagaggaacacagagccacagctgcagtgttcagatgaaggtggggcaggtgcactggaggcctaaagatgacaaggcccatttagcaggaagcagtgaagacttggcatagggggaagctgaatatcattccttcttattgtgtttcttacaagacaatgaatgggatctctgaaattattaccttttaaaaaggctatgattagttaaatgtacaaggttacttaacgccgaatgatacaagtttaaatgttaattataat

SEQ ID NO: 479853 - DNA, 499 bp, Homo sapiens
ctgcaactcctctacataactgaagcggggattctctccccatgccctccatccccacatgcccacagggagtactgccaggtgaccagcaatataccctcaaggtccaagggctttttagtcagctagtagtgaatgctgccaggcccgggattcacccttcagggaagttggctctactctggcccaagaaaggtccacaaataacatccaagagccaaagcctagaattggggtcccaaaaagtccactatgtgctctacctcaccgtggctgagctggtacctgaggtgcaagagaaagactccttttctttctgcttctcaagagcagaaggagtctgtcctcatagccaccacatctgtaaatgttctgggtcacaccttaagctagcaggtctcagagtcccacccaaagctcatgccaggtactactggactactgcgattgtttattcaggacccaagagccctttagtcagaagatgatgtatactatt

SEQ ID NO: 479854 - DNA, 1280 bp, Homo sapiens
atttatttgaggcacagtattttctgcagtaggggcagggagaaagatgtttccctcaccagatccattcaagggacttgggggaccctcctccaatcactggcgcttatacgattatatccttggcaaacagcgacagtttgaattcttctttactgatttagatggcctttatttctttctcttctctgctctggctaggaattccagttctatgttgactagaagtggtgaaagtggacatctttgtcttctttcagttttcagggtgttaccagggggtcattgctcccagagttcccaagatggtggtgggccgcttccaaaatggtggcgggccacttctaatatggtggcaagcctcgtgttctctgacctggggttcttggcctcagggattccaaggaatggaatcttgggccatgcggtgagtgttatagctctattagaagccctgggtcatggaagagaactgtggaacccagtgactaatgttcagcttgattaggatgaacccaggcacttagccgtgcaggaacaatggcaagcctttagcccagtcgggaacagcaatgggtgcctcactggatcaggagcacagtggacaccctgcgggatccggagggatggaagtcagcggctggtctgtgacggcggcaaacagcagtgacggacagcgagccaaagctcagctcgagtcataacaaacatggaccagaagagtgcagttgcaaaagagtgaaatagagtgaaaacagagatcccatacaaagggaggggacccaaagagggtagccattgcaggctcgaatgcctgggtttatatcccaatcatcgtccctcccactgtgctctcaggcattagatgattggctatttctttacctcctatttttacctaattagcattttagtgagctctctgattgatcaggtgtgagctacattgcaagccccgtgtttaaaggtggaagcagtcaccttcccagctaggcttagggattcttcgtcggcctaggaaatccagctagtcctgtctctcaagggggaatactttcaacttttctgtattcaatataatgtcggctgtgggtttgtcatagatggcttttacttccttgagaaaatactactcaagtgagaaaaagtctaacttgaataaaaaaaaaaacagtcaacccctttaattaatccccagacttgatccaattcacagactcagaaccccttgaataaaagggagactgtgacttctccaggaaggactcgcgtacactgtc

SEQ ID NO: 479855 - DNA, 591 bp, Homo sapiens
gcctgctctgtctttgccttccaccatgattggaagctttctgaggcctcgccagaagcagatattgctatgccagcagtggccatggcagtgtgtgtggacactgtccttaggaaacttgctagtgtgcagtcacctagatgcttatggggttggggttgctcttagcagcctcaggcaggcaaatctcaggctctggagaccacatgctttggcttcctttgtcgtagggacagtctccccagggcactgtactgcctttttcccagggtgcaggactctgtgtgggctagagtgctggggacccttctgcactgtagggtccagccagaattgtgcctctgcagtcctccaggtgtatgtgggggaatgtctgtggggctctgaagatgtggagatgctggttctgctgggcctgaaggcaaactataatcaggtgtttactgtcacatctctgctgaattttagtgctctttcttagatgctctatttaaattaggactatcttttcacaatttttgttatttgtggaggaggtacctggctcatctgattgggactggttaaaagtgggtgcagcccatggaggac

SEQ ID NO: 479856 - DNA, 578 bp, Homo sapiens
tttaggtacatgggctttgaagttattggaatcagattatgtcgaggaaactttgtgttctgtcaaaattgttacaaagttcagttggaggtttccttctccctgtggtctttccccaattccactggcggccttacccaaggatccttctctctaagttcatctcagctccaggtaaagtcaaatccttctcccatgatgtggacattaaggttccccagtgaggatgtttgtttaggggcagacgatccacctttcacattttcacgctttgggcactcagagtttttcggccatttcctggagcctgaagtagcaattcacttctttcaaagggtctgtggattcctttggctttcctggtatggtcctgctgtggttcttcaagcaaaagttttggatatgggtctccacacgccgctctgtccatgtctataaaatatggtatttaaaactatttgtaataaaatgttttgaaaattagaaacttctctttaacatgtatggatatttacttgaattatcatttcctaaaatcaagagctctctgcctacctgtaaatctgttcaacatcatt

SEQ ID NO: 479857 - DNA, 1465 bp, Homo sapiens
ctgcagtgtgcagcctcaggatttggtgctgtgtctcatctgctgcagcatggctaaaaggtgccaaggtacaactcaggccattgcatcaggggatgcaagcctcaagccttggcagcttcctttggtgttgagcctgcatgtgcaaagatgtcaagaattgaggtgcatacacattgaggattatcatgtcttcttggaagattgctctgtttatgtaatgcctcacattatcgctgataattttccatgcactgaagcctgctttgttattataactactccatatttcctggttttgttgacaaaaagagtcaaactctataaaatatttgaagatatttattttgagccaaatgtgagtgaccaatggcttatgccacagccttcaggagactgtaagaacatgtgcccaaggtggccaggctacagcttggttttatacgtgttggagagacaaaagacatcaatcaatgcatattagatagaaaagatacatcttttagtggctcccttttcaatagaaaattataaatcaactttctaatctgtgctgtggtaattgctgaatttaagtatttttaaagttaactttattgatatttttctaggaaatcattcttttgttaaaggtgtccaaatttattttcatagatgtgcatatatcaaattcttaaaaatgttaaattactagttatgattcttgccttttctcatttatataatcagctattttagcttttttcctcataaataatttatccattttactaaacgataaaaaagagaaaattatttccacatacacatccaattcattatatttatttatttatttactgtttaattaacttaatgttatctgttatgttaactaattcctttttctttcttttggttaattttgtcatttttttcctaatttctcgagagtagcaaactcttatttttttggtttcttcttgtaattaaaataaagttttaattttttctttgagaattatatttcataactttggatataaggtgtttttatcaattcatgctacatatatttttatatttcacttttgatattctcttttattgaaattttataaggatgtttcagatatccacacagttaatgctttttgtttacactttttattattgctattttattattgttttctgattgtgttggattattatcatatattgtaaggattttataattttcagttatatattatatatatattactttcaaatatacatatatgtatattttcaaatatacataaattatttattgccaagcatatgattgatattttcaccaaatattgcatggatagagaaaaacataaatatatctaaattaaggttgtagttgtgttttacatttattttctatgatgtttggggtacaccagacatgtgaaggtgttagaaaaaatatgtccccactagtttacatagc

SEQ ID NO: 479858 - DNA, 512 bp, Homo sapiens
ctttagggatagctatgcagggtgtccatggctgggtatgggaaagaatgcccataagcctgagagacccggtacaccccttcaaacctggggactctgtttgggtcatgaaatggaatccaaccactctagggcccatatgggttgggctccatactgtaatcttgtccactccctctattgttaaagttgcaggaattgtgccttggatccatcacagttggttaaaaccagaaatccaggacaagtggaccagccagcagaacccagaccatccaagccggctgatcctgcgacgggagccagttgccactgaggacaacagccctgctctgggcactccctttacctgtgtctggggatgggcccatagaaaggtgcccccactgcactcacaccacgtagtcggagagcacagtaactagaaccctgttatatcacacttactatgaatgtacagggacccaccaaggtacctgtattcacaatcagatgacctactcagtctgtga

SEQ ID NO: 479859 - DNA, 639 bp, Homo sapiens
ttgccaatttttgtactgaaatgttaggcccctttttgcttactgatttatacatattccttgtggaggaacagtactatatgttggatgctgattcaaagcacatacggcaatctggaaaaccctgccccactcctataaggtattttcacctacctggtgctgtaacagagtcttcaaaaggcaattccgcattctatcaaggcagctgctttaggatagtgtggaacatggtaagaccagtgaattccataagtatctgcccattgccacacttttttagccgtgaagtgatttccttgtttaaaagcaacgcagtgtataatactatgacggtggataaggcatactgtaagtccatggatgatagttttaacagaagcatttcatgcaggaaaggaggagccagatgcaacaatttatccttcatcttggatgaattattacatgtcccacatcacttgttccctagaaatttcactgaggtagaagatcctttaatttagttatatttatttcccaccctctcatgggcaaatgtcttaccatgggctagaactggtagtgtaactggaaaggggtcccaatccagacctcaagagaggtctcttggatttcacagaagaaagaatttgaggc

SEQ ID NO: 479860 - DNA, 7203 bp, Homo sapiens
gctgtgggcatgtttaagaaagcccactgtgtacaacgacctggccccaattttaaagctggtggagaaagttttcaaaacggatctttccacagtattaatgcatctccccacaaaacacctgtttattacaaaagcaaacaagtaactttgcagtggagaaaactggcagatatcacctcaatcaaacaatataattacctggaaattaaaaacaacgtgctcatgaacgacttttgggtaagcaataaaattaaggaagaaatcaagaagttctttgacactaatgagaacaaagaatgggagaacatatttgcaaactatgcatccaacaaaggcctaatatccaaaatctataagaaacttaaacaaatttacaagcaaaaaacaaacaaccctattaaaactggggcaaaggacaggaacagataattttcaaaagaagacgtgttgtaaaataccgacgtatatattatatttataggggttgtaaaataccgacatatatattatatttataggggtcgtaaaataccgatgtatatattatatttataggggtcgtaaaatactgaagtatatattatatttataggtatcgtaaaacaccgatgtatatattatatttataggtatcgtaaaataccgacgtatatattataggtatcgtaaaataccgacgtatatattatatttataggtgtcgtaaaataccgacgtatatgttatattcatcagtgtcgtaaaataccaacgtatatgttatattcgtaggtgtcataaaatactgatgtatatgttatattcgtaggtgccgtaaaataccgacatatatgttatattcgtcggtgtcataaaataccgacgtatatcttatattcgtcagtgtcgtgaaataccgacgtatatcttttattcgtcagtgtagtgaaacaccgacgtatattttttatttgctggtgtcgtaaaatactgacgtatatcttacattagcaggtgtcgtaaaataccgacgtataacttataatcgcaggtgtcataaaatactgatgtaaatcttatattcgcttgtatcataaaatactgacttatatattatgtttataggtatcgtaaaataccgacgtatatattatatttataggtatcgtaaaataccgccgtatatattataggtatcgtaaaataccgacgtacatcggtgtcatgaaataccgaagtatatcttatattcgtacgtgttgtgaaataccgacgtatatctcatattagtcggtgtcgtgaaataccgacgtatatcttttattcgttggtgtagtgaaacaccgacatatattttttatttgccggtgtcataaaataccgacgtatatcttacattcacaggtgtcataaaataccgacgtataactattcgcaggtgtcataaaataccgacgtaaatcttatattcgcttgtgtcataaaataccgaaatatatgttatattcacaggtgccataaaataccgatgtatatgttatattcgtcgttgtcatgaaacaccgacgtataccttatattagtcggtgtcgtgaaataccaacgtatatattatatttgtaggtgttgtaaaataacgtcatatatattatatttgtaggtgtcgtaaaataccgacgtatatagtataggtgtcgtgaaataccgacgtacatattatattcctggtgtcgcaaaataacgacatatatattacatttgtaggtgtcgtaaaataccgacgtatatagtataggtgtcgtgaaataccaacgtatatcttatattcgtaggtgtcgtgaaattccgtcgtatatgttatattcgtcggtgtcgtaaaataccgaagtatatgttatattcgtcgctgtcgtaaaataaggacatatatgttacattcgtcggtgtcataaaataccgacgtatatgtcacattcgtcgttgtcgtgaaataccgacgtataccttatattagtcagtgtcgtgaaataccgacgtatatattaaatttgtaggtgtcataaaataacgtcatatatattatatttgtaggtgtcgtaaaataccgacgtatataatataggtgtcgtgaaataccgacgtatgtattatattcgtaggtgtcatgaaattccgtcgtatatgttatattcgtcggtgtcgtaaaataccgacgtatatgttatattcgtcggtgtcgtaaaataccgatatatatcttagattcgtcggtgtcataaaataaggacgtatatgttacattcgtcagtgtcataaaataacgacgtatatgttacattcgtcgttgtcatgaaataccgacgtataccttatattagtcggtgtcgtgaaataccggcgtatatattatattcataggtgtcgtaaaataacgacatatatattatatttgtaggtgtcgtaaaatactggcgtatatattatagtcttccgtgtcgtaaaataccgacgtatttgttataatcgtcggcgtcgtaaaataccgacgtatatgttatgttcatcggtgtcataaaatagcaacatatatattacatttgtaggtgtcgtaaaataccgacatatatagcataggtgtcgtgaaataccgacgtatatattatattcgtaggtgtcgtgaaataccgacgtatatattatattcataggtgtcgtaaaataacgacatatatattatatttgtaggtgtcgtaaaatacagacgtatagagtataggtgtcgtgaaataccgacgtatatattatatttgtaggtgtcgtgaaataccaacgtatatcttatattcgtaggtgtcgtgaaattccgtcgtatatgttatattcgtcggtgtcgtaaaataccgacgtatatgttatattcgtcggtgtcgtaaaataaggacgtatatgttacattcgttgctgtcataaaataccgacgtatatgttacattcgtcgttgtcgtgaaataccgacgtataccttatattagtcggtgtcgtgaaataccgacgtatatattatattcgtaggtgtcataaaataacgtcatatatattatatttgtaggtgtcgtaaaataccgacgtatatagtataggtgtcgtgaaataccgacgtatatattatattcctggtgtcgtaaaataacgacatatataatatatttctacgtgtcgtaaaataccgacgtatatagtataggtgtcatgaaataccgaaatatgtattatattcgtaggtgtgaaattccctcgtatatgttgtattcgtcggtgtcgtaaaataccgacgtatatgttttattcgtcggtgtcgtaaaataccaacagatatcttagattcgtcggtgtcataaaataaggacgtatatgttacattcgtcggtgtcgtaaaataccgacgtatatgttacattcgtcgttgtcgtgaaataccgacgtataccttatattagtcggtgtcgtgaaataccggcgtatatattatattcgtaggtgtcgtaaaataacgacatatatattatatttgtaggtgtcgtaaaataccgacgtatatagtataggtgtcgtgaaataccgacgcatatattatattcgtaggtgtcgtgaaataccaacgtatatcttatattcataggtgtcgtgaaattccgtcgtatatgttatattcgtaggtgccgtaaaataccgacgtatctgttatattcttccgtgtcgtaaaataccgacgtatctgttataatcgccggtgtcgtaaaataccgacgtatatattatagtcttccgtgtcgtaaaataacgacatatatattatatttgtaggtgtcgtaaaataccgacatatatagcataggtgtcgtgaaataccgacgtgtatattatattcgtaggtgtcgtgaaataccgacgtatatataatattcgtaggtgtcataaaataacgacatatatattatatttgtaggtgtcgtaaaataccgacgtatatagtatacgtgtcatgaaataccgacgtatatattatattcgtaggtgtcgtgaaataccaacatatatcttgtattcgtagctgtcgtgaaattccgtcgtatatgttatattcgtcggtggcttaaaataccgacgtatatgttgtattcgtcggtatcgtaaaataaggacgtatatgttacattcgtcggtgtcgtaaaataccgacgtatacgttacattcgtcgttgtcgtaaaatacctacgtataccttatatcagtcggtgtcgtgaaataccgatgtatatattatattcgtaggtgtcgtaaaataacgtcatatatattatatttgtaggtgacgtaaaataccgaagtatatagtataggtgtcgtgaaataccgaagtatatattatattcctggtgtcgtaaaataacgacatatatattatatttgtaggtgtcgtaaaataccgacgtatatagtataggtgtcgtgaaataccgacgtatgtattatattcacaggtgtcgtgaaattccgtcgtatatcttatattcactcttgtcgtaaaatactgacgtatatcttactttcgcaggtgtcataaaatacaggtgtataacttataatcgcaggtgtcgtaaaatacagacataaatcttatattcgcttgtgtcataaaataccgaaatatatgttatattcaccggtgtcataaaataccgacgtatatgttatattcgtcggtgtcgtaaaataccaacgtatatgtaatattcgtaggtgccgtaaaatactgacctatctgttatattcttcggtgtcgtaaaataccgacgtatctgttataatcgtcagtgtcgtaaaataccgacgtatatattatagtcttccgtgtcgtaaaatactgacgtatttgttataatcgtcggcgtcgtaaaataccgacatatatgttatattcgtcggtgtcgtaaaataacgacatatatattatatttgtaggtgtcgtaaaataccgacgtatatagcataggtgtcgtgaaataccaacgtatatattatattcgtaggtgtcgtgaaattccgtcgtatatgttatattcgtcggtgttgtaaaataacgacatatatatttgtaggtgtcgtaaaataccgacgtatatgttatattcgttggtgtcgtaaaataaggacgtatatgttacattcgttggtgtcataaaataccgacgtatatgttacattcgtcgttgtcgtgaaataccgacgtataccttatattagttggtgtcgtgaaataccgacgtatatattatatttgtaggtgtcgtaaaataacgtcatatatattatatttgtaggtgtcggaaaataccgacgtatatagtataggtgtcgtgaaataccgacgtatatattatattcctggtgtcgcaaaataacgacatatatattatatttgtaggtgtcgtaaaataccgacgtatttagtataggtgtcgtgaaataccgacgtatgtattatattcgtaggtgtcatgaaattccgtcgtatatgttatattcgtcggtgtcgtaaaataccgacgtatatgttatattcatcagtgtcgtaaaataccgacagatatcttagattcgtcggtgtcataaaataaggatgtatatgttacattcgtcagtgtcgtaaaataccgacgtataccttatattagtcggtgtcgtgaaataccggcgtatatattatattcgtaggtgtcgtaaaataacgacatatatattatatttgtaggtgtcgtaaaataccgacgtatatagtataggtgtcgtgaaataccgacgtatatattatattcgtaggtgtcgtgaaataccaacatatatcttatattcatagatgtcgtgaaattccgtcgtatatgttatattcgtcggtgtcgtaaaataccgacgtatatgttatattcgtcggtgtcgtaaaataccgacggatatgttatattcgtcgctgtcgtaaaataccgacgtatatcttagattcgacggtgtcgtaaaataccgaagtatatcttatattcgatgatgtcgtaaaataccgacgtatatcttatattcacaggtgttgtaaaatactgacatatatcgtactttcgcaggtgtcataaaataccgatgtatatgttacattcgttggtgtcgtaaaataccgacatatacgtcatattcgttactgttgtaaaataccaacatatatgttatattcgtcggtgtcgtaaaataccaacttatatcttttattcgtcggtgttgtgaaatactgacctatatcttttattcgtcagtgtcgtgaaataccaacgtatatcttatattcgtaggtttcgtgaaactccgacgtatatattatattcgtatgtgtcgtgaaataccgacgtatatcttatattcttaggtgtcatcaaatgccgacatatatattattatcttagattcgtcggtgtcgtaaaataccgacgtatatgttatatttataggtgtcataaaataccgacgtatatcttatattcataggtgtcatcaaatgccgacatatatattatattcgtaggtgtcataaaataacgacgtatatattatgtttgttggtgttgtaaagtaccgacgtatatattataggtgtcgtaaaatactgacctacatattttatttataggtgttgtaaaataccaatgtatatattataggtgtcgtaaaataccgacgtatatattatatttataggtgtcataaaataccgacgtatatattatatttataggtgttgtaaaataccgacatatttattataggtatcgtaaaatactgacgtatatattatatttataggtatcgtaaaataccgacatttatatttataggtatcgtaaaataccgacatacatattacaggtgtcgtaaaataccgacgtatagattatatttgtaggtgttgtaaaacaccgacgtgtatattatatttataggtgtcgtaaaataacgacgtatatattatatttataggtgtcgttaaataccgacgtatatattatatttatatttatcgttaaataccgacatatatattatatttatatatatcattaaatatatatttatataatatatttaataaatgtttattgaatttcatggaaatttta

SEQ ID NO: 479861 - DNA, 509 bp, Homo sapiens
ggcattgataactgttcgacttgcctgctttacaacttggtagactatgtcagaggaaagatctggggcccaaaggctgctgctccaggctgtgcttttcccctgctggagccagggaggctggaccacttggtcaaaagacctgtcccccacagcccaacacactgactgtggcagactgaaaccacagtgcctcttcaggcttgactctgactcatccttcctcattgggaactccaataactctagccagaggctcagagagagaacctggatctccctgggcctgaggctccaggggaggggtggccacagtctctgccgaccagcagacatagccttttctcctggtagttctgaggaatccaggcagcccagactagtgggtttttccccagtgaagcacaccccctccaccaagggacagacaaagtgcttcattaaatgggtcctgttccccgtgccacccaactgggtgggaccctccaacagggattgttagacatcct

SEQ ID NO: 479862 - DNA, 679 bp, Homo sapiens
aggagtgaaggtttaggagatgccatggggtgcaaactcaacctcaaaattttccaaactcttactaagccccccacctgggatggagggcaatggaagaacatgggccttcccccaccaatgcatgccattgctgagactagctcagttgtggagaccctaacccgtggtgctagaggaattaaagacacatacacacagaaatatagtgtgtggagtgggaaatcaggggactcgcagccttcagagctcagagcatcgaacagagatttacacacatatttattgacagcaagccagaaacccacaaccttcatcgtgggcgtcatggccatcacgaacatgtcacagtgctgcagagattttatttatggccagcttaggggccaatttaaggccagatgttggggcctatccccagcatcccatacaccacctgggcacagagcagcacagtaaaattttaatgcaagtgtttatttctaatatcatgtttccacaatgatttcagtgtctcttcaatcatggttaacctctgatatgcacagattcttcacagatctgctgtgggtggtggaaagaaatggctagtgtttaacaaagtaaataaattgctagatttaaaacaattgctagatgtttaatctttgaaattttaatgtcaataatgtttaattta

SEQ ID NO: 479863 - DNA, 668 bp, Homo sapiens
tgccggcagatgtggtgtctggtgaaagtctactttctggttcttcgatggctgtcttctcactgtgtcttcacatggcaaaaggggtatgaccagtctggggatgtgataggggccagcagaccaaggagtgctcaggtcgaaccagcctcatctgatgtgcaaaattgtcctgcagagatcaggtctgacagttcccctagggctaaagtgtctcatgggagcaagtcaagcctagaggattgccatccctggccacactttgctaccgatgcttccacaccaaatcctctgggattcacatcagctgccttgctgccaaggccatttttcttgtctcttaggaagtacaccccagagagatgcaagtcagcaatagttcagtgctatcagcccaggatggtgggtctgtgctgtgggtccaagtcaggggttttctgtttggtgatgagcagtggagggtgtgtgggagccatgggagatagactggcctctccttgggttgactccagcttgttggagttgtggacaagggatatatagctataaaattcccacttagtaccacttttgctgtatcccacagcttttgatgatttcttattgcacattaacagttttttctttctgattgaattactcccttcagcatttcttgtaggctaggt

SEQ ID NO: 479864 - DNA, 684 bp, Homo sapiens
tatctcagtatgtcgtgtgaccccccccctcccccgacccctggtccactgtctctgggcctaattcaacaccaggactcacctaagagtttactgcctgctcttctggaggggctgaggtgttcccattccgctggcaacagcactctgatgggatgttccggccaaagtacttccgtggggcagcggcagcgtctgccagtgaaagagctatggtggtggctgctggcaaatgcctcatctgggaagctgaggctgcgctgcaagcggatgtggccaggcagggacgctgggataggccagcagacagcgggacactcagatcagactgaccctatcccatggccaagattgccctgctgcgtccaggtccagcagccagcaaacactaaagccacagagaggagtgtgctctcccggcaattctccctgcaatctcaaatgtctgtgggggtcatggggtctcctgcagcttggattccagaggtccatggcgagaatgagccactctatgcttgttttactcgccccttccccaggagtcactcaggccccaaaatgagtcctggtcctcagcaacctgatgcagggttcccagcttcctcccctttcagctcaggtcccctaagtccatcatgtcattcctatgcctttgcaccctcataggttagctcccacttataa

SEQ ID NO: 479865 - DNA, 743 bp, Homo sapiens
ctcgctgttgagggaaccactactctcttcaaagctgtccaacagggatgtttaagtctgccgaagtttctgctgccttttgttcagctatgccctgcccccagatgtggagtcttcataggcaggcaggcctccttcaactgcggtgggctccacccagttcaagcttcctggccgctttgtttacctactcaagcctcagcaatagtggacgccctcccccagcctcacttcctccttgcagtttgatctcagactgctgtgccagcagtgagcaaggctccttgggtgtgggactctccgagccaggcacaggatataatgtcctggaaagggaattccccgaccctttgcacttcccgggtgaggccatgccccgcccccgccgcccgcttcagctcacactccgtgggctgcacccactgtccaacaagccccagtgtgatgaacctggtacttcagttggaaatgcagaaatcagaaatcacccgtcttctgcatcactcacgctgggagctgtagactgcatctcttcctattcggtcatcttggaacctcctccctcaggaatttctttatagcagtgtgaaaacagactaatacaggcgagtagtttgagtaggactggcattagttcttctttaaatgtttggtagaatttagcagtgaggtcataaggtctcgggctttgctttactatagacggagactatttattaaggctttactgtgttacctgttat

SEQ ID NO: 479866 - DNA, 1041 bp, Homo sapiens
tcctattcagttcctagcacatattaaaaaacaaaccaggggctgagtcaacgaaggccaaaggcacctagagaagcatgatgagatgtggggaattgatgtcccttgctgtgttccactgcagctattcctgcgccaaggccttctgggctctgcacaagctgcagtcctgtctctgccatcaatccaagcatctctccctttcagctcaaatatccatgggggttgtgagatctcctgcagctgggattccagaggtccatggtgagaatgaatcactcctcgcctgtttaactcatccctccttgggagccactagggcccaggaacaagtcctggggcttggcagccctgtgcaaagttgccattttcctctcccttcattccagaatctgtgtcctccctctatcctttctcaataccttcctaccttcctcagaatattttctcagagtgtgccaatcttcttgatggtctggtctctaggtgggagattctctttctggctgcatctagtgggtcatcttggcttccgcttccccaactttcacacacattctgttttttagtttttgctatgaacatggcatttataatgattgtaagtatttttaaaatacttaagcacattactctcaaaagaacaattgaataataattccttgattaatatcaaatgtcagctcacaggaaaaatctcagtctttttagtaattccaggtcttgcatcctgaagcagtaatttataagttcatttgcctaggtcaagttacctaatctcccatttctgataatatatataacagggatgattattggtactggatagagttgttaggattgaattagcattaaatataaaatatccttatatagtagttgtgtacatgttaatagcctatgattcaggttctcttttcaaagggccacagctcgtactgcttcctgagtccagttcgacatctcaggaatcagctagtctttgtaaaagcttcacctctgcttcttggcccatggaccagtatgctgtcagtgttttta

SEQ ID NO: 479867 - DNA, 691 bp, Homo sapiens
tttgcatgtatctgctgattagtgacactgagcagtttctaatatgtttgttggctgctttctgatgtgcttcccttttatacgttacctggtctttctctctggttgctctgaacatttttttcttcattatgactttgagaatctgaagattttgtgtcttaaggttgatcttcttgtggagcaacttactggggttctctggatttctcagacccttttccatagggctgctgcagcttgctggggatccactccagaccctatctccctgagcccctcccacccctggaaggatcaccagtggaggctgcagaccagcaaaaatggcagaattatacttcttctggcaggtctgtcccagaggggcactgacctgttgctggctggaacagtcctgtatgaggtaaccatcaggcagaaaagactaagaccgctgatctacaatactgcagctgcccctcttcctaggggctcttctcaggaagatcagagttctgtccacaaacccctggctggggatactgaaatttccgcagggaagccccatctgagactccagtgtgaccacatggtggaagaagatttatgaacagaaaaagaaagggaatgtacagaaaatggaagttacagtgtgtcattcatttccagaagttgtgattgttttttacttatgctatttctgtgcaga

SEQ ID NO: 479868 - DNA, 616 bp, Homo sapiens
ccagcacgctgtcacctctcattatgaagcttagtttggctggatatgaaatcttggttacaagaacctttttatcaaggttcttaccttccttgaattgtgttaaaacatgctactttagctcagaggagtttgttattacccaccttctgaagcctacttctgtcaattcatcaaactcattctccatccagttttgtgtccttgctggagaggagttgcaatcatttgaaggagaagaggcattctggcccctattctgctggagtttgctggaggtccactccagaccctgtttgcttggctatcaccagcaggggctgcagaacagcaaagattactgcctcctctttcttctagaagcttcctcccagagaagcgcctgcccaatgccagccagagctcttctgtatgaggtgtctgtcaactcttgctgggagatgtcttccagtcaggaggcacaggggtcagggatccacttgaggagggagtatgtcccttagcagaggtcatgcgttgcactgagagatccactgttctcctcagagcccgcaggcaggaatgtttaagtctgctgaagctgtgcccacagccgcaccttcccctagttactctg

SEQ ID NO: 479869 - DNA, 552 bp, Homo sapiens
gtgaacatcacagaatctggcagcactatgttcaccaacaccctgctccacctgatgagtgtggaccccactgtgtttctactgctggcatgtgtgaaagatcacagccagcatctgatgaagcactttggctggcagcacccattagagtgttgtggccagcagttggagaccaccatggccactccccaagaacagcaggtttctaatttcaaggggccagagaacaaaatgctactgaagctcgtgcatgtgtcacgtagttctcgtgccatggttttcagctccatcaagtcattgaaagtcttctctatgctgtttattctagtcagtcattcatctaatcttttttcaaggtttttagcttctttgcaatgggttcgaacatcctcctttagctcagagaagtttgttattaccgatcgtctgaagccttcttctctcaactcatcaaagtccttctccatccagctttgttccattactggcgaggagctgcactacttttgaggagaagaggcactctggtttttagaattttcagctgttctg

SEQ ID NO: 479870 - DNA, 1211 bp, Homo sapiens
cgagcagtgagaagaggaccaccatcctccagaccgcagaatggtagagtcactgacagcttgcaccatgcccctggaaaatatgcaggactcaacacttcccatgaaagcagccacaggggctgtaccttgcaaatccacagggctggagctgcccaatgcccttgggtacctggagggctcagaagacaggaaggtgtgggaaagtttgaaacttcctagagacttgttgaatggctttgaccaaaatgctaatagtgatatggacaataaaatcctggctgaagtggtctcagatggagaagaggaacttaactttgaacttgacagagataatttagggtatctggcagaagaaatctctaagcagcaaagcgttcaagaggaagcagagcataaaattttggaaaatttgcagtccaacaatgtgatagaaaagaaaaccccattttctggggagaaattcaagctggctgcaaaaatttgcataagtaatgaggagccaaatgttaatcaccaagacaatggggaaaatgtctccaggtgtccccctcctacagtccccaatgtggcactgcctagtggagctgtgaaaagagggccaccatcctccagaccccagaatggtatatcaaccaacagcttgcactgtgcacctggaaaaactgcagacactcaatgctaccccttgaaagcagccaagagttgggctacaccctgcaaagccacaggggtagagctgcccaagaaaatgggaacccacctcttgcatcagcatgacctggatgtgagacatggagtcaaaggagatcattttggagctttaagatttgactgccccagcggattttggactttcatggggcctgtagccccttcatttggcaactgtgtctactttgctcatgaacaagactatcgtctctttgttggcattgcccatggccaatttgatcacaaaagaagtcttcaagtttcagtttggttacttttcttcatgaaataagcatctgtgcttcatttttctgcatctgtgtcagtcatggctgcattgattataaaatgtctcccatctttttctctgtcctgttaatggttatgttgtgtataaaacaaatcatctaactccatggctaccatgttcatgggaagtatactctttcatctcctttacagcatagaccatggctacttcatttatgaagaaagtc

SEQ ID NO: 479871 - DNA, 520 bp, Homo sapiens
ttggacagtggagggctgggggagggagagcaggtaatgctttaaacgtttccccattcagtatgatgctggctgtggggcagggagagaaagaccaccaggtgcgggcaggaataagcttttctgagctgagcctctccttgggtgcggttgctgtgaaggatgggggtgtggttcccatcccagtggagtttgtattctcaggggggttatggctgtctctgctgagtcatactggtctccatgaaagcgggggaaagccggcagtcagaggcctcgccttgctcctatgtagcccacagcccttaaggctgatctctctcccatcactccccacccccaacagcaccgagtctatttccaggcagctggtgaccagggccgagaacttgccccagactaaggacagcactgagttcagtgattcacaatttctggcactgtttcccctagagcccagagaagctccctgaactatgctgctgctgccagggggtggtacatgtgcacattgtgcagg

SEQ ID NO: 479872 - DNA, 530 bp, Homo sapiens
ataactgtgagacaataatgataagtccctggtgctttaagtattcatttggtgagataatgttttcctggatgttgttgatgtcagtagatgctcatcagtatccaggcattgaagagttagatgacagattagaggctttgttgttgcatctcatttacttggaaatagcaaaattgtgtgtagagattaatgctgtggacttttatccaagaagaaacacaggagctcaatataaaaacaaaggaaacttcagatattttgaaaaacatggcaggcagcagaccatgccatgggtctggcagaaaactgggagtgactccccagtgcacaagaagggcaggaaatgtctctctgacacatatttccactggagagccaggcaatccaggccacaggggagctctttgaccctacccagtactgaatctgacttgaggagcagtggggagactgtgagaaggagtggcagtgggaagtcttttgcacatgtttccagaccctagcacaaataaagcatgatcattcct

SEQ ID NO: 479873 - DNA, 518 bp, Homo sapiens
agggtatttgaataccaacaaactggtttgagaagagaaaacaaaagagctgccagggtcatgcaagcagttaatgtacaaattccgattcctggtataggtggcttcatatgccctcatgaagtcttttcccgtgcctatgtcctgaaaggacccacagctgcagctctgctggagtttgccggaggtccactccagaccctgtttacctgggtatcagcagcagaggctgcagaacagcggatattgttgaacagcaaatgttgctgcctgatcgttcctctggaagttttgtctcagtggagtacccggctatgtgaggtgtcattaggaccctctgctgctggtgtgctgcagtttgctgtaggcccactccagaccctgttttcctgggtatcaccagaggaggctgtagaacagcaaagattgcagcctctcccttcctctggatgcttaatcccagagggacacctgccagatgccagctggtgctcttctgttcgaggtgtctgttgatc

SEQ ID NO: 479874 - DNA, 1824 bp, Homo sapiens
agccattctgagtaagggagttgtcaacttgttactggctcagtatgtctggcatgggttggctgaagtcccaagcttggaggatgcacctgatgaggagatatgagagtgggcactcacgtaactttttcatagggctgctgcagcatgctgggggcctgctccagtttctactcaccttggattttgcagtacctggagggggatgcaatatcgccattggtggctggctggaatttcaagtcaatgggtcttatcttgtgagatgccatggaagtggggccttcaggctgtcactgctcaggcccaaggaacttgaagccagcacagcactagatcttgcccatggtctttcccttcagagtgataatttttctctggccctgcgtatgttcagagatgttttctgggagccagggcttggagtcaaaaactttacaagtttacctgatgctctattctatgatgactaaggtggcactcacaccacaatacaaagttcttcccacttttcctttccttttccacagccagatgagaatctcttggtggccaccatgaccactggtttatgtggtttttccaggccttcactggtgctcacttaaagctcaaggttttccatcagcttgtgataaatactgccaggcctaggacccaccttcagggcagtggaatgccttctgacttagggaaaatccataaacgctgtccaagagtccaggcctgaggctgcttgttgttctacctaccgttgtctatctggtatctaaggtggaagacgaagttttctttatattttcctctgcttttctcacatggaaggcatcttttaccattactatcacagttgggaatgtgtaagaacacccctaaagccagcacatctcagagctcaaagcccatgaactgtgcctgaacggatatctaacatgcaagacatagtcatctttactcttcactctcctctccttaagcagaaggaagaagtcacttttactgctgcaagatgcactgcctgggattgtgggagaggtggcacaagcaccttcttagctgtgccagctggtgtgaccctaggtcaggtttcaccctaatccactagctctaatcccagccgaggactaggagttgcctaggaatgacagtctatgtgtcctagactgcctttcaagtttaattaggacctcagagaacttcagcctgcattggctaaggttgctgagaaacttaagctctgactactagtgtgggcaatttttctctgattatgtcttgtccaaatgtttcctctgtgcacaagtgactgaatccagcatgtctgtattccccactgtgacaaggcaccactgagttcaatgtaagacccccccccatcaccaagttctctctctccagaatgcacagattctctttctgtgccacatggccgctgctgagggatggaggaggggtgacattggcaattaaagactgtctgtcctgtcctccttcatgccttttttagcaatatgaagttaaaaccaggtactgtgattactcacctaatttttggttcttgtaatggtgcttttcttgtggtcagagagttgttaagatttaattttccagcatgggagacaaatggtgtaggcttttattccatatttctatactctcacaattttgctttaaagaatagataaatgggatattcgttgaaaataaattataatcattgaaaataaataactaacctgcacaatgtgcacatgtaccctaaaacttaaagtataataataaaaataaataaataaataaataaataaataaataaataaataa

SEQ ID NO: 479875 - DNA, 706 bp, Homo sapiens
ccgaccctgcagagttcaggccctatagttcccctaggtctaaagtcttctatgggaatggtagtcttgggagaagtattgtgtgcaggagaggcaaacctgtatctggagacctgcttgagcccgatcacatatagaccacttccacttgataatggaatgcggctgtgcatgcccacgttatggctagatggtcaggaagccaaagtgggggctccaccagctgctaaatatgtctatgccaattatacattctggcactggggaaatgaccacaggatgagtctggaaacccactggacccactacaaaggaataaaggctgatggcaacgtgtcttggggagaggatgtttccactacagagtatggaaaagctgtttcttctggcaaaaaaggctcatcaaagttcacaagctcagtgtccccagctttattaaggtcctcccacacatccccattcaaagttggagggtcccattctttttccaatcaatgacctcatttttacaatggacacctggtgaagctgtgtgtgtacttttgttgtaagtctcttctatgcttattttgttggggttttaatcataaagtgatgatgaattttatcatatgatttttccatatctatttagatgatcacatgatttttgtttttaattctgtttttgtgatgtatcatatatactgacctgtatgttaaagca

SEQ ID NO: 479876 - DNA, 647 bp, Homo sapiens
agcagaagggaaactttgaaatttaggtaaagaaacccttttatggcaacaaaggctaccaatatagcatcagaaacctataaaggcaatgaggacttcaagagtaatgatctcagaaaaaagggaagtgcaaagagaaccctcagctgcagacgtgttggagtttgccggaggtccactccagaccctgtttgcctgggtatcagcagcagaggctgcagaacagctgatattggtgaacagcaaatgttgctgcctgatcgttcctctggaattggggaaaggcttgaggagagcactggggcttggttgggccagcactcaacttctgggtttgactggggccagatgctccctctgtggatagctgctgactttcccttgcttcccagactgatgcaagctaaaggagaggaccaatactatgtggagaagctggctagggacttgtgcctggcaaacatgcagatcatgcttccagcagagtaatgctattggctaatctctctggtgtggtacccctcttggctggaaggcagcatcaccaccaagaactgtgtgctgattgctgcaagccccacccccattctttctttctaaccgacccaagacggcctagttctgctgatacctgcaatgttttctgt

SEQ ID NO: 479877 - DNA, 905 bp, Homo sapiens
ctggaaactgggaagcaaagtgggcagctggtaatcacagctgagaacctgcaacagaccatgagcctccctgttgagaaagctaccagactcacagtttttcagcatctcaggacacctgcagcagtgatccagtttcttcaaagggtctgtggattctcttggctttcctggtatgttcctgcagtagttcttggagcaaaagtttatgatgaaaaactcattgtaccagttgcggaagaagaggcaacagtccaaaacaataagatcactgtagtgagtgttggacaagttggtatggcgtgtgctatcagcattctgggaaaatctctggctgatgaatttgcttttgtggatgttttggaagataagcttaaaggagaaatgatggatctgcagcatgggagcttatttctcaagaagcttaaaattgtggcagataaagattattctgtgactgccagttataagattgtagtggaattgaatccagaaataggaactgacaatgatagtgaaaattggaaagaagtgcataagatggtggttgaaaatgcctatgaagtcaacaagctaaatggatatacccactgggatattggattaagtgtggctgatctcattgaatccatgttgaaaaatctatccaggattcatctcgtgtcaacaatggtaaaggggatgtatggcatcgagaatgaagtcttcctgagccttccatatatcctcaatgcccggggattaaccagcgttatcaaccagaagctaaaggatgatgaggttgctcagttcaagaaaagtacagataccccgtgggacatccagaaggacctaaaagacctgtgactactgagctctaggctgtagaaatttaaaaactacaatgtgattaactctgagccttt

SEQ ID NO: 479878 - DNA, 556 bp, Homo sapiens
tcgcctactcagagctatgtccatatgtgtctaagacctagacatgtagtgatgaaaaatgcacagtaccctcttataatgcactcatcctattctgggatacctgtgcagaacatgcagattaggttgctggagatattacaaatagggagtaaacagtcaaaacgggttagtcgggagaaagggactgtgaatgtgaccggggtaaggtatctgagctaccaccagcagcgaatccagacacggaggtctgtctgtgacacgctgctccattacagcaaagcaaagccccataatgacctaatccagaaggataagatcccaggacccatagaacaaggaggccagagggaaggcaggccacaaagaagaaggaaaccagacttccccatccctctgggctcctgggggggtcagtggaaaaaggcctttaacctaagtgctcaaggccctaacctaacagcttttgtttttcacgctggagcgctggcacttcctgaccccgcttagtccttctattagaattttgtactctgatgctagttttcagagtata

SEQ ID NO: 479879 - DNA, 870 bp, Homo sapiens
ctggagggaggccaaagcccaggccgccctgccgcgcccccaggccccgctgctgccgctgccacactcgcctggctagcggacatcgccgccgccatgttgtctacaacgagcctcacaggctaccgtcgtcctcccagctcctcttggcggctacggtctctcttctgtagggctgctgtggtttgccggatgttcacttcaggccgtattcatctggagctcagcatgcttaagcaaattctagctgagaggtgcttgagaatctgcacggctatgggttggggcctcggccctagtggtgtgggtttgcgagtgggatcttctgatctgtgggttgcacagttctgtggaaaaagcatggtttccctggctgggtgggatacttaccaccactcttggcttgggtgtgggggctcctatgcctcatgctgctctcaggtggccactgcaggacgctgctctttcttcctctccatggatcacgccagctgctttatcagttctggtgagggaacctggatatcttggttgctggtgaaggattcacatgctaattatggttctttccgatgggagactctgatcgctgctgtttctcgtcagccatcttggccccactccagtaatttccttttgatcccaccccaataaatttctgtcctggaagctttaacatcctttttattttcactctcaattgacgaccttatctcctattgccttttgcactgaggtcataagtaccattcagagccaatgtgcctgtgatgactcaccctggttctctgttgacccatagacaatgctgttttcaatcataacttcacaacaaagtaatagatgtaaaatttatttgttaatattcct

SEQ ID NO: 479880 - DNA, 1000 bp, Homo sapiens
cccgctcgggaggcattttccatctggtatctgggagaaagtatgggagacaggacggggcctgatcctaaattaggaaatatgtgggagctgacggttttaaaagcaggagtttccctgcacgagcgctccctttgcctgccaccatccactgtaatgattaatactgagtgtcaacttgattggattgaaggatacaaagtattgatcctgtgggtgtctcctgacaatgcgatagaaaagaaaatcccattttctggggagaaattcaagcaggctgcagaagtttgcataagtgacaaggagccaaatgttaatctccaagacaatgggcaaaatgtctccagggcatgtcagaggttttcacagcagccccaccaatcacagggccagaggcctaggagcaaaatgtggttttgtgggccgggcccagggtccctgagctgtgtgcagcctagggactttgtgccctgcatcccagccgctccagccatggctgaaaggggccaacatagagctcgggctgtggctttagatggtgcaagcaccaagccttggaagcttccatatggtgttgagcctacgggtacacagaagtcaagaattgaggacttgcagtacaatgatgaataggaatggtgatagtggacatccttgccttttttcaaatcttaatggggataacattcagtcattcatcattaattatagtgttgactatggatacttttgcagattatctttattgggttcatgaagttaccttatatttctagtttaccttccctctaagcattgctttatcttcttccacaaatattgatatgttatacctttattttcattttgttgaaatgttttgtagtttcttttgagacttcattttgacccatggttatttagaagtgcatggtttaatttttaaatatttggagattttctaaatatctttctataattcatttctaatgttactctggaatatactttctatgatttc

SEQ ID NO: 479881 - DNA, 833 bp, Homo sapiens
gtggaggttggctgggcatttgaacatggctgacaagtatgggcacagatgtggcctgtttctattttcctcctatgacttggcaacttatttgactgaaactaggagcacaggtggcactgggaccgactggaatcttcctgggttctgtgtcctcagattggtagatgaccatagtagttacataatggtggaacaacagaattccaatagctcaggggcaggaaggatgaaagtagccaaagctctcagtgcacggtacaagctatcgttggatctaccattctggggtcctgaggattgtggccctcttttcacagctccgctaggcagttccccagtggggactctgtttgggggctccgattccacatttcctttctgcactgccctagtagatgttctccatgaggagcccctgcagcagaacatctgcctggacatccaggtgtgtcatacctaaaactgctttgccaaataaatccaagatcatgaagatttacctgtatgttttcttgtacatattttatatttttagctcttacatttaggcttttgatccattttgaattaaacacgttttatatggtatgaagttcttaaaggaaaagctaaggctgttgatttgagacatttcttttcaaatacaggcatttagtaacataagtttccttataagtactgctttggtgtcatcacataattgttacgttatgttctcattttcatactggttaaaatatatgatcattttgctttggtttcttctttgccccataagttacttaggagtatattacttagttctccaaatatttgggttttttttccag

SEQ ID NO: 479882 - DNA, 454 bp, Homo sapiens
gccaaagagactttacccaccatcatgagtcatggcacttgggagcacccctttcctggtcctttggctggagagagcaagtttttcttggagctttttctgtctgcacccattggtgtttccagattgccagtttcttcagctccaagtttgggatctgtgaggcagaaagaaaacccacagaagccaccactgagtagttccatggatcctgaagcagtgggtacaactcaaggagagcaagcagaagcagagtggggcgttgcttcacacgagaagtgcaaggagctgggggacctccccaccccgccagccaagggaagccgtgagggactgtgctacctggcctgggtactatgtttttcccgtggtttttgcaatctgcagatcaggagataccctcgtgtgtctaactaccaggaccgtggatttctagcacaaaactaggtggctg

SEQ ID NO: 479883 - DNA, 1954 bp, Homo sapiens
ctgagacagaccaagctccatttcactgggccccgaggagcctatggtctcaatggtagtagggggccaaaaaacagacttgatgatagatacaggtgctgaacactcggttgtgactcagacaattggaccgttatcaaaggactatgtgaacattatcggagccacaggaagagacttgctacacaagttgcaggctcagatctcctttacacccagtggagatatgaccttaagcctaggactgaaagaggctatggtattaacactcactattcaaaaaacagaggaatggaggctttacgaaagcaattgtcaagaatgtggaaagagatacactgtagctaaaggagaaaaactgtttacagatctgctccttaaattgccaggtgtctgggcagaggacaaccccaccgggctagcagtgaatagagcacctgcggtagtagagttactgcgcagaacctatccagtgcggattcgccaatatctcattcccatggaggcctattggggaattgaaaaacatttaaaaagactccttgagttctggataatagaagaatgtacctcctcctggaatacccccttgctgccagtgttaaaaccgtctgcaaaacctttatatgaggctaccaaagtggggataaaggagcccctcctttggggaaaagaacaggacatggccttcaaggaaatcaagaaagctttaattcaagctctggcactcgggttgccagacttgacaaagcccttttatctgtatgttcatgaaagaaaggagatggccacaggagtcttggtgcaaatgttagggtcatggtatctacctgtagcatatctgtccaagcaactggactgggtggccacaggatggccgccccgtttcaaggtgctggctgtcactgctctgttagctgaggatgctaacaagctcacttttggacagaagttgataattcaggtgccccatacagttgtcaccctgatggaacagagaggaggacatcgttggctctctaaccctagaatgctgagataccaatggctcctgtgtgaaaatccatacatcaccttagagactgtaaacaccctaaatctggctacacttctgccaatagaatatgcagagcatgggaagcccccgttatgtgccccagggtatcattgctgtgtagaaacagtagatgaagtcttttcaagccggaaagacctaaaagaccagcccctaaaggacccagacatagagtattttactgatggaagtagcttcatatccgaaggtatcagaaaggctggatatgcagtagccacactgaactcagtcgctgaggcctgccctttaccagtaggaacctctgcacagaaggcagaactaatagctctcataagagcgctacttctagcaaaaggaaagtcagtgaatatctatactgactcaaaatatgcctttgctaccttgcatgctcatggagccatctacaaggagaaaggactgttaactactgaagggaaagaaataaagaacaaaaaagaaatagagcagctcctagaggcagtatggactccaaagaaagtagcattaattcattgtaatggacatcaaacaggaggaagtaatgaggctacaggaaacaggaaagtagacagggaagcaaaaagggctgcaataacaaaaatgacagaaaaaagagagacttatgtcatgcccttattagaacctccccttgcagaaactcctaactacacctccagtgaaaaggcatggttcgcacaggaaaacggggattatcaaagaaaggaggctggtggaagttttcagacgggaggcttgccatcccagaagcccttcgaccataaaagatggccgccccctgaagcggccattttagaggcctaccctcagggatgcgttctctttctcagggatgttccttgctgagaaaaagaattc

SEQ ID NO: 479884 - DNA, 726 bp, Homo sapiens
ttctcaaggtgtattttcctaaatgcgtcatgatggagagtccagctgtgaaactaaacctcatcggaaataccatgtcgcctgacctggcagctgatttccaggagctgtctcagtcaaagactggggtaaaggcagagatggtcctgatgtccaggggaagattctgccaaaatcagagcaatttaaaatctcataaggagaactgcgactatgggacagcaggggtgacccagctcccaaacatcccacacagaacacttagtgatgtcatccacgcttgtgaagaggagaaactggtgtcaatgagtaccctgaacttactgccttctaacagtttgcctaaatcaaagacccaaatgaattgtttggactggaagaggaaccctaaagggaaaggtccctcagtgggaggccacactggaggccttggccagctcctgcctgatgaatgtatgacctgctgggggtgccctaacaagagtagattcttggtgcccaggagtaccacctatgccctctgggattgtttttacgtgtgtgcactcactatccatcactgccttatccctggaaggcattcacatcagcttcatcttcctggccagagttgtgctgagcctgaaatggtggctcacgctggacaaaaatggttaacacagaatcttaggaaggaggtcccctgcctttctaagatagaccttcatcattaataggatttgtata

SEQ ID NO: 479885 - DNA, 614 bp, Homo sapiens
ttgtggtcacagcagggacagtgggagacagagatacgaagggtgggcagaagaggggcaggcaaagaagcaggggagacaaagccacatgtgggctgtcacagccaccagagggagagggtgcctggaaggagattgtggagctccaggagcaacagaggttccccagatctgtgagcatgccctgcctggcagtgcaggaagagatggctgccacccaggccctacctgcagtggtatatgtgagaaagaactgtcccattcccaaatcatcgtccccaccccagcccccaggcccttggttggtgagatccttgatgggcagtctcacgctcctgtccaggagactttcccaccgttgctcctttgcatggagactaagtggactcttctattccctgtgcatcacagggtctacagtgcacgcatcttcctcatccctctgcgttccccagatgacgatttcatctgtgtctcctcctacatactcccaaatggaccgtcccagccctagaacccgaaaatggttcagagagcgaaggccaagatgcccaaacacctgctgcagaatcctgctccaggactgaagtgtatagtctctatcaaaataaaaa

SEQ ID NO: 479886 - DNA, 1101 bp, Homo sapiens
ggcactttgggaggccaaggcaggcggctgggaggtgtaggttgtagcaagccgagatcacgccactgcactccagcctgggcaccattgagcactgagtgaacgagactccgtctgcaatcccagcacctcgggaggccgaggctggcggatcactcgcggttagaggctggagaccagcccggccaacacagcgaaacgccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggaaagagagggagaccttgtggccccgacaaaaaagaaggcccatggctgcagtgccacatataaagaatgaagacctcgaggcccttctccctctgagtctccctcccaccggtgaccctccagaagcccactggctcctcctcaccctcactcacacttcaactcccagttggattggcctgtggacctacctgctgcatctcaggagcaagtgcatggtggtgtcgctgacttctagtaggaggatgaggctctctgtcaggccacggaccaagtggcccaacccatgggaagtctgcccactttccctcacactcactcacacttcaacttctgggaggactgatctgtggacccacctgatgtgtcatagtcagcaagaaagaagtcacaacatttcctcccacagctctgcagggacagaaggcagacagcaagacccacaggcagcaggaacttgcataggaaggaacatgcacattgagccagggactttcagggacagccagagtttcctcactgtcaccatgatagcagcagctgctgccatcacactggctgcagcagggaggcccagccagggctgcacgctctgtggaggcagcaggagccagggacaagtgggatccccatcttttacgagttggggagggagctcctgggtgcacctgcagctgcccaaacagcagctgtagacccagacctctagctccatggagcaggcatattgtggctacagatcca

SEQ ID NO: 479887 - DNA, 941 bp, Homo sapiens
gctcaccagcacacctctgttaactgaggttagcaggtcccccaggagagcatggtttctaacaccattctttttatcacctatggggaactctctatatccaatgaagaggactccctagaaaatgggcagtccctgagctccagccagctgtctctgcctgccctgtccgaaatggagccagtcccaatgcccagggatccctgctcatatgaggtgctccaaccgtcagacatcatggatgggccagtgtctgaagagagtccctctgccagtgagtctggagtcctcctgtcccaagatccttcagccaaaccagtcctgctactgccccccaaaaaacctgctgctttccctggagaccatgaagagaccccagtgaagcagctgccccttctcaagcagcccccggccctgcctcccaaacccactaccaggattgccaaccacttaacaggtgaaatcgattcaatgtcaacatttttgcaaagataaagaatagtgccttctccatatgggtatgtcgagggtttagatttttgggctttaggtgatggacctggaagcccagtgtatttcccccatttaaaatcacggcacggggtggctgttctcttaggggaaaaaaaaaaaaaagacaatctgcaaattatgtggtaaatacttttaaaagaagagtaagcttagcaatgttgttctaaaatgattgcacacgtcctttgcagtgtttctgaagtgttacttaatgaatgtagccacaggcattaaattgagcactcagtgaaattgtacttcactgcactttggcacatgaattagataccactttgtgattgaaggctgtggtataatcagagattaaaatatttcagagggtcatttctccaactttgataatagtttcacctgatgctgatcgactgcctttttaaaaagcactc

SEQ ID NO: 479888 - DNA, 927 bp, Homo sapiens
gcctcactaaacagaaatggagtcttgctgcagcacatgtaggaggagccatccagggaactagctgggaagacagggctgaccccaatgcgagccagcattaaccagcacaaaacagagccaatttcactggcgctgctgaccaccagggaacaggaaggcatttcaggaggtgagtacagcaaaggccctgaagagagaaggagcgtggttatcgggaaatccagaggccagagtggacgagagagatatcctggcgcccctgtgaaattgccttgtctgccagtgaaactgtcgcctccgctacctccaaagaaagtcatgatctgtatgcccgtgggggggccagacctctcactggtgtcctacacagcccagaagagtggccagcagggtgtggcccagcaccaccacactgtcctgccctcccagatccagcaccagctgcagtacggcagccacggccagcacctcccctccaccaccggctccctccccatgcacccctcgggctgcagaatgatagacgagctcaacaaaacgctggccatgaccatgcagaggctggaaaggtaaaggtgggcaccaggagggaggacgggaggagaggggttggctggggaggggggcctagggatttggaccatgacttaggaatgtgaacaaggggtcatccccactgggggaaaatgtttgaaagtaaaatgagacaaaaaactgaaggtcaaagcatggaaaaaaaaaatgttgccaattgaaaagctctggaataatcacatttatcggaaagaaaaactaacattcatgtatatatgtatatgcttatatatacacacagtcctcagtgtcattagtaggttcgtgaaaattgcaacttcagtaaaataaaatctaacaaaaccaacttaaccatagactaattgatat

SEQ ID NO: 479889 - DNA, 995 bp, Homo sapiens
ccgcctgtggttttccccaacatggatgtgcagcacatgcctatttatatttccagtgacacccagttgacaactgtgcagggagttgtcacaagtttctgtggtgattatggcgtgattgatgagtcgatctacttcagtagtgatgttgtgactggcaacgtgcctctaaaagttggacaaaaagttaatgtggttgtggaagaagataaaatactttatggattgagagcaatcaaggtccgcattactcacatacgtggaagaagtggggtgataaagaatactatctttttcaccttggattctgtgaaacttcctgatggatacgtacctcaagtagatgatatcgtcaatgtggtcatggtggagagcattcagttctgctttaagtggagagcggtttctatcaccccagtacaaaaatcatgacaaaacatttttattctgtttatatttccttttaagagcagtaaaggggctggtttaactgaaaaggttagcttagtaagcctaaatactattttacatatgacttttctggcaaatctaattgagatactggctagttcaattggaccatgaacccagcttagggaagtgccttatcaattaaaagcatgctaaattagcttgctagtagtcactggaggaaaggagttcttaattaaaatgaacactgccattaaatttgaattccatatttcctattagcagcagcagattccaggatgacagaggcctaggacggccctaaagggaacatcagagccaaagtatttaacagaaaaggcatcagggacagcatgttaaaggcatgatttaaagttacacttcagctttgagtcccccttatgctgtctgtacaacctgtattgttccatagcctctttcatcttctgtcattcacataatttgcaatgtttattattccttatgttccttcttctccatgctagaatgtaaactccacaatggcaggatgtcttttggtc

SEQ ID NO: 479890 - DNA, 702 bp, Homo sapiens
tcctacttaactgacttaggacaaaagaagcccaccgagcctccagttcctattattacagttcatggttatcactctagtggaacagaaagcatgggaaagcatggccttatcaaatcataaggatgctaaaagtcagggattacacacaggaaccaaaggaaagctaatagtaggccattgcctctggagggaagacatgcaaagcagcaccagtgcccacctaaggtcaaagaagtctgacactctaagagtggaccccaaaaaaggaatgccccaggggatcttctggacctcaacctctccaagagggatcccctgggcaaaggctctggggcataatactaagccctccttagaattttctcttgcagttgcaatactgtttggcccccatactgtttggaatctggagtttgctgttgaatgggaaaatggaatggaattgcatgtatccaggctttggtgctgctcttctaaacagggtcaggcctaattagtatgtgatgttctcctttggtgctgtttggtgccagtgttctttggagtctgaagaaggttggcctttaaaaatcaaactgccatggaaactgctttacccaaaattttggttcacagccttcattggattacctattgaggcaaacaaagtaaaaccatctggctagcagtctatctattttgttaatcttttcaaaaaaa

SEQ ID NO: 479891 - DNA, 625 bp, Homo sapiens
agttcagagtgtgtgtcaggaaattcctcagagagctcagagcccctaccctctgtacaggaagcatggtgctgacatctgcttttggtgaaggcctcagaaagcttacaatcatggcagaaggtgaagggcagccagcgtgtcacatggtgagggagagaaagaaagaactctttactgcccaaagaggagaagatgaacagagaataagtgttttattattacaacctttgcaccggtgtgatagaaactgccctccaaatataacaggattgaatcctctcaaccatggccatattgacgatatcatatctttgagccaatctaagggagaagcacaggatttattaaacaattggtcatgttcacaactccttagtgagaggcagtcaagtacacagccttttttcctccaaaacaacaacaacaacaacaacgacaacaacaacaacttgacggtcattcatgaataaaaacagctccaaaagagcacaagagtccacttaagaagctatagcaacacagttgaagaaaaaaactgagaatacttgcacaaaaaaggtaggaaggacagtttcattttacctgcatcatcccatcccccagttgacactgctcagcatgg

SEQ ID NO: 479892 - DNA, 557 bp, Homo sapiens
tgggcgcagcagtacataagggggaagcaacactgccatggagaccaagtacagccatgcttgtacaagtgtctggtacataggaagggctgcatacatggaattggctgtggtcatatgcaaaacagaagcaccactgcgagtgctcctgcccatgaaaacaactgatatttatccagcctcgtctgcaccttgttcatctatttgttacgtgccagccctcagtggcagagaaggggtagcagacacagaaggcttaagaaaaagaagagaaaaaagaaaacagaaagtagggggcattctacccatcagcattgtttctggttttggaaaagctctgtctgtgtgtgcctgtacctttggtttcctgcagccactgaagcaagcatcttgctgctgtgtctcctcacaagttcctccaggaggaaaacttaaggagaagagcttggccacattcctgcccccgctccattccttcctgtgactttgccttttcccccgccagagagaaggccttggaatgctttgtgctgtttcctgtccctgcttcctgataa

SEQ ID NO: 479893 - DNA, 693 bp, Homo sapiens
tactacaagatacaataagacttggacatctgcagtcattggctgcaggttgcgggagacggcgagggggatatgacttggtgccaaagaggctcccattcttgaggagaactttccagagaagggaagggggcagccgacattcacagcagctgtgggatgggtgcactggccaataaagagcacctgagcagaccactacctacaccacctctcagagtaaccaagtctataaatgtccatataacttgctgtgcctgggccctgggcagaagggagccactaagaaggattgtgctaggcgtttggctgcccttgatcaacagatgtttggatctcacctcagctctctgggcaccccaacattgccatcacccctcacccctcatcagcccttctctcatcaggtttcagaaaggggatttcctgagcatgggtagaacaagtgtccgtaggcacatcacagcaaattcaggtcccatacagtcctacaagatgggttatccaaggccagtcttttgcgggctgagggagcccagtcttcatgcctggatgactcactcgcaccatcctctctctggcccctctgcatcctgctctcctgcagggcagtgcccgggtttcctgtgcttctctgccagtgagctggttccatgctgggcttcttctaatgcatttctgggctcttagaca

SEQ ID NO: 479894 - DNA, 533 bp, Homo sapiens
gtctggctttgatatcggggtgatattggcttcatagaatgaagtagtgttccttccgttctctggatgataagagaatgccatggagcctacaccctttcaatggggagaataatgctggttcaaaggagtcagtcacttcaaatcggacacttcaaacgagtcagccaactccacctgaagaagtttatacttttggctgtgtgtttataaataatgggcagatacaggcttctccacttcaaacgagtcaaccaactccacctgaagaacttcatacagttggctacgtgtttacaaatgatgggcagcaaatgaggagtgatgaagtaaatcaggttgcaacagggcatcaaagcaaacagaaacgttccagaaaatccaagagacactcttcatctaagagagggaagagtatgtccctgcggttagacaaacaggaaggtgagggggaatccaatctttgggcctcaaccatgtcaaaggacatttgtagtcatgtccttgagggatgaacagatatgagcacattt

SEQ ID NO: 479895 - DNA, 2526 bp, Homo sapiens
agtctggcttcctgctgcacacagcatggcatttatagatgctagcatcactcacaatgtccatgaagagaaggtaaaaaatggccagccagcacctggtaatgtcatcacaactgttccaccagtgcttattaatatggctgcagctggtatttcatccatgagtactagggatcagtatgctgcagtcactcacagcattcgtgaagagaggataaataacggccaaccagcacctgataacaccttgtcgactgctcgactgctggtaatatggcagcagctggagtttcatccacgagcacgagagatctgtctcaacctgttccactggtttccagatgttaccatcactcacaatgtccgtgaagagaggatggaaaatgaccaaccccaaactgataatgtcttgtcaactgctccaccacagcttggttatatggctgcagctccatccacaagtatcagggatctgtatgctacagtcaccttcacagtccctgaagagaagatggaaaatggccaaccccaatctgagaaccccttgtcaactgctccaacagggtttattaatatggcaggagctgttattccatccatgagtaccaatgatctgtattccaccgtcactcacaatgtccgtgaagagaagatggaaaatgaccaaccccaacctaataacatgttgtcaactgttcaaccagtggttatttatttggcagcagctggtattctgggcatgagtaccagggatcagtatgctaccgtcactcacaatgtctgtgaagagagggtggaaaataaccaaccactacctaataacggcttgtcaactgttctaccagggcttacttatttggcagcagctggtattccagccatgagtaccagggatcagtatgctaccatcactcacaatgtccgtgaagagacgacggaaaatggccaatgccaaactgataacgtcgtatcaactgttccaccacagcttggtcatatggcagcagctggtattccatccatgagcaccagggatctgtattttaccatcactcacaatgtctgtgaagaaaagacaaaaaatgaccaaacagcacctgataaattcttgtcaactgttacagcagggcttatgaatttcgcaggagctggtattccacccctgagtaccagggataagtatgctaccgtcactcaaaatgtccgtgaagagaggatggaaaataaccaaccatcatctaataacgtcttgtcaactcttctaccaggacttacttatttggcaacagctggtattctagccatgagtaccggggatcagtatgctgcagtcactcacatcgtctgtgagaagataaataacgaccagccagcacctgataacatcttgtcaactgttccaccgtggattggtaatatggctgcagctggaatttcatccacgagtaccagggatctgtttagcttcctagaaactgagcatgacagggatatacctgtggagttgccaaaatgcacttacctcacagctcaacattttcctttggtttctagatgctaccgtcaatcaaaactgagcatcagacggatatacctgtggggttaccacagtacacttatcttacaactcaacctcttcatctggtttccagatgctacagtcactcaccatgtccgtggagagaagataaataatggccaaccagcacctgataacttcttgtcatccgttacaccagggcttattaatgtgtcagtagatggtattccacccatgagtaccagggatcagtatgttactgtcactcacaatgcccatgaagagaagatggaaaatggccaacaagcagctgataacatcttgtcagctgttccactggggcttattaatacaccagaagctggtattccagccatgagtaccaatgatctgtatgctactgtcattcacaatatccaagaggaggagatggaaaatggtcaaacgcctcctaatggcttcctgttaaattctgctccaccagagcttataaatatgacaggagatcatatgccacccaacgcattggattctttctcctacaacttcactagtctcagcagatataagctgctttacaaacctgatagtaatgacttgtggtaggcaccaaaaatggtctctgcaggtgacccaccagtcacagcaatgtcttcagtggaaactgtgccaaatataccacaaatatctcctgccatggcaaagaaaattaatcatgatataaaatgtcaattaatgaaagaagtttgaaggtttgggcaaatttgtatctttccatgaggatgcattttctatttgcatgtcgattgtaaactctattttgtatccactactacctcttacaactcgtagatcctgtaggtatcctctggttaatggaatacctctttaatttcaggtttaaaaaagttgccttaattcagcaactcgagaaggtgcttaaagatataggttcctactgccatctcagaaaagttaagcacatg

SEQ ID NO: 479896 - DNA, 561 bp, Homo sapiens
acctagttccttaaggtggtaggaatgtggttcccatttttttgctggctgtcatccagaaactgcactaaacacctagagccatcctataccttcttgggagcactgctttatcctcaaagcgggcctgctgtgtcacatccttcttgcactttgattcccttacctcttcttctgctccttggtaaggaaaatgctctgcttctcaaggattcccctgccagggacccaaacatcatgaacacatctaaacctaattacctcccaaaagctccacctccaaatatcatcccactgggagttagggtttcatcatatgaattctcagaggacacaaatattcagtctgttcataatgcctgtctaccacaaaagccagaagcggacagcttcattacgacaggcccaactgggatagctctgaaggacagtggtgaagggaaatcctccaagagggaagatgcttgagcagtgtttctgtgtggaggagagatggccagactataactcctcacccttcaatgtgtccacgaacctaatcttccccgttcgtgtgaactc

SEQ ID NO: 479897 - DNA, 1928 bp, Homo sapiens
taaaaccatcggctggctctggtggccctgtctgtttgtcctcaaccatcaagatttggctttaccatttactgacagtgggacacaggtcatcacctcatcttctctggcctgcacttcctcaccacagtggcgttgtcataatgcacttacctcacagctcaacctcttcctttgaacagaggatggaaaacggccaaccccaaactgataacatcttgtcaactgctccaccacagcttggtgatatggcagcaactggagtttcatccacgagtaccagggatctgtatgctaccatcactcacaatgttggtgaagagaggatggaaaacagccaaccccaaactgataacgtcttgtcaactattccaccacaggttcgtcatatggcagcagctggtattccatccatgagtaccatttatcagtatgctaccgtcactcacaatgtctatgaacagaagatagaaaatggccaaccagcacctgataacgtgttgttgactcttccaccagagcttattaatatgacagccactgatatttcatccatgaatgctaccatcacttactacgtccctgaagagaagatggaagatggccaaccccaatctgataacgttttttcaactgctccaacaggtcttaatatgacaggagctgatattccagccatgagcaccaatgatctgtgtctcaaccttttcatttggtttccagatgctactgtcactcacaatgtctgtgaagagaggatggaaaataaccgaccacaacctaataatgtcaggtcaactcttccactacggcttagttatttggcaacagctggtattccagccatgagtaccagggatcagtatgctactgtcactcacaatgtccatgaagagaagacaaaaaatggccaaccagcacccgataatgtcatcgcaactgttccaccagcacttactaatatggcagcagctggtgtttcatccatgagtaccagggatcagtatgctaccttcactcacaatgtccatgaagagaagatggaaaacggccaaccagcacctcaaaacatcttatcaaatgttctaccagggctcattaatatggaagcaactggtattccatccatgagtaccagggatctgttagccctcactttgcgggtcatagaaccaatgtggggattctgccagtcactgagtatgatcccaactatgcattctgaaactgggaaacaaccagagggtggattcatggaccaacttagtccactgtacgttggacctgatgtaaaaccacatggattacctgatgtaaaatcacatgattaccagaaactacaactcttattagaagagcatagtgacattttgggtatcctggaattagcaccagttcagagccattatcaagtaattcctgagaattctgattatttacttctccaccatgacctgccacactaataattggccacaggtctgttggggaaggtggggacaaggattaacagcattgttatttggcagtgcagcatgatctttcctcaagggcaagcctgcagtaatgtctgattaaagaagagagccaccacaatctcctcacagatttttgggctccccttaccaagtaatttcttgcagccttggtgaaagtcacatcatctggacatccagcgtggctgagcagttcttccaggataaagtcactctcacattccaatgtccttaagcctttggagtatatcaaggaagtccttgaacttctccttaattgacgatagtcaacattcggtttctcattttagctaaccaaccaagcaaactgctagagccatccttatcctctcaaagagaaacactgaatccagagccttggcttaatgacccttggcttaatgactatatagcaataagtttggtgtgaat

SEQ ID NO: 479898 - DNA, 1487 bp, Homo sapiens
ataaaaaacacagatgtgtgatgatggagtggagataagagtgttcaactccaatagccacctccattttttcagaatatttgagctcaaccacttcatttggtttccagatgctgcagtcactcacatcgtctgtgaggagaagataaataacgaccagccagcacctgataatgtcttgtcaactgctccaccatggcttcgtgatatggcagcagctggaatttcatccacgagtaccagggatctgtatgctaccgtcactcacaatgtctgtgatgagaggatggaaaatgaccaactgcaactgaataatgtcttgttaacttttccaccagagcgtgttaacatggcagtagctgatttttcggccatgaatgctaccatcaatcacaatgtctatgaagtgaggatggaaaataaccaaccacagtttaataacgtcttgtcaactgttaaaccagggcatattaacatggcagcagctggtattccagccatgagtgccaagggtctgtgtgctactgtcactcacaatgcctatgaagagaagatggaaaatggccaacaagcagctgataatatattgtcagctgttccaccggggcttattaatacatcagaagctggtattccagccatgagtaccaatgatctgtatgctaccatcactcacgatgtcagtgaaaagaagataaaaaacagccaaccagcaactgataacttcctgtgcactgttacaccagggcttattaatttggcagaagctggtattctggccacgagtacgagggatctgtatgctactgtcattcacaatatccaagaggaggagatggaaaatggtcaaatgcctcctgatggcttcctgtcaaattctgctccactagagcttataaatatgacagaagattgtatgccactcaacgcattggattctttctcttacgacttcactagtctcagcagagaggagctgctttacaaacatgatagtaatgaatttgcggtaggcaccaaaaactacagtgtctctgcaggtgacccaccagtcacagcaatgtcttcagtggaaactccacagatatctcctgccatggcaaaaaaaattaatcaagatataaaatgtcaattaatgaaagaagttcaaaggtttgggcaaactcattcttgggctgcattagatctgtatgtgatttagcgtgacttctatttaatttcactgaaaatttctaatacatctgcttaaatgttttgttttcctttgttagtgttcacaatagtttccttagtaatatacaggtgttgtgatttaagcattcaaacacaaacactacgtaacattgtaacccatgaaaaatgtatacagtggtagtggatgcactaagattgaggtatatttcattttcataattgtagaaatactaatgtttttaaatatcttcagattataaaagaattttcattttgcttgaagaactacaagg

SEQ ID NO: 479899 - DNA, 629 bp, Homo sapiens
catctcaccacaagcaccgtgtatggtccaagggcaatggaaggaagggaagcctcaggacaccgcgtgccctgctccaacagaacacggggacctgtgcagggcgccagagtccctaggagaaggctctcgctcagtgggtgccagcctagagaaccaggaagcgcagccctccccttcgctgactctggcgccctctaaaggcggcctgcccactactcagcgttctctggatgataagagaatgccacggagcctacaccctttcaatggggagaataatgctggttcaaaggagtcagtcacttcaaattggacacttcaaacgagtcagccaactccacctgaagaagtttatacttttggctgtgtgtttataaataatgggcagatacaggcttctccacttcaaacgagtcaaccaactccacctgaagaacttcatacagttggctacgtgtttacaaatgatgggcagagcgtcgtgtgtgttgagtgatgagaaatctttgacctgtgcctaaaactttatattaacgatataaatgcatggctgtgtatgcatatgaagactgtgactttgcaatggttggatttgtctttaatggaatatgttcactgatgttttt

SEQ ID NO: 479900 - DNA, 724 bp, Homo sapiens
tcatctttcagcgtggacagctcctctgggtgtttaaatgctgctctgcatgttttctgtgcaaccacatggctggttcatgggtccgtgtgggaggcggccccaggccagaaacacttatgtctcaactaacagaaatggattttggagtatttcataataggaatctgaatgaggaggaaggcagagtccagtgcaagaacagaggaagactcaccaaacatcaggctctcctcttagactgccccaaggttactataaaaacttgtgacacccttaatccagctctgctcatgccagtcaattcctcggagaacctaactcattcctgtattaaaaccatagagcagatctacttaggtagaagagatctaagagatacatctctcaagaatcctgatgatgaatatagttttctacattctgatggaagtagttttctaaaaaatggaaaaataagggtaggatgtactgtggccctggatctaggtcagggaaaggcacttaacatatatgctgactccaagaacgccttctttgtgcttcaaccacatgcagaacataagaatttagacttcaaaactgcactcactgtcaacagtggtatttgttcatgcttaattaagaaatattgaccttaacagcaaggatatttttaaaaatggatttcaagacaggccgtgtgtactggttatcagcatagagtaaaactatgcaactctat

SEQ ID NO: 479901 - DNA, 746 bp, Homo sapiens
agagagagagagagagataaaatgaaaaggagaaggagaccttttggatgccgttttgggctggccatcaatctccagatatcttttagtgctttgtctgctgagatggttaagtatctatacaagaagaaaacaaagtcagagacgttaaaaaacttctctgcccaagtttatgcagatggtgacacccagttgacaactgtgcagggagttgtcacaagtttctgtggtgattatggcgtgattgatgagtcgatctacttcagtagtgatgttgtgactggcaacgtgcctctaaaagttggacaaaaagttaatgtggttgtggaagaagataaaatactttatggattgagagcaatcaaggtggatgttgtgcctcaccctcttaacgatgatggaccctcagactcaaaaatcagagttttaaatggatgtgttacttctataagtgaagatactgtttatattagtaacatcatttatttccctatggacattgtttctgaagtgtgtctgtttaaatatgtgcaaaaatgactttaggtgttgcagaactgactttaaagtagtacactatcaaataacgtgtgcaattcaagatgacctagttaagagatcatgacactcacatttctccatggctgttttagattttgtgccttataagggcaactggttaaaagttgaatattccactgaaccaggcttcttaaacttcaaggcaagctctgtgaagcccactc

SEQ ID NO: 479902 - DNA, 777 bp, Homo sapiens
gtcttgtgtctttatttctacactctctcgtctccacacacggggagagacccaccgaccctgtggagctggaccctacaatgaccttccacataatctatcctccagtatgttccacatgcagttggaaagaatacgtgttttgcagtatttggacggaatgttctgtggatgttgtgcctcgccatctttatggtgctggaccctcagactcaggaaccagagttttaattggatgtgttacttctatatgtgaagacattatttatattagtaactgcatttatttcttcatagacattgtttctgaaggtggagcgtggacatgggtatccttacaaagcacccctggtgttagcaatgggccaaccaggttggaaatcaatgatttgcatcgaagtgacctgcactcatgcaggacccagggtgaggaggtgcaaagctggttacagtgcttattgggcttttccataatcatttccattatttatactcacaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaatgacaaagcatttttattctgtttatctttccttttatgagcagtaaaggggctggtttaacttaaaaggttagcttagtaagcct

SEQ ID NO: 479903 - DNA, 735 bp, Homo sapiens
cagggcacatgcaacatgaatcccactggacacaccagacacagctggaaggtgattccattaatactacaaaagcgctctcagtgcagttttcctggaatgtcttttctaaaggcctttccaagtgaacaccatggcaaatctgagcactggttaaagcagcttttgcccatggaagtgcagagggaagaggtcagcctgggagctcaaaggttggcttggaggttcagcttctggctcaccagccctgggaacatgagcatgttactgtgcccctctgcacctgcctccctttctgccccatgggcacagcggttcatgaagaggaagcaacgttcacagtgccttttaacatttgaaactgacagacccgtctctcttccattgcctagtttctcactttctgtgacttttcctggtgacagcaactctccacatacatgccacctgggaatgactgcaggtttaatgtcaaatttaataaaatgtcagatcatattaccctgggaatcacagcaaaatgtttaaagttgaggctctgcggcctcacactgacacctgcttccttcactcctttcctgtgccccatggccttgtagcctttctttttcccttatcaaagcctgtgatgcagtgatgactgtgtctcttgctgaaagccttagcaacaccctcccaagggcttttagatatagttcaaggaagtggccaacagatggcactattctcattagc

SEQ ID NO: 479904 - DNA, 669 bp, Homo sapiens
accagttagttttgcccagaatccatttctcttctgaatttgcagcattttctcaggacctgtggtgggaatgtccaggactggtcagcctgtgagcctgtaacatggatacagtggagccagaacaaactgtccagaacagccagacaagtaagagcaaccttatcttgtatgaagtgatagggattactgaggcatctccttggaaaccatacctcattaatcctgctgtgaagaaagatggagtgacacatcttcccttcaccaggggcctacaggctagaggtgggaaaggggctgtaagcagtggcattgtgtggagctgcttcctagaggttgaggccaagggactctggtgggaaagttgccctgggcactctgcattcaagggagtgtttcctactcccttctccatgcctggcaccacaacaaagcatattgttgagtgtaacgtgagaagtataccttttggcaaagacaggacttttatgatggggatagaaccttactttccattatccttgagaattccagacttggctactggtgaaggcttagcttctgtgtatacccttagcctgtgaaaaatggctcaggaaaaggtgagctatacctcttttactgtagcttagtagagcaatctgagggagatatctgagaagcaactgc

SEQ ID NO: 479905 - DNA, 1023 bp, Homo sapiens
aatgcacacattttaatgtccagaaaagttgcgggttttgtatatttgtactagctcaagagttgaggattgaaaaacgttcctaaagggatgagacaacaggaaatgggccacgcggaccccgtggggcggggcggaacctggcagggcgccagtgaccgctggggccagagccctgccgggaaaggagggcttccgccttgcagcgcagctcggatcagcagcagcccaggaggcctcccgcccgtactttcccgcgtccatccctctgtcccacggtcggtgagtcagcggagcctgatggaggccttgggctctgggcactatgtgggaggcagcatcaggtccatggcggcggcggccctgtctggcctggcggtgcggctgtcgcgcccgcaggggacccgcggctcttacggcgccttctgcaagacgctcacgcgcacgctgctcaccttcttcgacctggcctggcggctgcgcaagaacttcttttacttctatattctggcctcggtgattctcaacgtccacctgcaggtatatatttagagccactaactttgtggcatttgggggctcctcgtcaggatggctgacttccacccacctgctcacccaccctagagcaaagcgaccaactccgctcctgcatgcagacttgccactcattctttccattgcctcatcttttagtataaatgggtggcaaaaaaagaaaaaaacagcatttgtggaaagcctgaaatataacccaaatcgtctaagatagaatgaaaaattgactctcaaggaaatatttgaaggaacagaatacagcttaaaaatttgaaaatccttaaaaatatctgagaagtttttgcatccgtaaaacagaaaacagcacgaactttaggaaatgacaatgggcacagaatgcaataaaaaaaaaaaacggggaaagctctccttcgccttctgccatgagtggaagctccctgaagccctcaccagaaggcagatgctggtgccatgcttctcata

SEQ ID NO: 479906 - DNA, 946 bp, Homo sapiens
gagccacagtccttgtgcaccccctggacttccccaaggagggcatgtggaagagaaagtctgcctttctctgggagaatgcagggtccgcgtctgctcaggaggaaacactgggcaaatctagtttggagtcacctctgctctttagatctaccaaggttgtgaaactgagggacagtctcaggaacagttccagaaaaagaaaactggacctgaatggaaaaagacattttttctcccagttgaggcaggtggagtctgaatgttactttagtattaagaggccactgtgtggacataatgttactggccactacaccttggttgtggagaagaaccttgaggtctgtgctgaggaaaacgaaactcttgtctttgaagtgggcttggtgctgaactccataagcggaacacaaggcgcttcatggggtcagaaaaggcgggttcgcgcgccccctgctggccaccagagacagtgcgagattctcagcgctcactgtgtagcggtagccatctcatagtcattttgttaacatttctggtgatgagaataggatccaaagtggtccccaatttcttttcctctactgcctcaatcaatgcctaggtgccagcaaggatgctgtaaggtccagttgaattctggcatggtaggaaagagttgggccctaaatccaaaactgaaaagaactctgtgtaccctcttgttaccctccttgcactctgtcaaggccacttccaccttagtccttcttgctgccactgtcttctctttctgaactgcctttcttctccttgcctcccattctggaactgccctgtttgttgactctgcaacccctttggttgcaccttttaaagtgattgataactctacaggtggtcacactaccttttctacagacttgctgtagttcaaccatttctacttgatgacaaatgtgtg

SEQ ID NO: 479907 - DNA, 494 bp, Homo sapiens
tggccagactgcttttttaagtgggtccctgatcctgtgcgttcaggctggcaacagagccgtacctcactgggatggagctcccagaggaaggaacaggctgccatctttactgtttggcagccttcactgttgccaccttcaggtactggaaaatccaaggtgaccggggactggagtggacccccattatactgcagcattcctatggagaagtggacagacactttgttacatgggtccctgatcctgtatctcttcattcaactggtcctcctggcctgggtctccagccaactgccaccagagctattgagccagcagcaattctgcaacttcccaagacagaactcccaggaccagaggctggtgaagacccccagtacagagcatccacttcatggaaaaaaggccagactcttctttatgcaggtcctgatccacacttctccttactgggaaggaatgctcaatctgggactccagcataacca

SEQ ID NO: 479908 - DNA, 566 bp, Homo sapiens
gccgtagaatataagtgggggtggctggaggccctggatgcccaacacaggcccctgatatgatttggctgtgccttcacccaaatctcatcttgaattgtaaatcccacaattcccacgtgttgtgggaaaggccaagtgggagctcaggccatggcttcagagtgtgcaagccccaagccttccacgtggtgttgagtctgcaggtgcacagaagaattgaagttgggaacctctgcctaggtttcagaggatgtatggaaatgcctgaatgcccaggcagaagtttgctgcaggggaggggccctcatggagaacctctgctagagcagtgtggacgggaaatgggttggatgccgcacacagagtctctactggggcactgcctagtaaagctgtgggaagtgggccactgtcctccagaccccagaatggtagatccagtgaaagcttgcaccatgcacctggaaaagccacagacactcatgccagctcatgaaagcagccaggagagagattgtaccctgcaaagcaataggggtggagctgcccaagacccatgagga

SEQ ID NO: 479909 - DNA, 1346 bp, Homo sapiens
ggcacctggaaaatcgggtcacttccacccaaatactgcgcttttctcacagtcttaccaaatggcacatcaggagattatatcccgtgcctggctcggagggtcccacgcccacggagcctcactcattgctggcacagcagtctgagatcaaactgcaaggccgcagcgaggctgggggaggggcgcccgccattgccaaggcttgagtaggtaaacaaagtggccaggaagatcgaactgggtggagcccaccccaggtcaaggaggcctgcctgcctctgtagactccacctctgggggcagggcatagccaaacaaaaggcagcacaagcctctgcagacttaaatgtccctgtctgacagctttgaagacagtaatcgttctcccagcatgcagctggagatctgagaacggacagactgcctcctcaagtgggtccctgacccccgagtagcctaactgggagccaccaaccagtaggggcagactgacacctcacaaggccaggctccgctgaggatatccaggcaaacagggtctgaaatggacttccggcaaactccaacaaacctgcagctgagggtcctcactgttagaagaaaaactaacaaacagaaaggacatccccaccaaaaccccatctgtacgtcaccatcatcaaagaccaaaggaatgcagctccgaaccagcaatgaacacaggtggatggagaatgactttgacgagttgagagaagaaggcttcagacgatcaaactactctgagctaaagaaggaagttgaatccatgacaaagaaaataaccaatgcagagaagcccttaaaggacctgatggagctgaaaaccatggcacgagaactacgtgatgaatgcacaagcctcagtaaccgatgtgatcaactggaagaaagggtatcagtgaaggaagatcaaatgaatgaaatgaagcgagaagagaagtttagagaaaaaagaataaaaagaaatgaacaaagcctccaagaaatatgggactatgtgaaaagaccaaatctacgtctgactggtgtacctgaaagtgacggtgagaatggaaacaagttggaaaacactctgcaggatattatccaggagaacttccccaatctagcaaggcaggccaacattcagattcaggaaatacagagaatgtcacaaagatactcctcgagaagagcaactccaagacacataatggtcagattcaccaaagttgaaatgaggaaaaaatgttaagggcagccagagagaaaggtcgggttacccacaaagggaagcccatcagactaacagctgatctctcagcagaaactctacaagccag

SEQ ID NO: 479910 - DNA, 835 bp, Homo sapiens
tgagggttattatggtgggaaagaccaaatggaagccattagagctgcctctacctagaaacacaataaatcaaaaacagtatcacatccctggagggattgtgattagtgccaccatcacagacttgacagatgcagcggtggtgattcccactacatcctccttcaactctccaatttggcctgaacagaaaacagatggattttggagaattacagtggattatctgaccgaaaaggctgccagttttgagttgggtccagaacaggagaaggctcttcaacaggtccaggctgctgtgcaagctactctgccacttgggctatatgacccagcagatccaacagtgcttgagttgtcagtggcagatagggatgctgtttggagcctttggcaggctcccacagatggaggaacattgccaccaggagacacaacgattccattaaactggaagttaagattgccacctggacagtttgggctcctcctacctttaagtcaacaagctaagaatggagttatagtgttccctggggtgactgacccagactatcaagatgaaatcaatttattactccacaacggagtctagctaaataaaggtttgacaattttgttaaccctcagttttggttttgttgggtctctgtattattttctattcctcattttgtttacttctgttctaatctttattatttccttctgattactttggttttagattgctatttattttatggttttttaagatgaaaagtcagactattttgaaatttttatcctttttaaatgaagctatttgaaggaatgaagataatggtgtaagac

SEQ ID NO: 479911 - DNA, 1317 bp, Homo sapiens
gctcctcacttcccatacggggtttggtggtacacgtgaaggtttcttatatagtctggctgtagttcatgacttggcacagttgggctgcccactggagctctggggtgatcttagtgcttatgttccttccccagcgtagaggcagcagaggaggagatcttagtagtggttgtgaccaaggtgaagatgaacaggattgggaactgcttaaaaagcagtctgatcctgttttgatagagcagctgcgttgtgctgggggtccacttcagcccttggtcacctcacactctgaagcccaaaggctggaatggggaagtgcaatgctgctactgctagctgactggaattccaagccagtgggtcttatcttggcagtgagctccactctggccctgggtaggtatagaaatgccattcaagagtcaaggcctagaattggggaacccaagagcctgcttggtgctcttcctcactgtggccaagctggtacctaacctgcaagtcaaagtctcctttatcttccctttgcttttatcaagcagaatgagtctctgctcatcgtcaccatagctgtgcatatgttgggtgacacctaaaggtagcatatctctgaatctcacccaaggcccatgctaatgtgataaattgcctctttattttgataatttttatagaatatatcctagaaggcatatttttatcaagtaaaggtataatacaaaaataaaaattttcttgagtgtgctaatacaaccttccagtgttaatgataatcaggactggggggaattaatctccttcctgtgaaatgctgaacacttgtcctgaaaaaatactgacatcagactctagtatattcaatgttttatatattgtggcctatttcctcttttgttatttggataaaactttctttatatgacacccattaatactgcccacagtagaagaaatttctgatttattttcaatctggtactttatgctgccatgacaaataacctgttagaaagaataacagaaaaaataaactaatatttattgagagaatattaaagttatgagattggacccagaaggggtgttcaggcaatacaatatattgtctcagctcaagggtattttatttatttggggagataagatacataaagttccctaacagaacacaatacaggatacattatttgccaaatgattaaaaccataaaatttgtgctataagaattcaaaggaaaggtgatttgctgtgggccagggtggtcagaaaaggctttagataagtagaatttggaccttgaagattagatagga

SEQ ID NO: 479912 - DNA, 1745 bp, Homo sapiens
ctgaataggaacagctctggtctacagctaccagcatgagcgacgcagaagccgggtgatttctgcatttccatctgaggtaccgggttcatctcactagggagtgccagacagtgggcgcaggtcagtgggtgaactcaccatgcatgagccgaagcagggcgaggcattgcctcacttgggaagggcaaggggtcagggagttccccttcctagtcaaagaaaggggtgacagacggcacctggaaaattgggtcactcccacccgaatactgcgcttttccgatgggcttaaaaaacggcgcacagggagattatatcccgcacatggctcggagggtcctatgcccacggagtcttgctgattgctagcacagcagtctgagatcaaactgcaaggcagcagcgaggctgggggaggggcgcctgccattgcccaggcttgcttaggtaaacaaagcagcctggaagctcgaactgggtggagcccaccacagctcaaggaggcctccctgcctctgtaggctccacctctgggggcagggcacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgatccccaagcagcctaactgggagacactcgccagcaggggcagactgacacctcacacggccgggtactccaacagacctgcagctgagagtcctgtctgttagaaagaaaactaacaaacagaaaggaaatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacagaacaaagctggacggagaatgattttgacgagctgagagaagaaggcttcagaagatcaaattactccgagctacgggaggacattcaaaccaaagactatgtgaaaagaccaaatctacgtctgattggtgtacctgaaagtgacggggagaatggaaccaagttggaaaacactctgcaggatattctccatgagaacttccccaatctcgcaaggcaggccaacattcagattcaggaaatacagagaatgccacagagatactccacgagaagagtaacaccaagacatataattgtcagattcaccaaagttgaaatgaaggaaaaaatgtgaagggcagccagagagaaaggtcgggttaccctcaaagggaagaccatcagactaacagcggatctctcagcagaaactctacaagccagaagagagtgggggccaatattcaacattcttaaagaaaagaattttaaacccagaatttcatatccagccaaacaaacttcataagagacggagaaataaaatcctttacagacaagcaaatgctgagagattttgtcaccaccaggcctgccctaaaagagctcctgaaggaagcactaaacatggaaaggaacaaccaataccagctgctgcaaaatcatgccaaaatgtaaagaccatcgagactaggaagaaactgcatcaactaatgagcaaaataaccagctaacatcataaagacaggatcaaattcacacataacaatattaactttaaatgtaa

SEQ ID NO: 479913 - DNA, 721 bp, Homo sapiens
gctgctgcctggaaaatgttgataatgtgttcccatgatgaggctgttctggcccttgttctgttggaatgtggtgtttcttgcactttttcccagcagaatatgataagaggcaggctgtttctcatggcccaaatatccagtgggatgtttcactttgaccaaggagagcccttgatttggctacacggagagctgcgccagcagagaggggaggggctgaggggcttttggggaatggctcgcaaacgcatgagggccaatgggagaagtgaagtccagaccatgttaacctctaaggagagtttgaaggtaccaaacttgttttacggggtgcatgttggtgaagtcgatctgccagtgctgccctgccaggtgccctcgggcctgatgtgtggggaaaggaggtcatttgataatttcctgaggcaagttgaagttggaaatccacagtcagaagtatcccacaaggcccaagaaggagaggaggtcctttgaaggggcatgtcccaaattagctccttgcattgggttgggatggctggagagttaggggttaggacaagcccaaggttgaaattagaggagggattgtccaaaggaggaggcatttttgcgggttttttgttgaggaggaggatttgaaaaggtgaacatgattggtagagagagagagctgcaaacagagataagcaaagcatctcacgtcatttaccattgc

SEQ ID NO: 479914 - DNA, 577 bp, Homo sapiens
agaagaaaccagaaaaacaattctgctcaccagcaatggatccaaaccaaaaagaaatcccggatttacctgaaaaagaatgcggaaggtcaagtattaacttaatcaaggaggcaccagagaaagacccaagaataattagtgttcctgaggaagaagagaaatctaaaagtctgaaaaacatatttgggggaataattgaggaaaacttccctagccttgctggagacctagatgttcaaatacaaaaagctcaaagaacacctgggaaattcaccacaaaaagatcattgtctaggtacatcatcatcaggttttctaaagtcaagacaaaggaaagaatcttaagagctctgaggcaaaaacaccagggaacctataaaggaaaatctatcagaataacgcagatttctcagcagaaaccctacaagttagaagggattggggtcctattgttaacttccttaaataaattatcagctaagaattttgtatgcagcaaaactaagcatcataaatgaaggagagatagcctttttcagacaaacaaatactgacagaatttgccactaccaag

SEQ ID NO: 479915 - DNA, 1472 bp, Homo sapiens
ggccgaataggaagagctccagtctacagctcccagcgtgagcaaagcagaagatgggtgatttctacatttccatctgaggtaccgggttcatctcactagggagtgccagacagtgggtgcaggacagtgggtgcagtgcactgtgcgcaccgtgcacgagccgaagcagggagaggcattgcctcacttgggaagcacaagggatcagggagttccctttcctagtcaaagaaaggggtgacagacagcacctggaaaatcgggtcactcccaccctaatactgcacttttccaacgggcttaaaaaacggcacaccaggagattatatcctgctcctggctcggagggtcctacccccatggagtctcaccgattgctagcacaacagtctgagatcaaactgcaaggtggtagcgaggctgggggatgggcgcctgccattgcccaggcttgcttaggtaaacaaagcagccgggaagctcgaactgggtgagcccaccacagctcaaggaggccttcctgcctctgtaggctccatctttgggggcagggcacagacaaaaaaaaagacagcaataacctctacagacttaaatgtccctgtctgacagctttgaagagagtagtggttctcccagcatgcagctggagatctgagaatgggcagactgccttctcaagtgggtccctgatgcctgagcaccctaactgggaggcactcccaagtaggggcagactgacacctcacacggccgggtactcctctgagacaaaacttccacaggaacaatcaggcagcagcatttgcagtttaccaaaatctgcagttctacagctactgctgttctgcagccaccgctgtggatacccaggcaaacagggtctggagtggacctctagcaaactccaacagacctgcagctgagggtcctgtctgctagaaggaaaactaacaaagagaaaggatatccacacaaaaacccatctgtgatcaaaatatccgagctacaggaagaaattcaaaccaatggcaaagaagttaaaaactgaaaaaaaattagacgaatggataactagaataaccaatgcagagaagtccttaaaggagctgatggagctgaaagccaaggctcgagaactatgtgaagaatgcagaagcctcaggagctgctgcaatcaactggaagaaaggttatcagtgacggaagatgaaatgaatgaaatgaagcaagaaggaaaaatttcatatccagccaaactaaacttcataagagaaggagaaataaaatactttacagacaagcaaatgatgagggattttgtcaccaccaggcctaccctaaaagagctcctgaaggaagcactaaacatggaaaggaacaaccagtaccagccactgcaaagacatgccaaattgtatagaccttcaaggctaggaagaaacagcatcaactaatgagcaaaataa

SEQ ID NO: 479916 - DNA, 685 bp, Homo sapiens
tacgttcagtgctgatgtcccctcttatattcctgattttggtgatgtgtatcttctctcttttgttttgtttcagaaggaatggtaccagttcctccttgtacctctggtagaattccgctgtgaatccatctggtcttggactctttttggttgaatgttgaatattggtccccactctcttctggcttgtagagtttctgctgagagatccgctcttaggctgatgggcttcccattgtggacaggaccctcagctgcaggtctgttggagtttgctagaggtccactccagaccctgtttgccggggtatcagcagcggtgtctgccaaacagtggtttttcgtgacccgcgaatgctgctgtctgatcattcctctggaagttttgtctcagaggagtacccagccatgtcatgagagctccactctcatgattgtgattggtgcccttataaaagaggcttacaggagcccttttgccttcctgccatgtgaggacactgtgaaaggacacagtgagaaggtgccatttttgaagcagagagtgacccctcaccagtcttcaaatccactggtcacttgatcttggatttcccagcctctgaaactgtgaataataaatttctgttgttgataaattacccagtctgtggcatttttgttatgcattttgtttcatggc

SEQ ID NO: 479917 - DNA, 1039 bp, Homo sapiens
caggtagtgattgctgctggagacttccttctccctgtggcgtttctccgcgcctctggccaccctcctgaaggatccctgtgattccaggcaggaatggtctgcttggagacccgcaagctttcagggcctttcccactgcttcctctaccctcatatttcacttggctctctaaattgactcagctccaggatgtggagcatctagaactcttacatgctgctagtggaaatgtgaactggtataatcattttggaaaacagtttggtagtttcttagaaagaaccaaggtcagaagagataaattgacaaaatttagaaagcaagggccaagtgctggtggagactggaaatataggaactctcatgcaggtgaaagtgtagatttgtactattattccagagaactaactgaaagcagacagttaaacttgagtcatgccccatgccccagcaattttgttcctgagtcggtatcccagagaaattctcccatgaattcaggtacagaaagcacagaatgtaaagacaagcctttcactaccgctttaagagctggaggaaaaaaagacatgacagtaaatctgcttcgagttccccgatactaacataattaaccaggtatggctacatattttatttctactatatttgaatatttgcgataacatttcctatttctagaatatactttaatgggaaataacctcagttaattaagttacagggcatttgtgggaggaataatatgcatcataatataccttttcaaagagatacattgagctttagagaaactagaaggttttcaacaacaatgccaatataaacaagacattgtgctgctagaaacaaaggcaactgtaatcttttctactaccataaaatgaatatatacgatgctgttttaaggcttttgggttcaaaataccttctacagatgttaaggaataaaagggctttattcttaagatttgcatgctatattctttaaacattgatttatttttaagatctctgacattcaacaagtacaaa

SEQ ID NO: 479918 - DNA, 684 bp, Homo sapiens
aggaaaaccagagacctttgttcacttgtttatctgctgaccttccctccactattattgttcactgttggcatacagaaatgctactgatttctgcagaggagtctcacaccctaaccactaccaccccaggccatgaggagtactgccagactatcgccaatgttcccttaaggcccaaggtctcttatgtcagcttgtcgctcgcccaaggccctcgatgtacctggctgtcgctgctggttattcaaggcccaagggctcttcagttagcaggtgatgaatgctggcaggactgggttctatccttcagggcagcaggtttccttctggcccaaggtgtgtctataaatgtcattttggagctaggtcctggaatggaggccagaaggaagggatctcttttggagctgcaggctgaactatttcctcattgcaatcagatccatgcattacgggtcaacagcacccaactggtagagacagtaccagaggcagcccttagtccaagagaactaagcagccccttgcatggcctctggattgattgccagtgaggggctgccaaactgtgggtggtacctgaaagggctatcccagatgagcccccaaatttgtaaccacctgacagaatcattttaggtttgttttatatgaaatattcagcattttaagccggtcttc

SEQ ID NO: 479919 - DNA, 555 bp, Homo sapiens
catagatataggctccaggctcactgacatgaacccaggcccctggtcatccatgcacaaccaaccaacagttccacaccaggggattgaggcttcagactcaaccctgtgggcccaggtgtcaggcccacctacctactgtcccaggtgcctggccagcctgcccaaggactctgatggcaatcttgccattggatcaaaacattccaaatttggagaaagatgtgaatatccaggtacaggaaaggcaaagttcttcaatccaaacaagactacaccaagacatcttataataaaactgtcaataattaaggacaaaaggagaatcctaaaagcaacaagagaaaagaagcaaataaagtataagggactttccataaagctagtaggagatttcttagcagagaccttgcaggccaggagagaatgagataatatattcaaagtactgaagaaaaaatcctgctagtagtgtaacacaaaagcatatgaaagtatacaattcactggtgaaagtaagtacatgatcatattcagaatactctaatactgtaa

SEQ ID NO: 479920 - DNA, 504 bp, Homo sapiens
aacattttttccttcatttcaactttgatgaatctgataattatgtgtcttggagttgctcttctcgaggagtatctttgtgttttccttctaacagtcaggaccctcagctgcaggcctgttggagtttgctggaggtccactccagaccctgtttgcctgggtatcagcagtggtggctgcagaacagcagatattggtgaaccgcaaatgctgctgcctgatcattcctctggaagttttgtctcagaggagtacccggccgtatctcaagctgcatgctgggagaaccactactcccttcaaagctgtcagacagggacatttaagtctgcagaggttactgctgccttttgtttgtctgtgccctgcccccagaggtggagcctacagaggcaggcaggcctcttgagctgtggcgatgactcgctctgctttggctcacgcatgctttggcccactgtcctgcaccccctgtccggcactccccagtgagatgaaccc

SEQ ID NO: 479921 - DNA, 533 bp, Homo sapiens
aaagttaatctttttcttagttccatcttttctgctctggtttctccccatctttgtggttttatctgactttggtctttgatgatgatgacgtacagatgtggttttggaccatcagctgcaggtctgctggagtttgctggagttccactccagacgctgtttgcctgggtatcaccagtggaagctgcagaacagcaaatattgcagaacagcaaatattgctgcctgatccttcctctgaaagcttcatcccagaggggcactcacctgtatgaggtgtctgtcggcccctactgggaggtgactccctcattttggtcaaagccattcaacaagtctcttggaagttctactttccacatcttcctttcttcttctgagccctccaaactgtttcaacctctgcctgttacccagttccaaagttgcttccacatctttgggtatctttacagcagcaccccactcttccagtaccaagttactgttattagtctgttttcatgctgctgataaaggcatacctgaga

SEQ ID NO: 479922 - DNA, 862 bp, Homo sapiens
attattctgctaactgcctatatttagtgagtcatttgacctctttgaggtggctacagtaatgccacaaaataatagggaagacaggaaaatgtgggaaagtttggaacttcctaaagacttgttgaatggctttgacaaaaatgctgatagtgatatgaacaataaggtccaggctgaggtggtctcaggtggagatgaggagcttgtttggaactggagcaaaggaatggaggtttgggaacctgtgcctagatttcaaaagatgtatgtgtatggaaccacctggatgcccatgcagaagtttgctgtaggggtgaggtcctcatggagaacctctgctagggcagtgcagaagggaaatgtggggtgggagtccccacacagagtccctactggggcaccacctagtggagctgtgagaacagggccaccatcctccagaccccagaatggtacgtccactgacagtttgcactgtgtgcctggaaaagccacagacactcaatgccagcccgtgaaggtagctgggagggaagctgtaccctgcaaaaccacaggggcaaagctgctcaagactatgggaacccacctcttgaatcagtgtgacctggatgtgcaacatggagtcaaaggagagcatcttggagctttaagacttgaccgccctgctgggtttcagacttgcattgggccttgagttcaaataaaaaatagccagcataaaaatacattattaaatagtattacttcatcaccaatgactcacatggatcaaacatattaattttcccacaatattaactaaattaatctgtgcacagctcatgaaatgaaacaaaaactctgacattgtctatga

SEQ ID NO: 479923 - DNA, 838 bp, Homo sapiens
aactcaagtgtctacggtggtcatgagctatccttctgccaggattccagaggcctttggtgagagggtgttcatgcagtctcagttcacaggattcgacctgacaaaagggtttcctggagtggtcctggaccctgggttttctggaacaggcctagacctgggccctctggagcctcggtttgacctgatgctgacgctggcatggagccggtttctatggggactgctctggagagcaggattgtgggtgttagcctggatcctatgtccactgatgctggcctgggggcttgttgtgcagaattggaatggcagtttccaggagttattgttagccaatgaagttagtaaggacgaatttataacaggatacattcacagagttaccaatgctttctataaaaatgaatctaaggcttttgttttctgtcggagaaaacaaaattctgtctttacccaagaagaggaaattcacagtctaggtgaagaggggacatggatgaaattggaaatcatcattctcagtaaactatcgcaagaacaaaaaaccaaacactgcatgttctcactcataggtgggaattgaacaatgagaacacatggacacaggaaggggaacatcacactctggggactgttgtggggtggggggagggggagggatagcattgggagatatacctaatgctagatgatgagttagtgggtgcagcacaccagcatggcacatgtatacataggtaactaacctgcacattgtgcacatgtaccctaaaacttaaagtataataataataaataaataaataaaattttaaaaaaagtaccaacagtc

SEQ ID NO: 479924 - DNA, 689 bp, Homo sapiens
cttctccttctcctcctccttctccttctcctccttcttctcctcctcctcctttttctcctcttcctcctcctccattctctcatcctcctcctcctccttctcctcctcctcctttttctcctcttcctcctcctccattctctcgtcctcctcctcctcctcctcaggtgttctggggtgatgcacaccctgtggctgttctgggcctccttgcctgcctgttccaggatgttggctgtcaggcttacaggagctgcgactgtgtttgtttccagccatgatgtttgctgggttttgccccggttgtcacagcttgatttttctgctggcctgagtctctcaaggtgccagtgcttactgcagcccactatacccctgtgctccagcccctcactggtcatcagttgccttagtgacaacctccactttgtgatgtcattggtgtccactgggccgtccttttcaaggattgattctcctttctactatgcacttactgaggggctgacccctaggctaggtccaccctacatcatgcaacaccagccatgcatcccaaaccatgcttatcctcccatgctccctccaacaatacatctcccaccagattttaccttacgatggatgcaccctcatctgttaatatatctcacctacttcttcccaaggagagaaagtctctaaaa

SEQ ID NO: 479925 - DNA, 677 bp, Homo sapiens
agtgcactacgtgcttaaccttgaggggccaaagaacacagccatgggcctggtaccaacaccccagggattgaggtactcacacccatggctgtcaggtgtgactgtagctacaaacactcatctgagtcctttctccaaaatttccttcagccataggaaaacctctcacccaatggcaacccacatcccgtcattccccctccccagtggcaacccacatccagtggatggtcaatgcagggatatgaaggttgatcagtgtcctgtccattcactaattggaagattagtgacgaagactgggcaagagacatgtggatggagctatggaagtgagcataaaagggaacacagcaaaaagagttccattaaacttcaaagctgtggctgcttcccaggtgtttcaggccttttgtaccaagaaaggagcaggaaaggaacaggcagtatcctggcaggggaaatggaccctgatcatcatgagcaagtaaggctaaggttgtacaaaggaagaatacatttggttccaagatgatccactagatgtctcctcatattctgaagcctaaatctaatggcaaatgggcaaataactaattctccttatttgagtgttattggggtaagataattccgtatgtgttttgtgttttaaatacattaggctaataata

SEQ ID NO: 479926 - DNA, 579 bp, Homo sapiens
gccctggtcctatggaaaagacagcccttttctctccaggtctagcagcttacatatgtacaattacattttctactacaagaagatgtactacaagaaggaaacatgatgattatgaggaagacacagatcaagatcaagccctctcctgtcttgattcaataacagaacaatctagcattttggatgatgcagacacatatggtaattttaacaatttaagattctggtataatcttgagatccatagcactcctggaccacccatagagattatggaaatgacatgtattgctctgcctgaaatggctgaagagttctggtatttactgaagttaactattgaattaccaaaaccaaccacaatgccagaaatacagtgcgaccttggcaagcttagggacaagcagagttcaggggctggtgggaaggagagaaacctggcaaactttcctcaaggtgaagcagaggtaagcaatgaacaactgtgaacatttgttattcgtatgttaccttcacaatttttggcatacctttgtatcacctatataataatttaaaggcattctaatggaaaac

SEQ ID NO: 479927 - DNA, 850 bp, Homo sapiens
cagtgtttgccaggtgctaacagatgacggtagggattgactacaaaggtgcagcacgttggaattttgggggtgatcacacttttctttatggaaatgtgatggcagatgttatcccttctgagagatggatagtaaattttgacaaagacctttcagatggtcttgtttttgcaacacagttgggagcctattgcccattcttggactctgcacaaataactcccaaatttctgcagaagtctcacataacaccttcatacagttctgtctggggctggctgagtggcgtcttttcttgtgcttctctttttccagaaggtgtcaacttgactggattgaaggatgccaagatgactggcaacgttttgtttctaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagccacagacatctgtgacccaaatccaatcctgatgctcatgctttgtgtctacatgtatgaaagactccctacatatctccctaagaaggtggtgtcctttgaatgtactctacatgacacggtgctgaataaggaaaagcaggaatttacagccaaggagcaggatggagatcagtgggtgggaaatgactaagaggaaacatatggattctactgaaaaattccagctcgcgaaacttagtgtataatgctagaattgttggaagagatgctgctgacttctccctttcccaaaaagggaatgttgtgacaatttctccaaggcat

SEQ ID NO: 479928 - DNA, 817 bp, Homo sapiens
tctctctctcttctcttctctctctctctctctctttctcattatagagagaatgctatgctttcatgtatgggtctgatttctctgaagaaggaagagcaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatctaaaggctgagaagtccaagattaaggtactggcaggttctatgtctgataagggctgctgtctgtttccaagatggtgcctagacgatgcacactccaaacaagaggaacactgtgtcctcacgtggcagaaggcacaaaagagataaactccctccatcaaagaacaatgtattattcagcagtaaaatgaagtgagctatcaaggcatgaaaagacatggagtaaacttatagatgtattactagtctttctccatagcaatttttatcttgatactgaaaatattttacttaatttccagtttattgttcacttatgtagaagttatatcaagtattatatacattactttatatcacatttcatgtgactcataactattatatgtgactgatcttataatgatttagagttcacatatcttcataactcaactacctttacaagcaagattatctatgtctgcattaaagaatatacctcattgcatttcagaagtgtttcaaaacaaaattc

SEQ ID NO: 479929 - DNA, 1329 bp, Homo sapiens
tgtccctgtctacacttcccaccatgcttgctgtgttatggttggatgctccagagatccaggcaagtgcttgctatgctcagctgttcttcatccacacattcacattcctggagtcctcagtgttgctggccatggcctttgaccgttttgttgctatctgccatccactgcactaccccaccatcctcaccaacagtgtaattggcaaaattggtttggcctgtttgctacgaagcttgggagttgtacttcccacacctttgctactgagacactatcactactgccatggcaatgccctctctcacgccttctgtttgcaccaggatgttctaagattatcctgtacagatgccaggaccaacagtatttatgggctttgtgtagtcattgccacactagaacccttgcgctatgcagccatcctaaccaatgatgtaatcattgggattgggttggcaattgctggaagggccttggctctggtctttccagcttctttcctcttgaagaggcttcaatatcatgatgtcaatattctgtcctaccccttctgcctgcaccaggacctcataaagacgactgtatccaactgtcgagtcagcagcatctatggcctcatggtggtcatctgttccatgggacttgattcagtgcttctcctcctctcctatgtcctcatcctgggcacagtgttgagtatagcctccaaggcagagagagtgagagccctcaatacttgcatctcccacatctgtgctgtactcaccttctatacaccaatgattgggctatctatgatccatcgctatggacagaatgcttcctcaattgtccatgtgctgatggccaatgtctacttgctggttccacctctcatgaaccccgttgtctacagtgttaagaccaagcagattcgtgacagaatcttcaataaattcaagaaacatgaagtgtagatgacagagattctgaaacataactttccctccattccccatatatttattttatgagaggtcatctgagctttgctaatttggatgcctgtgtctctcccaacatctggaacattttcagacactatttaccaatgcttttttgtccctttctttctctcttctcattctgggaatctcataattcttgtttatctgtgttctcttgcatttcatcaaccctctttaagctgattattttgagttatttgtcaggtaatttgtcaatcgccattgctttggggtcaataactgaagttttagtagttttctttggtggtgttatgcttgcttaattctttgttgtgcaggtagccttgcattggtg

SEQ ID NO: 479930 - DNA, 3450 bp, Homo sapiens
cctgtaaaaccaaagacaggaagtatgctacaaatgaagactctgcacaaagcctcaaccctctggaaacatcgagaaaataattatactgactgtactcaacctatattgcagttaaagggacacctacacacagagatgggaaagaatcaattcatcaaggcagaacagaccctccgggagcccatgttctactttctggccatcctttccacaattgatttggccctttctacaacctctgtgcctcgtacgctgggtatcttctggtttgatgttcatgagattaactttggagcttgtgtggcccagatgtttctgatccatgccttcactggcatggaggctgaggtcctggtggccatggcctttgaccattacgtggccatctgcaatccacttcactacacaaacatcttgacatgccgggtgctgaacgagagaagtgaggaagatgcagaagaaaagtttgaagttagcaaagtcacatttttcctcattggaatcccaggtctggaagacttccacatgtggatctccgggcctttctgctctgtttaccttgtggctttgctgggcaatgccaccattctgctagtcatcaaggtagaacagactctccgggagcccatgttctacttcctggccattctttccactattgatttggccctttctacaacctctgtgcctcgcatgctgggtatcttctggtttgatgctcacgagattaactatggagcttgtgtggcccagatgtttctgatccatgccttcactggcatggaggctgaggtcttactggctatggcttttgaccgttatgtggccgtctgtgctccactacattacgcaaccatcttgacatcccaagtgttggtgggcattagcatgtgcattgtaattcgtcccgttttacttacacttcccatggtctatcttatctaccgcctacccttttgtcaggctcacataatagcccattcctactgtgagcacatgggcattgcaaaattgtcctgtggaaacattcgtatcaatggtatctatgggctttttgtagtttctttctttgttctgaacctggtgctcattggcatctcgtatgtttacattctccgtgctgtcttccgcctcccatcacatgatgctcagctaaaagccctaagcacgtgtggcgctcatgttggagtcatctgtgttttctatatcccttcagtcttctctttccttactcatcgatttggacaccaaataccaggttacattcacattcttgttgccaatctctatttgattatcccaccctctctcaaccccatcatttatggggtgaggaccaaacagattcgagaacgagtgctctatgtttttactaaaaaataagactcttaccatgttattttactaagggctttgatccttctataaagaccgatatgttcttgccttaaggaatatctcctgatccttaacttattgctgtcaacttgcaatacaagttggtttgttcctggatgctgactaataatggattttaaaactgtcagaaacatcattgtagttgaagttcaaagactgaccaactatcctggaagggatatcctgggagagaactgtggggcctttgactgcatgaccttgtgaagaatgcttgttagcacaggctgctgcttttctggggaaagaacatattttactgagtgttttttgactagtgatgagagatatgtggcactggaaatttaccctgtaaactactttatttattcctttaatctttctttccttattttcttcctttctttcttttttccttttattctttttctcttacttctgtttattcatgcatcatgcattttatgattcctttaatttatattcattcaatgtctggccctatggagcttgcattctgttgtcctcttacaaagcaaatttcacgggttcaaaacaatctttgccaaatctgtagcttcaagtggaatcatatgccaaagacatgacactcagtgcaatgatagccaaaacaaacacacaatttcaaaactatttatcagtaataccagcataacttatcactgattgcttttcggaattcatgaccataacataagcaccagttaggtatagcatttttacgtctgtgatatgtggaggtctttgcctatcactttttccagtattctctcaatctatatttgaccctaaaagactctatttcaaaatccaagacctctctttccaacctgtaatctgtcatttgttctcccacagactttaatatagactatgtcatatctagctatggatagccacatttcacatgatgctgaaggttttcaatttatttaataagatttccaaagaccaagcaattaattaccttttgaattatcaaacttgtcacattgttttttacaattatactcattttgtcttatgtaggttattaaaaatataaagcaaaaatgtaacaaatagctttgttcctgataccaaaaattaacaactttttatattgcgctcatctcaaagaggatgtttaaataacatgcacacagcatgaaagctaatatcacctttaacactgccccagcagatttctctcccaatttccagaggcaaaggctagcatgtgtgttttctgatttcacattgcaaatttttagatttacaaccaatcacagtatttttgttaatcatttgttatttgtttatatagattaatgtactccatgttttgttttgtaacattgatttcatttatatttttattttctaatagataattcatcttattatttttaattacaaaacatgctgcacatctttgtatttatttgtttctacattttaagttaatttatccaggttttattctttaaagtagaattcttaggttgctaaatttatagatttcactgactttttaaaaatttttattaagaagtttaattattaaataagcgtgcttaaggataacattttttttaagtggaccaagactcatgattggctgaacttcagaaggttaaatgtatacactcatcaaaggatttcaggcttaaaatgcattcagtacaccacattgaacctctcaatactctagaacatatacgtaagcaatggaaaattttttttttgcacagtcatttgttattctccagagtttaagctaatttatggaaaagccagaaatcaaaaacattaacaatcatttatgtaacaacaacttgtattagttgtaccatttgcaaaatttaaacaaactgtcatcacaacttttcacatatgtaaataaaaacatcaatatcttactgttcacgatatcttataacacctgtccaaacatccatcaagttataaagagactgttttagattaaaccaaagatttatttgacgagataaaacatttggttgtcacttctgcaactttgtgttg

SEQ ID NO: 479931 - DNA, 1220 bp, Homo sapiens
ccaggtggattttcatcctgatatgcatgggaccgctagtgagtttcacccctcctccttcctgttgctggggatcccaggactagaaacacttcacatctggatcggctttcccttctgtgctgtgtacatgatcgcactcatagggaacttcactattctacttgtgatcaagactgacagcagcctacaccagcccatgttctacttcctggccatgttggccaccactgatgtgggtctctcaacagctaccatccctaagatgcttggaatcttctggatcaacctcagagggatcatctttgaagcctgcctcacccagatgttttttatccacaacttcacacttatggagtcagcagtccttgtggcaatggcttatgacagctatgtggccatctgcaatccactccaatatagcgccatcctcaccaacaaggttgtttctgtgattggtcttggtgtgtttgtgagggctttaattttcgtcattccctctatacttcttatattgcggttgcccttctgtgggaatcatgtaattccccacacctactgtgagcacatgggtcttgctcatctatcttgtgccagcatcaaaatcaatattatttatggtttatgtgccatttgtaatctagtgtttgacatcacagtcattgccctttcttatgtgcatattctttgtgctgttttccgtcttcctactcatgaagcccgactcaagtccctcagcacatgtggttcacatgtgtgtgtaatccttgccttctatacaccagccctcttttcctttatgactcatcgctttggccgaaatgtgccccgctatatccatatactcctagccaatctctatgttgtggtgccaccaatgctcaatcctgtcatatatggagtcagaaccaagcagatctataaatgtgtgaagaaaatattattgcaggaacaaggaatggaaaaggaagagatgctggagataaaattttgactatgtcaccttcccttactttgtggaatttatagagtctaaaattaatgagcaacttcaactttgaaatgtccatactttttgttttaattgttctatatcattataatttatgtttatcttcccttaagagacacagcgatttaatggtaatggggtatcctaaatgggatgctggattagaaaaaggacattggctaaaaagtaagaaaatcttaataaagta

SEQ ID NO: 479932 - DNA, 880 bp, Homo sapiens
ttcctgctcaaccctcaacctgggcgcttcactattctacttgtgatcaagactgacagcagcctataccagcccatgttctacttcctggccatgttggccaccattgacttgggcctttcaacagctaccatccctaagatgcttgggatcttctggtttagcctcagggagattatctgtgatgcctgcctcatccagatgtttttcatccacaactttactggcatggagtcagcagccctcgtgggaatggcttatgaccactttgtggccatctgcaacccgctacgatatagcatcatcctcaccaaaaaggctgtttctgtgattggtcttggtgtgttagtgaggtcatttatgtctgttattccatttgtttttctcattttgcggttgcccttctgtggggatcatgtcattccccacaccaactgtgagcacatgggtcttgctcatctgtcttgttccagtatcaagatcaatataatctatggcttgggtgctatttcaatcctatgactcacaatgtaactcacatgtctactcaataaatgtcagctgaatgaattgatctagtttaaaataagaaattcatgtgttcataattactcatcgtatactacaagaaagttggtattaaatgtatcaattggttcctatttatcttttctttctggaaggaaggaagaaggaaggtaagaaggaaggaagggaggaaggaaggaagggaaggagggagagagggagggagggagggagggaaagggaatatcagaactgcagtgtgggaaatcagtaacatagatctttttagcctggtgtcaaccactatcattgtctttttaaaatttctctcaagtttccttatttcaacaaa

SEQ ID NO: 479933 - DNA, 668 bp, Homo sapiens
cacgaaaattaactgcactagatgtggctcatccacacatttcaaggcattgaatcaggagtcctgctagccatggctctggaccgctgtgtagcgatctgttatcctctgaggcgtgctatagtattcactcgacagctagtcacttatattgtagttggagtgacattgcggcctgccattctggtaattccatgcctattgcttataaaatgccatctgaaactctaccgaaccaagttaatataccacacttactgtgaacgcgtggcccttgtgaagcttgccactgaagatgtttacattaataaggtctatggtatccttggagcatttattgttggtgggcttgacttcattttcatcaccctctcctatattcagatatttatcactgtctttcacttgcctctgaaagaggcacgacttaagattattatttttaagcttttcactgaagtatatcatacaattagaaaagtgcaccaatcctaagactatatttttctctcccctcccctcccctcccttcccctcccctcccctctcctcccctctcctcccctcccctcccctctcctcctctctcttctcttctcttctcttctcttctcttctcttctcttctcttctcttctcttcttttccttgagctcaagtctcactct

SEQ ID NO: 479934 - DNA, 877 bp, Homo sapiens
cctttgatagtgttgcattaagaccttcgtcttcaaagttgccacactgtcttccacaatgattgaactaatttacagtcccaccaaccatgtaaaaacgttcctttttctccacaacttcaccgggatgccctgccagagaggagtaatctggctgtccggccacagcagccttgctgaactgcagtgggctccacccagttcagacttcctgactgctgctgtgttggcagcaaatttcaagatcgtagcttgcttggctccatgggtgtgggaccagccaagccagacaacttggctccctggcttcagcacccctttccaggggagtgaagagttctgtctcactggcgctccaggcaccactgggaagataaacccggtgctgcctgaggcaacagtgatggtctcctctgaggcagttgagaggcaagataatgttgattctcctcaggagccacctacaacatccctgtttgcttctagacctataactagattaaagttctggctggcccctagaggagaggttcagagtgtaattcacaagggtgtgtgtgacactcgaaaaaagctgcttaaattttttaatttatataagcagaaatctagagaacaggcatgggaaaagatattaagggtttgggataagggtggaaggaacatagagttggatcaggctgaatttattgatttgggcccactacataagcactctgcatttaatattgcagctctagaagttaaaaaatgttctaaaactgtatgtgcttggctagctaaaatatggattaagagatgggccacgtaactgagctggaaatgcctgatctcccttgatttaaagtagaggaaagaatctaaaggcttagggaga

SEQ ID NO: 479935 - DNA, 766 bp, Homo sapiens
ttgagtcctgagagatcatctttgatgatagtgatgtacagatggggttttggtgtggatgtcctttctgtttgttagttttccttctaacagtcaggaccctcagctgcaggtctgttggagtttgctggaagtccactccagaccctgtttctgcgtatcagcagtggaggctgcagaacagcagatattggtgaacagcaaatgttgctgcttgatcgttcctctggaagttttgtctcagaggagtacccggtcgtattccatttggcacaagaacttggtaaggatttgttggaacctaaaagaggttctgagctatgaacttgttccacttggttgtgctccaaatcaccagccagtttactcagctttcggtaacagaaagaagcacaacatcaccacagctcaaagagcatgttgggccaaggcaaaaatcctggaattggatgaactaaatcagaaaaccgagcactggggaagaagttccatgaaagttgcacgggagtgaatgagttgtaatttgtataataggagattagaacaggcagaagatttgttggtacgaatatgaagcgctgttgctggaatgaaaaaggcattgtcctcttattatttattctattttaattgctcctttaaagtgatgctttggtacctgaagtggtgtatgattaaaaaataaataagagtgatactttcaaattattagcaacatctgaaagtttctcttcctatatgaactggttaactatactgaatattt

SEQ ID NO: 479936 - DNA, 496 bp, Homo sapiens
cggaatcaaagtagtataccaataggcttattggtatacccaggatgaagttgaaaaaggactacgggtactgtgcttttcccatggtttttgcaatctgcagatcaaaagattccctcgtgtgcctacaccatcaggggtctgggtttcaaactcaaaactgggtggctgtttggacagacactgagctagctgaaggagtttttatcatacaccagtggtgcttggaaatccagcagttttccactgacagtgctaaggaggatgggaggtttggactgggtggaattcagcacagtgtggcaaagcagctgtggccagactgcttctctagattccttctcactgggcagggcgtctctgaaggaaaggcagcagtccgattcaggggcttgcagataaaactctcatctccctgggacaaagcacctaacggaagaggcagctgtgcttacagcttcagcatattgaatctttcctgtctgtcagaatgatt

SEQ ID NO: 479937 - DNA, 1727 bp, Homo sapiens
gagaaccgagtgattagtgagcatgatgaaagtgagctttttcagtagaggatggtggaggaacactgaagggaaaagaggcattccttccatttccagcagaggcagggtgagtgagtggtgtgggcaaggcgatcagttggagctatgccacaaccactggcccagaactcaaggtccctctgtgaccatgcagcctccatctggcaatgatctgtccacagtcgtcttaatacagaaaccagggccccggaggcttcctatccacaggagcaacagcgcaattcctctcaacactcccacactccaaggcctctcacctgggcctgtgcacgtgaaggcttctctcctggcccagagctctgattccctggactgtaaaccagcaccagcctggctaaccagacaacttctctaccaaaccagtggactgaactacaacttatgccatgagagatccttccaactgtttccttccttgcgtactttcccctagccctatggtgtcatatcaaggttccataaatctcagagttgatcatagttgaattatttgtattaaacttatcctgtttaacctatgtagttcctatcttttgattagacccatgctgatttctgatggcattattattagtatattttaacttactcattctctgtcactcttttgccaatatattggtttgtaaatcttatatgtgtgtgttgatgtatgtatatgcatatacatatatcatctagtagtgatacttttgtctaacaatttatgtataagttattttgggttttctagtccataatcaaatcacctatcaataatgacagatttgtttcttcatttgtaattcttacacttttattattcttgccttactgagtaaattaagatctccaatagaatcaagggaaactatttctcaatctcaaaaaagaaagctttcaatatttcaaaatttagtggacatttattaaagttattaaagatgtccttcagttaagaaactttctttctcttcatagatatctgaaaagttttattatgaatgcagtttgagtttattggacacttttttactacatgtactgaaataatgatatgatttccatgctttggattaatatggtggaggacactaatttatttcttaatgatagaccgtcttggtcttgatatgttactttgttcatacattgttgaatttactttgctaatattttcttgaggattttccatctatttccatgagtgtgattgatctcttattgtcgtttatttttgtgtccatcatcatattcactttcaaaattttactacatgatataaataggaaaatgttctttttttctcatatattccttagaagactttgtataagattgggatcattttcttatttaatatttgatgagcttagaggatttcatttttggttttaattctttggggaaacttttttaaatgacccatttgtttcttttaataactataggtctattcttgattttcatattgtcttgagccaagtttgttatatttttcaagcatttgctaattcatctacactttcaaaaatattaccacaacgtatcacatattttctcatcatctttatcactgagacacattatgcatatacaaaatgtgaataatatataaatatgcatataaaatatgcatatacagtcctatatttcaaacagtgtatgctttctctttcaaattt

SEQ ID NO: 479938 - DNA, 1792 bp, Homo sapiens
gtcaaactatactacaagcctacagacataggcatgggcaaagacttcatgacaaaaatgacaaaagcaattgcaataaaagccagaattgacaaatgggatctaattaaactaaagagcttctgcacagcaaaagaaactatcaccagagtgaacaggcaacctacagaatgggaaaaacattttgcagtctaccgatctgacaaagagttaatatccagaatttacaaggaacttaaacaaatttacaagaaaaaaaacaaccccatcaaaaagtgggcaaaggatatgaatagacacttctccaaagaagaaatttatgcagcctacaaacatgaaaaaaagctcaacatcactgatcatcagagaaatgcaaatcaaaaccacaacgagataccatctcaggccaacatgacatttaagtcatccctgaattaacatgtcaggaaacaatagatgctggtgatgctgtggagaaatgggaatgtttttacactgttgtccatcaaatccttgctatggaatatcacgcactcctaaatccaactgctcctttgacattctttggccacaaccttaaaataaatggccaccctaggatagatggggttaaaaccacaaaaaaagagtcttcttggcatgctagagtggctgcagtctaggaggctttctggaaaatggaggtgattctccagaaaatggaggtttgtttttctggaaacaaaatgtcatggttgtcaggttactgataaggggactattaggaaaattgggtcccaaatttattcgtaaggcaagtaggggtgcaggacgtgaaaagaaggtgggtttccctgtatgctgggtgtaatggcctaattatttctactacatgcaaaatacaacactgcttcttgggttcctcaaaatactcaggccctgggcactgaatagtgtgtgcacggatgagggctgtcccccttagagtgatgattggtaatgataggtgattcatgaaaaaaaaaaagtacagaaggttacagggcagaggatggcaaagggacaggttggagaatctgttttttttaaaaagttatctggttggtggtcaaggactggaggtggagaagagtggaggggttgaagaggattgtcttctctgtgaaaagggttttataggttatttctagtatagcacactcttgtgggaataaatgttcatttgaatttttgtgaaattctaaaaatagtttctaacattcacttggtaaagaattcagtaactttccaagtgaatatgtatattgatcaataggttcccaatccatttttacctaaatggtagcacactgtacaaactactctgtaccttgctcttttgaattagcactgtaaccatagacaaccagaaaaaaacctaagtatttatcaaagtgggcaatggttaaaagaattattctatatccatgaaattgagtatcatggagatattagaaatggtgatgcaatcatatattgacattaaaattatattcatcttctaaggtcaaatgagaaaagcagcttttgaaacagagatgtgtgtgtacacatgcaaatgcatagttagaagtttagagagatataaacacacaaaaattgttgactgaacatctctgaatgatggcattacagatgatatgtttccctattttatgtgcattttgtaatgtttgggatttgctaccatttggttcattacatatttaatttttaattatgtaatactttcacagaattttttaaaatcagcaaataacaaaaggtatagatt

SEQ ID NO: 479939 - DNA, 1168 bp, Homo sapiens
gccagcaggattggccacttgttgaatgtgatggggagaggcggttccaagatggctgaataggaacagctccagtgtacagctcccagtgtgagtgatgcagaagacagggtatttctgcatttccaactgaggtaccgggagattatatcctgcgcttggctcggagggtcccatacccacggagcctggctcattgctagcacagcagtctgagatcgaactgcaaggctgcagcaaggctggaggaggggtgcccaccattgctgaggcttgagtaggtaaacaaagtggccaggaagctcgaactgggtggagcccactgaagctcaaggaggcctgcctgcctctgtagactccacctctgggagcagggcatagctgaacaaaaggcagaagaaacttctgcagacttaaatgtccctgtctgacagctttgaagagagtagtggttctcccagcagggagtttgagatctgagaatggacagactgccttctcaagtgggtccctgacccccgagtagcctacctgggaggtaccacccagtaggggcaggctgacacctcacacagccaggaacccctctgagatgaagcttccagaggaacaatcaggcagcaacatttgctgttcagcaatattcactgttctgcagcctccactgctgacacccaggcaaacagggtctggagtggacctccagcaaactccagcagacctgcagctgagggtcctgactgttagaaagaaaactaacaaacagaaaggacatccacaccaaaaccccatctgtatgtcaccatcatcaaagaccaaagcaatggaacaaagctggacagagaatgactttgacgaattgagacaagaaggcttcagacgatcaaacctctctgagctaaaggaggaagttagaacccattgcaaagaagctaaaaaccttgaaaaaagattagtcgaatggctaactagaataaccagtgtagagaagtccttaaatgacctgatggagttgaaaaccatgacacgagaactatgtgacaaatgcacaagcttcagtggcctatttgatcaactggaagaaagggtatcagtgattgaagatcaaatgaatgacatgaagtgagaaaagaagtttagagaaaaaagagtaaaaaaaaaaaaaaac

SEQ ID NO: 479940 - DNA, 1616 bp, Homo sapiens
ggtgatgttccttgtgatttaggccaggtgatcactggcaaaggagagggtcaagttcctcactctcccatggtagtattgtgctgccttatcctctagagggtgcaaatcctcttctccagggtcctctcctccttctggttgtccgtggaggttgggctcccacctcctctctgtgaggcatcctgctgtgcatatgggaatggcctcagcctggcatctctgcctgatcagctcatgtacctggcatagtggtccccaacatatcgatttgccaagtgatgatcctactgaccaattccctgatcactgccaaaaacccatccttatcaccccatgtagcaagtttgaagatttcagggctgatccaagaaaagacatgatcatgacatcaggagacctcctgagacagtggcatggggccactgcccaaaaagggaagagggcaatggaactcctggtggagaagggaattggagaaggcgttatgtgtcaaggtgatgtggctcagcagcaagatggggagtctgtgtcagagagctctgaggggcagcagcagcttggtgtcttttatagccccagaatttgttttatctatggcaggcagaggctaggtgcagttttgcagggtatgcaaagcagggaagttctgaatggctaaaaatattacttgggctatatttaaagcaattgatgtgtaagaatttgaatttggcaccagcctgctgtgaagaagtgaacaacagagtcaatatacagggaccatctttggttcatttatgtaacaacctttaattcttgcaatatgaggcagaggtcaagattattttttccaaggctattcagttgctccagcaccaaaagagtatctgttccccgttgaattttactgtggcctttgttgtagttcagccaataatctatgtgaagttctatttctagattgtttattctgatccatttatctatttgtctatccttgtcccagtacttgactgtcttatttaggcctttacattctttcaataatattttgtaattttctctaccgtgggttttgtacatattttgttaaattttttcctagtttttttttggtacatttcttgatgttctagtaagtagccttaaagtttcattttcttattgttgttcctgatatgtagaaatatagttgtatgtatacagttttatgtgttgacattttatccaatgatcctgataagttcacttataaattgtactagatcatctgaagatacttttaggcttttttacattcacaaaaatgtcatctgcatattatggcagttttatttcctccttcctatcctttacatttttaatttctttttcttgatgattgcattggctaggacctttaatacaatgctgagcagaaatggtaatagtaataacagatattctttccttgctcttaatctatggagaaactttcactcattcaccattaactatgatgtttgctgtaggttttatgtagatactctttgtcagattaggggagtttattgggggaaccaacccccaatatttcaacgtaggttcttttctattttccctaagtgtcggccgctctgaaaaataaagggaaa

SEQ ID NO: 479941 - DNA, 828 bp, Homo sapiens
tggagcctacaacagcacacatctcagcacgcatctcagaggacaggtttcaggccaccggaggaatttaggagtgagaactgcaggagcgatcttatccctcgctgtttgaacaagcactgtgggccaatggccatggcccaggagccgcagggccttcatggactgagccagtggagatcagctttgagcttccgggcttcaagtctacagcccgcttctgatgcatttttgaatgctatatggacaaacacgggcattttgaagcaggagaagtgggccatctacaagctaagaagagatacctggaagagatctttccctctttctactcaaaaggaaccaacccagctgacactttcatttggacttccgtcttccataactgtgaacaataaattcctgctgtttaagccaccagcaaaccttcagacagtttggcatagagagcagggtcaccaaagccagtctgctcttctggaacctgcagttaagggaatgcaggaaactggcaaactggcaaaggagagggttacagggagaaagttcactctcatcttgatctgtgttcttgagagcttgatttgtgagcaagaggaaacactctctcttgctctccaccatgcaggggaagtgatttttgagtcacagcaggcgtctggtgtaggaaatctcttcgctgggaagtggagagattttgttttgttccgagtgtgccaagctctcagcagggtttgtcacaagaagtcccgtccagaaggggctttgtcatctctaactttattgcctagggcagggatcaccaacccataatccagggaatggtat

SEQ ID NO: 479942 - DNA, 733 bp, Homo sapiens
tagatagtggcatctgaatttcgctaccagcaggcagtgcagaactcaacatccacctggaaaagatgttgagcctgagcaccagtgccaccacctttcaaggatgctatgcttggtggtccggctgggttgggctgctgtcatgggaacccaagttacacagcccccctaacacatcagttttgccagaaggttcaggccacagggctgggccatcatctggacattaatcccccaggtgctgaggaagttgctgaggcaaagaaaggagcagcaaggactggaaagactcaggctgtttctcttgcaggtcagagtgctcctggtgccatgaacggagacgacgcctttgcaaagagacccagggatgatgctaaagcatcagagaagagaagcaaggccttcgatgatattgccaaatacttctctaaggaagagtgggaaaagatgaaattctcggagaaaatcagctgtgtgcatatgaagagaaagtatgaggccatgactaaactaggtttcaacgtcaccctctcacttttcatgcgtaataaacgggccacagactctcagaggaatgattctgataatgaccgtaaccgtgggaatgaggacaggccagattctacaatctcccacaatcactacaagaggtctgaaaatccagtgcttgagtatctgccaagcttttgactttaaaggagtgtctttatactgaaaatgtttcagagccacc

SEQ ID NO: 479943 - DNA, 545 bp, Homo sapiens
gattactgttggagatggagccttggtggccacagagccagcaagtcttgcctcaccagcgaacagtgaacaggggatctgcccataccgtgagtgatcactcctgcttgtggggcacagagaaggcacccagatctgagccagccagcactctgccccaagccaacattacctccgaagtaacagcctacacagtctccagcagtggccccctgctccctgctccccacagctgctttgcctctgctgcagtgctgctgcaccttgatccccccagtacagtagactccaaacatcaaggagccagagaacaaagttggggcccaatacaagtcccccagagatacagcatgcagtccaggggttgggagctgaacattggccccctagtatcttccagaaacgaagccagatggatgaatccaccttataccacaatcaaacccccaaggtcatcaaataggataaaagaaaaaaaacatccaaaggtcagcaacctcaaaagttgaaggtagagcttgaggactgcctttctgaagtaagac

SEQ ID NO: 479944 - DNA, 860 bp, Homo sapiens
tctacttgccctgattcccatggttacggtcattatcagaatcattcccctggaagtctgcagcccgtttattacgcatgaaagaaatctgatcaccccacactgtcccctgggccactgctctgccccctccaggtctcctcaccttttgcatgttctctggtatttgagaaccaaccctgggtctccttgcaaaggcgtcgtctccattcgtggcactgggagcaatctgacctgcaagagaaacagcctgagtctttccagctgcaggacctttggtcctgtggagggagaaatcagtgaagtccggccacactcagtcacctggaatcaggtgttgcatttctccatccagggcttatctgtccagtccctggatgaaggacagagcccgaggttgggacctagtcagaaacaggactcagaggagcccgactcaagtctggtcaaaggacagtgactctgtctgaaagcataagcaagaaagtcaacagcagtaaaatgaatgggtcacaaaggagaatttttgtgcattgctaagcaggactctgctttaaccattgtgaaagctgattatgtgaagtgagtcattcttaattgtttttaagttcttatttgtggaggaagccttcagtatttttcttaaacaatcaaattcacttatatttatcatcactttcccattccaatttctattagagcaacttgggtttgtttgtttgtttgtttgttttctcaagctcagggtgtaggaaagaaatgtacttggaatttctttctgactggtatataggcttgaaagaaaagtcagtcccaccagagacctacttctgacaaagctgtattcacaggctagagtg

SEQ ID NO: 479945 - DNA, 589 bp, Homo sapiens
agctaatccttgccatttgatagttgaaaatatctcatttcttttgtgtgtgtttgtcaatgaaattgagtatcttttcatacaaccagacactctgcttctttcctcggggcctgggtaacctcaaccccaaatcaggacagtttctaactctgttccacatggaggtaagtttcctgtttcctgagtctaagaaaactgcagtgtccattctgggagattatggcttaaacaaccttgccctccatgtgtgggagagtagggcccagcagggcttcagtgggtccccagtgctgacttaccatgacaatccatgtggcagaggttcttgtgatggtggtagcgatggtattcatgatggtaacagtggtgatgatattgattgtagtgatggtgttgatggcagagatggaggtgatggttgtgaaggcaataatggtggtggtgttagagttagttaaactactcagcatagtcagtcagggagtgactcaagggatcatgcccaggcctggagagatgctgtcccaggaacacccccatttcctggagctctgtccctattactcccaaacactagctgaagtta

SEQ ID NO: 479946 - DNA, 556 bp, Homo sapiens
taaagaactgggtaagctgcactaggcgttcacaaacagcaggagagggttattttcaactaccaaagatatgacaatttacttgaaagcggaggctcaacttctggtgctgaggagcactggcatcagaggcaagaagctcttccacccttgggaattaaggggatggtgcccagtgtgtgggggcagtagtggtggtggaggtttcacagtcctagactcaggtggagtaaggaagaacaaaattgcagatatgatagacacattcagtgctctcttgacttttggacagtatgagttttgcagacaaaaacgtgaagtatgtgaacttggggaggccagtggagaggttaaccgaattcctctcagtctccaaagacaaaccagatggtcacatatctcggaagatatgtgggatgtaaacccagcagcctggccccagagcccatggtcttcatggcagcagcatgtgtgccgcctctcatgtgtacaagtgaatgaagaatgaaaggggtgatggcctgttttcttaattcattgaaatttcaaaatgatt

SEQ ID NO: 479947 - DNA, 650 bp, Homo sapiens
aaagtctagcagttccctggcagttctgtccagacgctgaaatggggctcaggaaacaagactgggagagtagtacctatgctgctcctgtatgctgccacttcaatgaaagttgctgtctaacaccactggcttaccaagaactttccctggctaagccccagttttggggctcaactgccctgcatcatttggcaaccaatgaagggataaaggcagtgaaaatggcagcaatggatggagagacagctccatctgaggatcccctccttgctggttctcctagaaggcctatgcctttcccagagtctccccagtcccccaattctgaggggggtcctgccagtgctctaacaaaggattctagctcaaggtcatcagacactcctccccctcatccaactagccccagcttatacccccatttcccccaaaataagcccaatcaatactaccaggagtggagcctcatattagcccctaaagtaaaatctgtgtccattgcaggagctaaaggaccctctcccagtggccaccagcaccaccagcccctggggaattctgctagaccaccaccaatgttcacttaaagttcaagggctcttcatttagcttctggtgaatgctgccaggtctgtgactcacccttt

SEQ ID NO: 479948 - DNA, 958 bp, Homo sapiens
tctgctagcgcaggggctatgacatgggcccacaggagatacctgggggctgcactgcaagcaggcatgaccaggctggggccccaggagaggccaacagactgaggggtgttcaggtcagaccagccgtgtcttatgggcacgattgccctgcagcgttcaggtccgacagttcccctaaggctaaagtcttctataggagtgagtcaagcctagggagatgggcaaccatggccatgctccactacagatgctcctgtaccaaactctctgggctccactccagctggagttctgcccctgccagttctctgagtagctctcactgccaattcaagtgtccatggtggtcaaggggtcttctcctgcagggattccagaggcccgtggcgagagtgggttgctccttgcctgttcaaccccttccccaggagtcactggggaccaggaatgacctggtgtatggtagccctgagcagcgttcccagcttcctcctgcttccacccagtatctgtatctcccttctgtctgctctcaatgccttccctcaagatctgctaggagtgtgctagtcttcctgatgccctgtccctttgtgggagacattccccctggctgtatctagtcggccatcttgcgcccttttttatttctctgcgtatctttgattggacatttattttcatttttcatatgcatgtaccggtcctcggcctaagaatagaatttctgagtcataggtgaaggttattttccttggtgttatgttttaatttcttatcttttatttttttgtgtatccattgtatgacttttggtttaaggttaccatgagactttcaaataaaatcttgaaacctattattttattcttatgtttgcagtatatgcttgtttgtgcccatctttcttgggaaggctttccaggtatttgaagagccttgaatgttgtgatct

SEQ ID NO: 479949 - DNA, 1241 bp, Homo sapiens
actgcactgaggtgaaggagcaggcagaagacaggagagtgcatgttggcaggaggggcagagggcactcagggattcttaaaagatatttcatcaaaatgccgaagtgtgcgagagcatatcctccctcacatttctgcacatttgtgtcaagtggtcaaacagttcctaagcaacggtgcggaggcggttgctaggctggcttgtcacgtgtccacggattcagccgctaaagaaatggcttcttgtcttgcccacttcctggaaaaaaatcacaggacattctgccaagactcaagtcagacttcagttaacaccgaaagactcaccccggtatccaaaagaaaggaaataatcttaccggacaccatcccaattaccctgggttctgtggactcactaggcatgggggtgaaggatcccggtcaccctcagtcttccgttgtcagcgccagcagtgaagagatttcctcctgtgatggtcagggggctttattatgagccgcacccaaacggggagggtgtccctgttgggggcagtccactttccagtgtccccaaagaccacaagttggacacggtctggtgggggaccagtggttaggacaagcctttgcccagtgtccagagttgccacgtcggaaacagactcccagaggggtcgggtagttttcttttgggtcattgggaggcttttgtgtaactggcttttggatagcagaggcaagcatctggctttttaatgagagatgtttgtctttttgaattttttgttcctcatctctgttgttaaagacacagaaggctacatttaggaggtcctgccgggatgtctggggaccctcctctaagttttgtaattttttccagatatctggggcagattgggaaacaaattggaggtggagaaaagtttgaccttctctagattctgggtccaaattggcatattttagcatagcttcagtgaggtgtgataagggcaggattttcttggggctcttgtgtaatttctctaagtttctcataattaactgccttatgggcatttttgtccatacccacaaggagacagctaatcatgtggtctcttcatctgatgccattgtctccctgttggatctggtagtgcattaatctagttaccaaaatgataccactcataccacgcttggattagtaacttttcaaataatttggaaacaaacaaaaaaaccgtttaacattaaaattgaaaataa

SEQ ID NO: 479950 - DNA, 1411 bp, Homo sapiens
acaattaattcaaactaggatttgtccaatgccattcttcttactaatatgcaaagtcttcaacacccgaatccttcagccattttataactctgagtctaaccatctgcatgaaaagctgttcacagaggattcaggaatttttctccccacaaacgaattttttgcctctatcacaactagtcattccttaataactgtgacaatgatgctctacttccttatattcccgggcttctttctcctctgggtaccagctccttactgccctgcagacaagcgtgccgtgcgtgcttgtggccaagggaaggaagagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagatacacacgtttaagactcagtcttttcat

SEQ ID NO: 479951 - DNA, 988 bp, Homo sapiens
agcatctgtgatgccccctgaggacataagggtagccctgaaatctgagaactggctatggttctgttctgtctgcagttttataagtcttacaactgcatgcaaggggaaaaagaagaaaactgcccaggatttctgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgatgtcaaaaaagtgataatgtttccttggatgacaaacctaaagaacaaggctcacaatggcattgctgcctccatcatcaatgccttagaaaggcattttcacaccaattcacagcttgactatactggccccgaaattgtaaactgtttctgtagtgaatgtgggtattcagacaaatggtaacatcccttttattttgaattgtaggaac

SEQ ID NO: 479952 - DNA, 1017 bp, Homo sapiens
taagaaacaagtttgtgatgatgcattggaagcaaagacattcacgcagccgttcaccggaaccagttttacgagaaaggataaatcctccgcacagcccccagagggtggtgctcagacaggatgttaaaggaagggcctcgatgtgccctggcctgtttggttggttctgcaaggactttagctctgtgtcttcctggtgcagagcatctgatgcctgagccagcccaggccctgaagcacaggagaccccagcccccagacataagactcttaggtcaaacagaaaatgtcctctctaccaccatcattgctgtcaacagcatcatcatcatcatcatcatcatcatcatcatcatcaagggatggtgttcagtgaatattcaatggattctggtgacatttacattgaaatggttacatggttacattaatgataaattacctcttcctaagagcataaacttgaactgcttttcaaaactcttgcttctaactaaagtttctaaagtaaaatatagaacaatgaccaagaaatgtgaaaggagagtaattgcagtcaaagaggaaaagggaaaaacaactttcgacatggaaaattcccaccaggaaaatgaagaaagtgttcataacgtagaggaagagctacatttggaagaaatggaaggccaggaagctagaggaaataatctccaggaacaagcaccacctacccaggaagatggagatggcttgccccataggcatgtcaataacaatgaagggagagggaggaagaggatgaggaggaggaaggagatggggaggaggagaaagaggaggagaaagaggaggagaagaaaagtgtccagaagagatttttaaaaattaagaaataaatttagagtaatgcatcggatgaaaagacagtccaggaagtggccttatccaattcagtgctttttgtcttgaattattttttcttatatttttagggcttcacttttattttaggttgcattttctagtcttactttc

SEQ ID NO: 479953 - DNA, 570 bp, Homo sapiens
gtgtgcgtggaaatggcctccaggtgcgaaactaagcacagagaaaagtggacccgcccctgccctaagaggccactgctgccagctggaccgctcacaaagggcgcaaacaccaccaccagtgtgaacaggcacacagtcgccgtctgggccctgtcaccgcccggcccccacagccgcgctgtcaatgctagccgctgctgcgaaggcccgcacagaggccagcaacacaacacccatcagtaccctgtcgcagcagatgaaaatgaaaccagtcaactgaactataccacaatgaaacccgcaaggtcatcaaataggataaaagaaaaaaaaaacatccaaaggacagcaacttcaaagattgaagaaacatcaacacacaaagatgagaaagaaccaaatgtgatggctgaaatgacagaaatagaattaagaatatggataggagcgaagatgattgagatccaggagaatgttgaaacccaatcaaaggaagctaagagtcacaattaaaagatataggggccgacaaacaaaatagccagtatagaaaaaaaatgtaaccaa

SEQ ID NO: 479954 - DNA, 603 bp, Homo sapiens
ctctccagatgtgtccctgcaggcataaaactttcagttgctgctgatggagatgaccactggcagcccaccaccttggccaagttagagtagatggccagtggctcccgcaggcagcaaaggaagaaggctgtgtcaaaatgtctgctgctgctgtgctccagtaatgcagcacccagatgtcaggaagaagaggcacctgtccagatgagcccaggtggcttctgcctttgctcgccttctgacacctgcatggtggttatctgccaactgtgccctgggcctatgccctttcagtctaaactcacactggtagagctcctagaggtcatcaagcataattgtcttcatgttaaagcccgagaagtggaggcccagagtggtgtggcgagcaggggagaggacgatgacaaacctaaggtcacatggcaagtaaggcaagcccccaggagtaggacagtatggaaggaaacacttggtcctaccagatggactcctttcccaagccctgagtagggagaatcatgaaggccttgccaagctttagagatttagaagctgcctccttgacccaagactgaagagatatgaaaggccctccag

SEQ ID NO: 479955 - DNA, 484 bp, Homo sapiens
tttactacctgatgcgggggcagtcaaatcttaaagcaccacaatgatctcctttgactccaagtcttacatccaggtcatgctgatgcaagaggtgggctctcatggccttgggcagctctgcccctgtggctttgcaggctacagccccccatcctggctgctttcacaggctggcattgagtatctgcagcttttccaggtgcacaatgcaagctgtcagtggatctaccattctgggagtccccaggctctgcccgctgaacccctaggacagggtctcatggtcccaggaccatccagtggccacctcactgacttgcctcctcaatctgccctgacatccaactcaaaaggtgccattgacagatctgggcagctgtgtccacagtgtcctggagcctgtgagggagtgggaggagatctgggaagccagtacaggggttgggtaatgaagtgtgatcactctgtcgtctaggaggga

SEQ ID NO: 479956 - DNA, 2855 bp, Homo sapiens
gttttcaggatcactcaccttcctatgtcacaacgcttacttgcctacccaaatcccccagcagagccccttggaccccagcctttccccatcaaccttccttcccgtaggtcagactccgctggttgatgaacggcatccccagtctctggatcatcgtcttactgagaccgaacaatctgataacaaacccatcatacaatctgaaatccctctgcttcagctgtgcccatcgcattttggtatcaagctgcagctctggtgaatccattgaacccattactgctttccagtgtcctacctgcaggtatgttatctcgctgaaccaccggggcctggatggcctcaagaggaatgtgactctgcagaacattattgatcgcttccagaaggcttcagtcagtgggcccaattcccctagtgagagccgccgggaaaggacttacaggcccaccactgccatgtctagcgagcgaattgcttgccaattctgtgagcaggacccgccaagggatgcagtaaaaacatgcatcacctgtgaggtctcctactgtgaccgttgcctgcgggccacgcaccccaacaagaaacctttcaccagccaccgcctggtggaaccagtgccagacacacatcttcgagggatcacctgcctggaccatgagaatgagaaagtgaacatgtactgtgtatctgatgaccaattgatctgtgccttatgcaaactggtgggtcgtcaccgagaccatcaggtcgcatccctgaatgatcgatttgagaaactcaaggtaagggatctggggagcatcccctatacaactttgtcgcataaatgcagttagcaagttctctaataaaataggtgacttttcctatatgacaagtgagttaactttaagttgttctcatgaggaataacctgctctcctgcaagctcttcctggagcctatctcatctgttgcataaacattcttgcagtcacacacttctggctaacttttggggagtcagctcatggcctgcaacaccagtagttcatccagggaaacacaccctctatcttctgtcagtgacatattgcttattatatatctttgctatgatctttccacctcttcttttaagtatgtgagtacttgtgtacgtgtactacaattagcatatgtgtcgatttgcatatgtaggtatatggcaatgggaaggcagggtgtgtctctgtgtaggtgtgggtggaggtggctgagtgtatctaggtaggtgagagatttttgtggaggacattattgtatgtttgtgtttgtgtactcaatacactaaagaaacaaaagtttggcattggccattacaaattgccattaagcctttaacatagggctaattctaagcctgcctttaaaaacaaaacaaaacaaaacaaaacaaagaactgaagaaacttcagtataccacgaaattgggagggataattaaatatctgaatgaacaatttaaactgaaggcaataaatattttatccagtatcaaattttgtgacagtgctcactattatgggctacaaactgaagcatttgtttatagttcctgccttacaagttcctagtcatttatgtgtattcaatggacagagttttctaaagttgttgtgtcatataatatgtatgtacaagtctaagtgcccataaaaagtcctcctaccttacactgatgatccagcgaattgttttattcccattgcttgtctgctatgttgtataatttctcttaagaagggagctacttagcatatattctagaaaaataaaatgtttaaacggatagtaaaattaccactccaaatagaacctgagtacataagccaagctagaagaaagacccagataggataaaaggagggcaagaagggaatggagattttcctcctgccatgcagtggatgattcattgtaacttctgtaaaaagtataatgttggtgagagtagcagtactcagaataggatatatttgtcctgtaatttgttgcaaataatattgagagtagtcacaatgactatggtttgtgcctcttttggttattatttatacctgatatgtataaatgtgtagcaaattcaatttttttatttcactcaagttgatactctcattcatatcaaggctgcagagggaaataatcttgttaacttcagttcttagactcataagatattaggcctttgacttggtctagtcgaagcgctctactttaaagttgtataaacagaccttgatagatgaagtgacttggtcaaaatcaaagaaatgattagtaatgggaaagctagaactgggacttagcctctagattgagtaactatcctttgtactgtagccggctgccactttgttttggatctaagttttccccatgaaatgtgatttgaaacttaactttatgctcccacaactgtacatttcgtggtcatagataaatgattaatgacatcaaggaagggacagattgtataaacttacagctgtataatggcaaaagataggagcggggttataggaagagtgggggatgtgaagaggacagaacaatctctgccaaatatttgcaggtgttgggactataataagtcattggccttgagaaatattccaaacagaaaaatctgtgtccatatgcactgttgagataacaaaaagactggctagtgtaagcttgtattacagaaaactagctatttgaaaacatccgaaaacatgatgattgattagatatttggcatcatgaagctatagccctcatctccagggatggatggaacatggacatattttaccaagatatattttagtctgtgactaatc

SEQ ID NO: 479957 - DNA, 2237 bp, Homo sapiens
gagaggggggttcccatgtctctgaaatgtcctggagacattttccttattgtcttggtgattaacatctggctgctcattacttatgcaaatttctgcagccagcttgaatttctccccagaaaatggagctttcttttcttgttgggttgcaaattttacaaatttttatgctgtgcttccccttcaatgctttgccgcttagaaatttcttctaccagatactctaaatcacatctctcaagttcaaaggatggcagagtggaagaaaattcttgtataagtgggcacatgcagttcagacctgttgttcaagggtcaactgtaatctgtaatgatgaaaaaatgatcagcagctgccagaaagtgagggattgggagatggggtgaaagagttttaactgccaaggagcatgaaggaacattttggggtgacaaaaatgttctacacctcatttgtggcggtagtgacttgggtgtatacattagttgaaacttattgaactgtgtgcttaaaactgatacttttattgtatgtgaagtattgatcaataaagttgattgcttttaaacaaaaactaaattaaaaataagactccaggcaactctaaatattttttggaggccgtccagtgctgctagctaaattaagtctctctaactgcatttctcaagcctactgaagaatatgtgtttatatgtgtatatatatgcatatgtgtatatgtacatgtctatgtgtatgtcaatatgcatgtgtgtatatttatgtatatggtatatatacatgcatgtatatgtatacgtgcatgtatgtataggtatatgtgtgtgatatgtgcatatacattcattatgtgtatatgtatatgcatgcacatacatatatgtgagtgcatgtgtatatgtatatgtgtatggtgtgtgtacatatgtacatgtgtgttacttgtatatatacgcatatatatgcatgtgtctatgtgtgtatagtatatatatgtttatatgtatgtatatggtacttgtatgtgcatatatgtatgtgtgtgcctcttaataggtacatgtttagatatatgtgtatggtataggtttttatatatgtatatgtgtgtatgcatgatgtatgtatatgtgtgtatgtatatttatatgcataggtgtgtatatatgtgtatggcatatatgtgtgtatatatgtgtatggcatatatgtgtgtatatatgcgtatggcagatatgtgtgtatatatgtgtatgacagatatgtgtatatctatgtgcttgtgtgaatgtgtatgtttttgcgtatgtgtatagcatgtgcattatatatgagtaaggggactgagtgcagtggctgacacctgtaatcccagcactttggaaggcctaggcaagaggatcatttaaggacaggagttcaagaacagccttggcaccatatcaagaccccatttctacaaaaaaattttaaaatatacatataaattagtatgggtatatgtatggtgtatgtatacaggtatatatgtgtacatatatgtatatgcatatatgtgcattatgtgtgtatatatgcatatatgtgtatatgtctggtatgtaaatgtgtaaatgtacatatatgatgtgtatatgtgtatatgtgcatagtatgtggatgtgtgtatgtatacatatggtgtttatatgtatatgtatatctatgtgtatacatgtgtgtatcacatataaatatgtgtatatctatgtgtgtatgaatgtgtaaatatttatgcatatgtgtatggtatatgcatgcatatatgtgtatgtgggtgcatgtctatacatatgtataagtgtacagcgtgtgtatgtatacatgtgtatatgtgtggatgcatacgtatgtgtgtgtgcatgtgtatatatgtatgtgtatatgtgtgtatggtatatataagtgtatctttataaatgtttgtgtgcaaatgtgtatatatttatgcatgtgtgtatagtatatgtatatatgtttgtatatgtatatgtgtgtgcatttgcatatgtataaatatgtgtataattctgagaaaagtgctcttttgcagaattatacatatatttatacatatttagcaagaaaaagctaaattagagctgaatgctgtgacgcattcacagttgtggttgggcacattcaactagacagatttttaaaaaaacaatactgcatggagtccaaacct

SEQ ID NO: 479958 - DNA, 633 bp, Homo sapiens
gcacctcatgcattagagctcagaattcacaaactgattgcgggaagagatggaggagaataatgagccagggtctgtttgataccagcctcctggggctggatgagagttgccattactggacccagttgtgtatattaaatagagttgctgtcaagtcaatgaagtacaagaataaactaatacagaaaattggtatcaaggagtgggacattgctataaagatacctgaaaatgtggaagcagctttggaactgggtaatgggcagaggttggaacagtttggagggctcagaaaaagacatgaagaccccagaatggtagatctactgacaacttgcactgtgcacctggaaaagctgcctatgaaagcagccacaggggctgtatcctataatgccagagaagcagagctgttcaaggccttgggagcccaccccttgcaccagtatgccctagatgaatcccaagaggacccacagaccatccggaggaagtggactgttcctgcaggacctgggaggcaccccaaatactttgagtacccaagctggggaagtgggaaagggagatcttccactcccgaacacacacccccactagggaaactgaaggtctagtttgagggagaag

SEQ ID NO: 479959 - DNA, 486 bp, Homo sapiens
cacagcacagctgctctatgaaaatgcagccagactgctttttaatgcaggtccctgggcccgttcctcctcatggggtgggatctcctgaccgtggtccccagccactcccatcagtgtgtttggactggcaacaggaactagagcagatcctcagcatactgcagcagccctacaaaaaacctggccagactgtttgttatgagggtcccgaatcccatatcttctcactggaggatctttgtggcttgggtcttcacccaccccctgggactatcaagccggtagcatttctgctctggagagtctgcaggcccaagggcttttctggacacccagaagagcacccacctcatggaaaagtggtcagactgttctccacacagtttccagtcctcaattctcctcactgggcagggctgcctgacctgggacgccaggaaaaccattctgcccctacatgaccacttcaatcagaaacagctc

SEQ ID NO: 479960 - DNA, 463 bp, Homo sapiens
gtagataaatccatgaagatgaggaaaaaccagcgcaaaaagtctgaaaattccaaaaaccagaattcctcttctctccaaaggatcaccattccttgccagcaagggaaaaaaaactgtacagagaatgagtttgatgaattgacagaagtaggcttcagaacatgggtaataacaaactccgctgagctaaaagtgcatgttctaacccaatgcaagcaagctaagaactttgaaaaatggctagaggaattgctacctagaataaccagtttagaaaagaacataaatgacctgatggagctgaaaaacacaacacgagaacttcatgaagcacacagaagtatcaacagcccaattgatcaagcagaagaaaggatatcagagattgaagatcaaattaatgaaataaagcaaatatgggactatgtaaaagatgaaacttacgtttgattgctgtacc

SEQ ID NO: 479961 - DNA, 726 bp, Homo sapiens
ctcctccttcctcttccactgtgattgtaagcttcttggggtcctcaccagaaacaaatactggcactatgcttcttgcacagtctgaagaactaatcactgatgtgcaggcaaatcatatccagagtatggtaaagagccaccagaagacagaggagcctcaccccatggccatcaccactacagtcccaggggtagaattgccagactacctcttttgttctcttaaagcccagaagctcttcagtcagcttgcggtgaatgctgcctggccttggactcacctttcatggcagtgggctcttctgtggcccagacccagtccaggaatgctgtccaagagccaagccctggaattgggcaccccaaaaactggcttggtgctctacccttctgtggctgagctggtacctaaaggccctagggctcttcagttagcaggtaatgaatctcaccaggactgggtctttccgttcaaggcagtagcttcccttctggcccagagtgtctctagaaatgtcatccaggagctagtgcctgaaaaggtggcctcaggactttgaccgggggaatactttcaactttccaccattcagtataatgttggctctgagtctgttccatatggcatttattattttcagtctgtaagtgtctttacaggaaaggaagcctggctaaaagttcatcaattttgattaatgtttccacttcaaactatactat

SEQ ID NO: 479962 - DNA, 692 bp, Homo sapiens
tgactgcaacacttctccagcaagggctcagagctaggctgaggcagagatgagtgaaatgacagaagtagacttaagaatgcagataaaagcaaaccttgctgagctagaggagcacattgcaacccaatgcaaagaagctaaggatcatgataaaacaatgcaggagcagaagccagaatataagatactccaagaggagatcatcaccgagacacataattgtcagattctccaaggtccaaatgaaagaaaaaatgtaaaggacagccagagagaaagcccagagaagtttaatcatctgaagccttcttctctcaacttgtcagagtcattctccatccagttttgttccattgctgggccctcagctgcaggtctgttggagtttgctggaggtgcaatccagacactgtttgcctgggtatcagcagcagaggctgcagaacagcgaatattgctgaacagcaaatgttgctgcctgatcgttcctttggaagcttcatctcggaggggtacccagccttcccatgcagccactctatggctgttaatggagatattcatttacattcaatgtcattattgatagcttgaatgttattggtgtatagacatgctacttattttgtgcattgattttgtttcctaaaattttactaaagtctttaccagttctaggactctttcag

SEQ ID NO: 479963 - DNA, 859 bp, Homo sapiens
gtgttgctccagtacgtcgaggaccttctgctaggacaccccacagcagtcgggtttgccaagggaacggatgccctactttggcacctggaggactgtgggtataaggtgtccaagaagaaagcctagatctgctgacagcagtgctcccaaggacaagacttgcaattataagtttccactgctcccaaatttgcttcctggagcctctggaccaaatggacagacagacacccactggcagcatatggggcacttatcaaaactgaagccctggtggggcagagaaaattaccctatggaccgagattcctgttatgccctggaggacaatcagattccctactgctggctgcaaatgacctccaacatttatgcctatgctgttgttctgccctttccttacctgagaaagttcctaccttcaccaatgtcaattatacctcgattggtggatcaccctatccctggtaatccacaccctactgctggcagaactaacaacgttcttcttggactgccaataacacctgcaaaacctatcccacactcatgggaacacatcaatgctatttattattggcaatcaacaggaaactcaagcacaatgcacaacagtcacagcaaggaggaacatgcaattgccaactacaccaaacgtgcctatagccttagccacagcaacatataaaatggtaaatctaacctaatgcagggcttgcttctgccaacctgattttagaaaatatagtgtaatacttcttccctggcaacgctgcatcatatacctcacttatttagatgagccgattctcctaaccgttgacattcaataaccttatccagagacttatctcac

SEQ ID NO: 479964 - DNA, 659 bp, Homo sapiens
catcaactcgaatttcttctgcatctctgctttatatttaacaatgttcaatataggccctcaatctcctatggcctgtaatgtttttgctcagtggtccactgttattctgatgtgctttgtaggaaactgcaccctcctgctgaattcacacagaaacagggaagctgggccagagactctagcaggcccgccagcctggctacaagtggcagacacagatgaggtcatgtgctctgatctccaggtttttcccatgacaacaggaagctgctccctccagctgagctcacatagaagcaaggcttctggaccagaaggtctagcaggcattgcccccgctggctaccagggtcaagggcaagtagtcttgtgctttgctgtccaggtgcttcctgttacaacaggaagctatgacctccagctgagctcacacagcagccagtccactgggccagagggtctagtaggctttgcccatctggctaccagtggctctgatgttcagggtgtgtttcccatggcaacaggaagttgtgccctccagctgagttcacacaaatgtgggactgctggctggctggctaccagtgccagaggtggaagacgtggctggctgagttcatgctgaatcaggactactggtccagaagctggca

SEQ ID NO: 479965 - DNA, 764 bp, Homo sapiens
tgtcttcattaacgcagaaacaatggttccttacccaccagtagccaagctgggacctgggcccagaaggatgctgtcaatggtggtggcagcaatagcagaagcagcagctctggtagcagcaggagctgtagccacaggaacaaggattccctgtggtggaagcactgggactggtgacaggagatggacttgcctgtctcttaagccagaccctatggaatctacacaaatattaactctccattctgagtacaaggacaagaacaacttgcattcaggcattaaactgtctcaggctcttcctcgagctcttccttgtccactttgcctagtgaccaccactgtcttctgcctggggcagcaaatgatttgtgtcagcggaagaggcccaagttcatccattgctctccactcccagggcacaaaggctcttcagttagctggtaatgaatgctgccaggactgggccctttccttcaagggagtgggttcccttctggcccaaggtgtgtctagaaatgttgtctgggagctagagcctaggagggctctcacaactgcgactggtgccctgtctgctgtggctgagctggtattctagatgcaagacaaagtcctacccagtcttctctcttctctcctcaaggggaaggaaggggtctcatttggaaccacaagctgtgcagcctggggttaagggagtagttatgctagcactcccttggctgccccagctggtgtcttaagatgaaatctcactc

SEQ ID NO: 479966 - DNA, 692 bp, Homo sapiens
gcaaaatgttggtatttacagtgagtgcctcctattggctagacccagcgggaagtcagcctgggaaagagcctgaaggggtcagtttcctcctctgtcaataccaaaccaagatgccctgccatccacaccgggtcacctctgaaggttgtttcctttactgtggggctgaatccatgactgaatgctatcccagaaaataccccattggcttggatctggcactcagttctggggcggtgaggggagggcaagagagagggcgtcttttcaggcagcatgctgagactgacactgccgcagcttcctgtgcttcctgcctgggcagaggtgcccagggtattttaacctttgaccaccctcttactgaaaacttcaactttcatgtcctctcattcattgaatctgcttggcaaaactctttgccttcttcaactatattcctgcagaaaaccatacaaccacttgcaggttggaactgctgtaaattcacattcttcaatttcaagcatgtcctaaatagtgtcaaacaatccttctatgcatccctaagatcgttcccagttcacacaaaagataattcaacctgtcatcactttctttgagattactacctcattacctctactgtcattctcatattaactcactttttaccttacaaagacatttggagcaatcaggtagaattt

SEQ ID NO: 479967 - DNA, 583 bp, Homo sapiens
aatacaccatggaatactactcagccataaaaaggaatgaaataatggcattcgcagcaccctggatggaatcagagaccattatcctaagtgcagtaattcaggaatggaaaaccaaacgtcgtaagttctcatccgtaagcaggacaggatggcacatgaagtgtggggccaagagcattccagacagaggaaacagtgtgtgcaaaggcctcgaagccgaaaagagcttggatgttgaaaggcagaactcctggagaaatgccagtggattgaagttctccgaccctttttacaagaaaacacatgaggagtatctgtccagagaggatcatcagaagagagcacgccaagggaaaccctacctctataaactcaagcatgtgtttatccaaatgacccctgagggcagtgattcgaatgcatattccgagatgcttatttatcagtggagctcataatctggaagaggagacagatgcgcacataaataacactaataaggatgacactgggaaacgctggaatagaagtgcaagcaaaaggctatgggaatatggggaggggaaaattaatttcaacc

SEQ ID NO: 479968 - DNA, 769 bp, Homo sapiens
ggaaaatcacctactaaagcctcagtaatggtggatgcccctacccctaccaagctcgatgatcccaagtcgacttcagactgttgtgctggcagtgagaatttcaagccagtggttcttagcttgctgggctctgtgggagtgggacccactgagctagaccacttggctccctggcttcagcccccttttcaggggagtgaacggttctgtctcactggggttccaggtgccactgggcatagcaccaggtcttactcaaggcctgccgtgaccactctccggctatggcctatgtttgttcaaggccctggaactttacaatcagcaaattgcaaagccatccaggcccttttccttccctttatgatgggcccaagagcccttcagttagcaggttgtgaatcctgccaggactggttccttcccttcaaggcagcaggtcctcttctttcccaggagcccagaaatgctttctgcaccatgctgcctctgctggaagatgagtgaggggtggcattggtgattcaagactgatttttgtacgccttcagtgcctcttttggcaatatgaagttaaaatcagggttgtcatggctattcagactcctttttggttccatatgaattttaagatagttttttttctaattctgtgaagaatgtcaatggtagtttaatggaaatagcattgaatctataaattactttgggcagtataactattttcatgattgatttttcctatccatgagcatgaaatgttttt

SEQ ID NO: 479969 - DNA, 687 bp, Homo sapiens
acctgactgtgaactccttgagggcaggattctgttttattcatgtttgtatccacagagcctaactcagggctggctcagatttctgtgctgcatattgtcagtatccacagtgaccccagaggagcctgtgctggcaggagtaatgctgtgaccaacatgtttgataactgctactctagtccagtggttctcaaagagtggccccagaccaccaccaccaccgccatcgccatcatcatcatcatgcctgggaacttgttagaaacatcagtcctcaggccccactctaaatctactgaattagaaactctggggatgaggcccagcaggttctgttttaacaagctttccagccttaatggtaacttgattcaaaatggttccttacaaaatggaacaaaccgccctaacagacctttgtcttcaaatataagaaaagaaaaacttacactgaccagtcatgtctataagatgtctaaagagccagatttacttttctgagtattgcctgtaaatggaattatataacatggagcctttgtgtacaacttctttcacttaatataatgctttcaaggtccatccatgttgtagcatgtataaatactttatttttattgctgaataatattccattgtacggagatatatcacattttgtttatttaccaattgatggaccct

SEQ ID NO: 479970 - DNA, 9074 bp, Homo sapiens
ccacggaatggaatgcactcgaatgcaatggagtcgaaactaatggactggaatagaatggactcgactggtacggactccaatggaatggaatcgaatggaagggaatcgaacggaatggactcgaagggaaaagactgcaatggaaaggtctcgaatggaatggaaattaatggaatggaatggaatcgaatgaaatggagtcaaaaggaatggaatcgaatggcaagaaatcgaattgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactgatgggattggatgggattggaatgaaatgtactggaaaggactcgaatttcatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaatgtcctctaatggagtggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaacaaatggactggaatagaatggactcgactggtacggactccaatggaatggaatcgaatggaagggaatcgaacggaagggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaatggactcaaatggaatggaatgtcatgggatggcatcaaatggaatgacatcaaatggaatggaatcgaatgcaatggaatgctatggaatggaatggaatgcattggaatggaatcgctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtgtaatggacaggcctggaataaagtggaatgctacggtctcgaatggaataaaaatgtatggaatggaatgcaatgaaacggaatcgaatgtcatagaatgtaatggatgcaaaaaaatgaatccaaaatcattgactggaaaggctgggtgtcgaaaggaattgactccaatggaatggaatcgaatggaatggaatgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaatggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaatggactcgaatggaatggaatgtcatgggatggcatcaaatggaatgacatcaaatggaatggaatcgaatgcaatggaatgctatggaatggaatggaatgcattggaatggaatggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaagggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcaaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaatggactcgaatggaatggaatgtcatgggatggcatcaaatggaatgacatcaaatggaatggaatcgaatgcaatggaatgctatggaatggaatggaatgcattggaatggaatggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaatggactcgaagggaaaagactgcaatggaaaggtctcgaatggaatggaaattaatggaatggaatggaatcgaatgaaatggaatgggattggatgggattggaatgaaatgtactggaaaggactcgaatttgatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaatgtcctctaatggaatggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaagggaatcgaacggaatggactcgaagggaaaagactgcaatggaaaggtctcgaatggaatggaaattaatggaatggaatggaatcgaatgaaatggagtcaaaaggaatggaatcgaatggcaagaaatcgaataatggaatcaaatcgaatgaaatggaatggaatagaaaggaatggaatgaaatggaatggaaaggattcgaatggaatgcaatcgaatggaatggaatcgaacggaatggaagaaaatggaagaaaactggcaagaaatggaatcgaaatgaatggaatgggattggatgggattggaatgaaatgtactggaaaggactcgaatttcatgaaacggaatggaatgaattggaacggaatggactcgaatggaatggaatgtcatgggatggcatcaaatggaatgacatcaaatggaatggaatcgaatgcaatggaatgctatggaatggaatggaatgcattggaatggaatgaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaattcaaatcaatggaatcaaatcaaatggaatggaaaggaattgaatggagtagatgggattggatgggattggaatgaaatgtactggaaaggactcgaatttcatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaatgtcctctaatggaatggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaaagcaatggagtcgaaactaatggactggaatagaatggactcgactggtacggactccaatggaatggaatcgaatggaagggaatcgaacggaagggaatcgaacggaatggactcgaagggaaaagactgcaatggaaagaaaggattcgaatggaatgaaaaagaattgaatggaatagaacagaatggaatgaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaattgactcgaatggaatggaatgtcatgggatggcatcaaatggaatgacatcaaatggaatggaatcgaatgcaatggaatgctatggaatggaatggaatgcattggaatggaatggctcgaaaggaatggagtcaaatggaatggtctggaatggaatgaactcgaatgtaatgcaacccaatagaatggaatcgaatggcatggaatataaagaaatggaatcgaagagaatggaaacaaagggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaagggaatcgaacggaatggactcgaagggaaaagactgcaatggaaaggtctcgaatggaatggaaattaatggaatggaatggaatcgaatgaaatggaatgggattggatgggattggaatgaaatgtactggaaaggactcgaatttcatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaatgtcctctaatggaatggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcggtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggaccccaatggaatggaatcgaatggaagggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatgtaatagaatggagtggagtggactcgaatataatggactggaatggaatgaaatcacatggaatgggaacgaatggaatggaatggaaaggaatggaatcgaatggaaaggaatcgaatggaagggaatgaaattgaatcaacaggaatggaagggaatagaatagacggtaatggaatggactcgaatagaatggacacgaatgctcaaattaaatggactcgaatggaatggaaacgaaaggaatgtcatc

SEQ ID NO: 479971 - DNA, 9203 bp, Homo sapiens
gacagccacggaatggaatgcactcgaatgcaatggagtcgaaacaaatggactggaatagaatggactcgactgagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaagggaatcgaacagaatggactcgaagggaaaagactgcaatggaaagaatggaatggaatcatctggaatggaattgaatggaatggaacaatatgaaatggaatggaatggaatggaatggaatgcccttgaattaaatggactggaatggaatggactcaaacagagtggaatggaaagtgtggagatagaatggaatgaactcctttggaatggtgtagtatgcaatgcaatcgactggcagggaatcaaaaggaataaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaatggactcgaatggaatggaatgtcatgggatggcatcaaatggaatgacatcaaatggaatggaatcgaatgcaatggaatgctatggaatggaatggaatgcattggaatggaatggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaacaaatggactggaatagaatggactcgactggtacggactccaatggaatggaatcgaatggaagggaatcgaacggaagggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaattgactcgaatggaatggaatgtcatgggatggcatcaaatggaatgacatcaaatggaatggaatcgaatgcaatggaatgctatggaatggaatggaatgcattggaatggaatggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatgtaatagaatggagtggagtggactcgaatataatggactggaatggaatgaaatcacatggaatgggaacgaatggaatggaatggaaaggaatggaatcgaatggaaaggaatcgaatggaaatgggattggatgggattggaatgaaatgtactggaaaggactcgaatttcatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaatgtcctctaatggaatggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaagggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaacaaatggactggaatagaatggactcgactggtacggactccaatggaatggaatcgaatggaagggaatcgaacggaagggaatcgaacggaatggactcgaagggaaaagactgcaatggaaaggtctcgaatggaatggaaattaatggaatggaatggaatcgaatgaaatggaatgggattggatgggattggaatgaaatgtactggaaaggactcgaatttcatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaatgtcctctaatggaatggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaagggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaacaaatggactggaatagaatggactcgactggtacggactccaatggaatggaatcgaatggaagggaatcgaacggaagggaatcgaacggaatggactcgaagggaaaagactgcaatggaaaggtctcgaatggaatggaaattaatggaatggaatggaatcgaatgaaatggagtcaaaaggaatggaatcgaatggcaagaaatcgaataatggaatcaaatcgaatgaaatggaatggaatagaaaggaatggaatgaaatggaatggaaaggattcgaatggaatgcaatcgaatggaatggaatcgaacggaatggaagaaaatggaagaaaactggcaagaaatggaatcgaaatgaatggagaattgaatggagtagatgggattggatgggattggaatgaaatgtactggaaaggactcgaatttcatgaaacggaatggaatgaattggaacggaatggactcgaatggaatggaatgtcatgggatggcatcaaatgtaatggcatcaaatggaatggaatcgaatgcagtggaatgctatggaatggaatggaatgcattggaatggaatgtcctctaatggaacggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaatggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatgtaatagaatggagtggagtggactcgaatataatggactggaatggaatgaaatcacatggaatgggaacgaatggaatggaatggaaaggaatggaatcgaatggaaaggaatcgaatggaaatgggattggatgggattggaatgaaatgtactggaaaggactcgaatttcatgaaacggaatggaatgaattggaacggaatggactcgaatggaatggaatgtcatgggatggcatcaaatggaatggcatcaaatggaatggaatcgaatgcaatggaatgctatggaatggaatggaatgcattggaatggaaagtcctctaatggaatggattcgaggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcaaaactaatggactggaatagaatggactcgactggtacggactccaatggaatggaatcgaatggaagggaatcgaacggaatggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatatgggattggatgggattggaatgaaatgtactggaaaggactcgaatttcatgaaacggaatggaatgaattggaacggaattgactcgaatggaatggaatgtcatgggatggcatcaaatggaatgacatcaaatggaatggaatcgaatgcaatggaatgctatggaatggaatggaatgcattggaatggaatggctcgaaaggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtagtgaaatggaatcgaaccacaaggaatggacaggaatagaatggtctcgaattgaatggaatcgtatggaatggcatcaaacggaatggaatggacagccacggaatggaatgcactcgaatgcaatggagtcaaaactaatggactggaatagaatggactcgactggtacggactccaatggaatggaatcgaatggaagggaatcgaacggaatggaatcgaacggaatggactcgaagggaaaagactgcaatggaaagaaaggattcgaatggaatgaaaaagaattgaatggaatagaacagaatggaatcaaatcgaatgaaatggaatggaatagaaaggaatggaatgaaatggaatggaaaggattcgaatggaatgcaatcgaatggaatggaataaaatggaagaaaactggcaagaaatggaatcgaaatgaatggagtgttatggaacggactcaaaaggaattgaatgaattgaatggagtagatgggattggatgggattggaatgaaatgtactggaaaggactcgaatttcatgaaacggaatggaatgaattggaacggaatggactcgaatggaatggaatgtcatgggatggcatcaaacggaatggcatcaaatggaatggaatcgaatgcaatggaatgctatggaatggaatggaatgcattggaatggaatgtcctctaatggaatggattcgaagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggaatggagtcaaatggaatggtctggaatggaatgaacacgaatgtaatgcaacccaatagaatggaatcgaatggcatggaatataaagaaatggaatcgaagagaatggaaacaaatggaatggaattgaatggaatggaattgaatggaatgggaacgaatggagtgaaattgtatgcagtagaagagaatagaatggaatgcaagcgaaaggaaaggaatggattggaatggaatggaattcattggaatggaagggaatgtagtgtaatggacagtgaaatggaatcgaaccacaaggaatggacaggaatagaatggtctcgaattgaatggaatcgtatggaatggcatcaaacggaatggaatggacagccacggaatggaatgcactcgaatgcaatggagtcgaaactaatggactggaatagaatggactcgactggtacggactccaatggaatggaatcgaatggaagggaatcgaacggaatggaatcgaacggaatggactcgaagggaaaagactgcaatggaaagaaaggattcgaatggaatgaaaaagaattgaatggaatagaacagaatggaatgaaatcgaatgaaatggaatggaatagaaaggaatggaatgaaatggaatggaaaggattcgaatggaatgcaatcgaatggaatggaatcgaacggaatggaataaaatggaagaaaactggcaagaaatggaatcgaaatgaatggagtgttatggaacggactcaaaaggaattgaatgtaatagaatggagtggagtggactcgaatataatggactggaatggaatgaaatcacatggaatgggaacgaatggaatggaatggaaaggaatggaatcgaatggaaaggaatcgaatggaagggaatgaaattgaatcaacacgaatggaagggaatagaatagactgtaatggaatggactcgaatagaatggacacgaatgctcaaattaaatggactcgaatggaatggaaacgaaaggaatgtcatc

SEQ ID NO: 479972 - DNA, 698 bp, Homo sapiens
agccaaactgcagtccagctgagacttccactccaagcccagatgcaaccagaagcagtgctcagggagagcaaaagccttattctttgctgtttgaaacctgggccatccgaattcatcctggtagtagtgcagactggagataaagtccactgtgcaggcctaaaacctggggctgtggggtctggcctggccctgagacagaaggctgttcaaattaatgcttctgtgaggagacaatctctggagagtgctattgtgtccgtagttggttccttccagtggattcttggtctcgctgacttcaagaatgaagccgcagacctttgtggacaccccaactgctgctgggaattgggcgatgaccactctagctactttctgctggataggggcgaagaaggggccctacagttggcccgaaggcgagtaatagcaagatggatgtcacgggacctagaaaggggagaagccatgtcacccaactccagagggtggtataagagtttgaaaggcttgtatggccctgtgctgatggacttgagctctgaggggcactgatagggtctgattaccacaagattagaacttaggataatacatgttacactgttaacttttagcaaactttacttttgtaaaaacttaccttgaaacctgctgggttaaggatttttgatgggaaggctatgggttgt

SEQ ID NO: 479973 - DNA, 2665 bp, Homo sapiens
gcatctggctgcgctgtgactccctgagcggcacccacaacctgtatcgggaataccaggacctgaccacggcgggcggtcacccagtgctaccgagtcatggactctcggcactgcgcccaggcccactccatccagatcatgaaggtggaggagatcgcagccggcaagtgccgccggccgtccgtcaagcagttccacgactctaaggtcaagttcccgctgccccaccaggtcctgcgccgagatgtttcgacaacttggcacagtaacaatgacgatgtgtatagggtgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctagaaatcgggattctgacaaaacagatacggactggagggcttgtcctgctacagacagctttgatgactagaagaggtgatgatagctttggagacaagtatcgggatcgttatgattcagaccggtatcgggatgggtatcgggatggcccacgccgggatatggatggatatggtggccgggatcgctatgatgaccaaggcagcagagactatgatagaggctatgattcccggataggcagtggcagaagagcatttggcagcgggtgtgatgatagacgtcccccccaaagacccaaactgaatctaaagccttggagtactcttaagcaagatgattcctctgctagtacctcccagtccactcgagctgcttctatctttggaggggcaaagcctgttgacacagctgctagagaaagagaagtagaagaacggctacagaaggaacaagagaagttgcagcgtcagctgagtgagccaaaactagaacgacggcctcgggagagacacccaagctggcgaagtgaagaaactcaggaacgggaacggtcaaggacaggaagtgagtcatcgcagactgggacctccaccacatctggcagaaatgcacgaaggagagagagtaagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacgcagagcagcaatcccctacaagtggtgggggaaaagtagctccagctcaaccatctgaggaaggaccagcaaggcaagatgaaaataaagtagatgggatgaatgtcccaaaaggccaaactgggaactctagccgtggtccaggagacggagggaacaaagaccactggaaggagtcagataggaaagatggcaaaaaggatcaagactccagatctgcacctgagccaaagaaacctgaggaaaatccagcttccaagttcagttctgcaagcaactatgctgctctctcttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagatctttcttacctttttttaaaaacaaaaaatgaaactattttgcatgctgctgcagcctttaaagtattgaagtaactggagaatcgccaatatagccagagagaaagggactacagctttttagaggaaaagttgtggtgcgttatgtcaccacgcagttgccagtgtgattagcgcctaagggtctccatttagcagaaatggtaatgagagtgatataacccctggaacctggttgggcagtaggggagggagggagaaggaaaagtcttcccttgagagaataaacggtaatggagagaactatttaacaaggtcctggtttctcttgcaacacagtagctaaacttgcctgcttttatatgcatttctttgtagggatcagcttgatagacagtattagcagagaaacgacaccttgatcttgatttttttgtttccatttttctttttccatcctatgtctttttgtctccaactttttgtttaatcataaaaattagtgatttccagtcatcagataattagatttagcagcatattttctgatttcttttatctttcatctcaactttctttcatttcatgtttcttcttccaccttatctcctaattctgggtttatttttcttcttgctgaagtacctgttttaattatttttaaagcacgtatttgtgtgcaaatctgttcttttatatttcataatgtcctccatattttatggcaaatggcagaattttagttttaaggctgaatgatatttcactttgtacatataccacaatgtctttatcccttcattcactagtggaaatttaagttgtttccatat

SEQ ID NO: 479974 - DNA, 1904 bp, Homo sapiens
tcatcagttaaggcaaggaccggccatttacacttcttttgtggtggaatgtcatcagttaaggtggggcagggcatattcacttcttttgtgaatcttcagttacttcaggccatctgggcggcccatcaatgattggaatggataaagaaaatgtgatatatatacacaatggaatattattcaggcataaaaagaatgaaagcatgtcatttgcagaaacttggatggagctggaggtcattatgttaagtgaaataagccaagcacagaaagacaaatattgcatgttctcactcatagtgacagaggcctttgaagaacccacagaagagccaaagacccagagagtgggaagccattccaccaaggaagaaatgaccaatcccttacctctcttccctactcctatttccaccctggtgaggatccaaataggaactggcaagtggagagagaaagaagaaaacctatcactcctccttttccaaaggcatttagccaccactacaggccttagcatgggcttagtgggaaacaaagcctcaccattaagtgaagatggagaaagttgagtaatatcttggactgaatacattctaattactaaatcaaggttgtgttttgtgacttagagtgacctaaggactgtttatttttgaagaagtgagcagaaaatcatgtgctctatccaaacttccatctatggtcaggaaaaggttacctcaatggggtacattttattggaacatggggagacaaaataaagttgtgttttgattctacaataaataatactgtagaaaatactggttgtactgactaattcatcccttcaacaagcatgtgattcctttcatgcgtcagacattgtgctaggaataggacatacagtgaaataaaacatagttcttgccctcaaattacttatgatatatggcaggggtcagcaaattcttctctaaagagccagataataaatattttaggctttaagggacacgtacaatctcaattgcatattctacttcttttggtaactaaccttttaaaaatgcaaaaaccattcttattttgaaggctgtactaaaagaggccatgggtcagatttggcctgtgcactctaattttctggctcctaaatgatggaagtaacaaatttttataaaccaccaattaccatacatttattatgattgaagatatgtttagggcacttgggggaggagacacagaagagcatttgctaattctgatggggaaatcagggtttgcaggaagaggcagtgttgatttgtaacctgaaggatgagtaagaattaatcagagttaaaggaggctactttacaagaaatggaaaatcatgcctgtttgttttcattctatttttttcattcgtctttgaatgctcacatgttttctggtgagattatatgacactataattcttagttattccagatttctctattctttcatgtatttgggataaatttttcaaaattcctaggcctgagattaactctttagaaattgttagctttggaataccagaaaagaacagcaaataattcaccaaactgttgtgtaataaccaaagactaaaaaagtgcctttgagttacctatttgacaacgaggcagaactacaaaaggccttgaaaactaaagtcccaaaccacaggacagtctctatggtaaggggtcaggaatatctttttcatcaatgtaaccacaatgattaatatagtgcctcaaacatagtgggtgatcaatctaccctggttggccgaataaacactggtgcagagagcactggaagaaatacttctagattgctatcaaggtaatcagaccttctggctattttacatataactgagtttgtataagaacttattcatt

SEQ ID NO: 479975 - DNA, 573 bp, Homo sapiens
cccagaaaggctttcagactctaccttctgcttcccaaagtagctgcagataatctgggagattggttgttggtgcagggcaggtagtagtagtaatagtagtagcaaatgacaagatggaatctggagaaataaagatgtacttggcaggaggcaagaagtatcgaagccagtactcaaaaaaattgagtgccagctatgtacaaggaaggcatagtactgtcaccagagaccctcgaaggtcggaatcacaagctaaaccacccactctctgtctcctttcccctgagttgcaccctgatcctgctcaaattttcaagagctgtggaatggtgtcttcctgcaccaacccactgggatcagaaagaatcaaaagagcaaactatgcagaaaagaagggatccaagagagccaaaagaaagcaagggtatgttccctcctatggagatggctctctgccttgccgtattccacagaccatgcctggggagttgcaactgccaatcagtttgttagaggagtgagtgcagaaagctaacatggctgcagcttgccttttctttcatatgaatg

SEQ ID NO: 479976 - DNA, 702 bp, Homo sapiens
ctggtagcttgcatcaacacatctctctgaaaactctatagccaaggagaaaggaaagagaccaaggacagctgtacaagtagcatggcgccagcatctgcttctggtgagggcctctggctgcttccactcatggcagaagatgagggaagctggcatgtgcagggatcacatggtgggagagaggaagcaagagagagaagtgggatggaggtgccagcttcttttaaagaaccagctcacatgggaactaatagaagaatacccttaccagaaagccattgcaattggcagcacagcatagtgattaagggaatggcctttggagccagacagcagacgcttgaatctcaggtctctcctttattaggtgtgatctggtgttcaggagtatatgtgcaggtttgttatataggtaaattgcatgtcaccagggtttggtgtacagactattacatcacccatgtaataagcatagtacctgataggtgaagttcacatggattatcatgtttatccctcataataatcatatttatcattattacaattatctttattttatagttgctaaaatgacagcacagaaaattaagtagtctccccaaggatgcaaagctgggaagtggtggagccaggatttgaatccacagtctactctggaatccatgctgtcaactaccgagctgtacacacgaggta

SEQ ID NO: 479977 - DNA, 599 bp, Homo sapiens
gcatagggagccctcttcctcaagagacaagttataacacgtgtgatgggtagtatgaaagggcgagtccaaggtgctgtgactaagtcatggggacttgtcctcatcatggagagacaaggaagaccttccagaggaaatgacactgaagtgaagtttgttattaccgaccttctgaagcctacttctgtcaacttgtcaaacacattctccagccagttgtgttcccttggtggcgaggagctgcaatcctttggaggagaagagagctgtcagacagggacgtttaagtctgcagaagctgtctgctgccttttgttctactatgcattgcccccagaagtggaatctatagagccagtaggccttgctgagctgtggctgagagaggtgaagaagctgcagaagaaaagtttgaagttagcagaggttggttcatggggtttaaggaaagaagccaactctacaacgtaaaaatgtaagatgaagcagcaagtgctaatgcagaagctgtagcaagctatccacaatatctattaatagctaaagaaaaactctactgcgcataggcctaggcaaagaaattatgatgaagaccc

SEQ ID NO: 479978 - DNA, 903 bp, Homo sapiens
tcctctaaagacaaagactcttctgtgactaagcagtctctctctttgccccctctctatagatttatctacctttggtctttgatgttggtgaccttccgatggggttttggtgtggacgtcctttttgttgatgttgagtccattcctttctgtttgttacttctccttaaacagtcaggcccctctgctgccggtctcctgaagtttgctggaggtccactccagacactgtttgcctgggtatcaccagtggaggctgcagaacagcaaagtttgctgcctgttccttcctctggaagcttcatccctgaggggcatctgccagatgcctgccagacctctcctcaggctgtctgtcccttagcagaactcgagcactgtgctgggagatccactgttctcttcagagctggcaggcaggaatgtttaggtctgctgaagctgcacccacagccaccccttcccccaggtgctctgtcccagggagatgggagttttatctataagcccctgactgaggctgctgcctttttttcagagatgccgtgctcagagaggaggaatctagagaggcagtctggctacagcagctttgccaagttgccatgggctccacccaattcgaacttcctggtggctttgtgtacactctattacttacagtactaggttgaatatcagcagtgaaagtgggcatcattgttatgttccagatcttagagaatcctttctttatccttgaccttttggagtttgattattaaatgccttgagatagtcttctttgggttaaatctgtttggtgttctataaccttcttatacttggatattgctatgtttcttttgatttgggaagttctcagttattatcactttgaataaattttctaagcatatc

SEQ ID NO: 479979 - DNA, 641 bp, Homo sapiens
agcgcaccgtcggtgacatggtggtggtgtttgatggggggtctagtttacctgttcatgtaacttactattgtcctctgatccttttagatctcaatcctggagtacaatttctgtcttacgatggactactgctgggccagactgactttatgccttggatccaaaccaaccactcaatcgattatttttatgatggtgcaggggcccccggtgctgcctcatttttaagagtcaaagcctgccagtgtctgattcccctcatctggcagcaagtttggacactagtggaagcagcccagattatatatgaggtattttacattctccacagccatccgaggatagaatctcaattagaacatcaaggtctgccttctgtggccccttgctatgtcagttccacctatgagctgctgtggatttgcataaattaaacgctgctggatagctgccattgtcttgaaaaatggaatgtgatcagcatgggggagggaaggagagggaaaatttgtctttgtttcatcgtcttcttgttaatattcattcaagactgctttaaccacaggtcagttgtggtttggtaattttttatttttattttttcctatggggaaaacaatttgagcaacatcttcttc

SEQ ID NO: 479980 - DNA, 3213 bp, Homo sapiens
ggtgtacagagacctgtctatcagctcctttaggctgccagccaccttcaggaagatccgacccattttggtggtaacagcttctgagagtccttccagaaacctggtccgtagaatggcatcagaccaagacaaatgtcgggccagcagcaggaagtcatctgtggctttgatttccggagtggacatcactccaaaggctgtctgtggtgtggacattgttccagggcctgaggccctcattagtggtgtggacatccctctagagtctgtggctgtcatttgtggcatggacatacccatgccacatccagaggctgtggctcttggtagtggcatgggcatcgatccagaaactgaggctctcataaatgatgtggaccttgctccagaagcagaggctctaattggcgctgtggccatccttccagacacggtatatgttgtttgtgacaaggacatagatctagagttcgcaacactggtttgcaatgtggacgttgctccagaggccatggtttccattagcggcatagacatctctccagaagccatggctgacattaaaggcatgggcattgttccagaggccggggctctcattaatggcttggacatccctccagagaccatggctgttgtttgtgcagtggacatatgtccagaggctgaagctctcattaactctgtggacacagtctcacaggctgagggtctccttagtggtgtggacatagttccagaggctggagctcttactagtggtgaggacacccctccagaggctggggctcgcactggtagtgtgcacatgtctccagaagctgtgggcatcatttgtgatgtggatgtcactctagagtctggggctctcatcagtggcatggacatccctccagaggctgtggatcttgttagtggcatggacattgctccagagatgggagccttcacttgtggcatggatgacatcattccagaggctgtggctgtcatttctggggatctcagaggcgtggctatctctccagaagctggagctctcattagtggtagggacatctctccagaggatgaagctcttgtgagcagtgagggcctctctccagggtctgaggttctcattagtggtgtggacattgtttcagaggtccaggctctcactgttggtgtggacatcacatcagaggttggggaattcatctgcatccctccagcggtcatggacttcatgggcgacatggacatccctccaggatcttggactgtggctgtcatttgtgatgtggacattgctccagaagctgtgtctctcattagcgatgcagacaaccctccagaggctgtgtctgtcatttgcggcatggacagagctccagaaactgtgtctctcattagcagtgtgggcattgcttcagaagctgtggttgtcattttctccgtgaacatcgttcctgaggctttgggtgtcattagtggcttggacaatgctccagaggccagagatctcatttgtggacaggacatcactcctgaggctgtgtctctcattaacagcgtggatgttgatccagaggtttgggctgtcattagtggggtggacattgctccagaagtcatggctttcatctgtgctgcagatgtcaatcctgaggccatggttctcatttgtggcatggacattgcttcagagacaggggctctcatttgcagcatggacattgatccagaggctgggactgtcaattgtggcatggacattgtttcagaggctgttgccgtaactggttgggtggacattgctccagaagttggagctctcctcagtggcgtggacatctttccagaggctgtggctctcttgtattgttttgccacggctttcatagagcctgtgggcattgctccagaagttttggccattgttaactgtgcggacattactctagaggctgtggctgacatttgctctgtggacatcactccagagcttgggactgtcatcagtgaggtggtcatggctccagaggctggaactgtcttttgcaatgtagacatatttccagaggctggggctcccattagcggtgtggacattgctccagaatctaaagctcttactggtggtgcagacatcaccccagaggctgttgctctcactggcggattagacatcatttcagagtctacattttgtgttgaccatggggacatcgccccagagcctggggctggcatcgtttgggtgggcatcactccagagggtagggccgtcattagtgctggggacattgcttcagcatctggagctggctttggtaatgtggacatttctccagcatctgggactgacagtagcggtgtggacattacttcagagcctggagatgacattaaaagcgatgacattattccagagtctagatctgacatgagcggggtaggtattcccccagagttttgggtgcttgttggctggggtgatgtacctccagaagctacagctgacattatcagtgaggatattgcttcagagtccgtgcctgacattagcagcgaagatatctctccagaggctagagcagtcattagcactttggacattgcttcggtgtcttcatctgtaatttgcaatggggacattgcctcagagctgggagctggcactggctgtgtagacatcactccaggattcatatcttgcattagaattggggataactctccagaatctggggctagcattaatggtgtggacattgcctcagaggatgaagtgctcattataggtgtacacaccactccagaggatggagctggcattgccaatggtgatatctctgcagaatctggtgctaccattagcgttgcggacatcgttccaaaatcaggaattgtcatcatccctggggacattaccccatactctgaagtggacagcaatggggacaatgttccagaatctaaggctggcattagcaatggggacagtgccccagagtctgaggctggcattagcaatggggaaagtgccccagagtctgaggctggcattaggggtggggacaatgctccagagtttggtactcccattagaggtgcagacatggtgtcaaagactggagatgtcatcaactgtgtggatgtccctccagggtctgaggctgaagttgagactataggcaactgtacatgagaatgcagaatctgtac

SEQ ID NO: 479981 - DNA, 604 bp, Homo sapiens
accaatttcagtttgacatacaagatgcaaaggaagacaagctttgaattggctagtggggtagaagagatggaacagcctgacaaaagccgtggagaaagtgaacctacagagcagttgaaggaggagcaagtgcatttggccagtgcgctggatacacgtaggggcagacctgtgcccaccatgagtcctcaccttgaccctaatcaacttgggattctcctcaaagtacttagaaaggaaaaggaagacggtgactaccctgacatgatggccacccacccgagctccaggtatgaagcctgctcctctggaattactctagagaagcctgagaaattgcggagtgggaaggtgaaggaagaagagaccctcttggaaagagcatataagttctcccagggcttccaaatgaaagtccctacaagagacccaacaaggttgtcatttttaagggaaaaatacccaggcatggtagctgctgcgaggaaatttgagaagtgacctgcaagttacatttgcgatgtgaaaaccactttgtgttctttgtaagcaactgtttgatgtgtggcattgcagtcatgggtgtgaaacatctggtttt

SEQ ID NO: 479982 - DNA, 737 bp, Homo sapiens
aacctaaaagaaatgcagctgttatattggcctgaaataaaccttgggccaactgctcaaaaggcagatctgcccacctggacaggctatggggtgggctccagccagcttggggtgatgaaagatgtcctgctgcgtgctgggagaaccactactctcttcaaggctgtcagacagggacatataagtctgcagaggattctgctgccttttatttggctgtgccctgcccccagaggtggagtctacagaggcaggcaggcctccttgagctgtggtgggctccacccagttcaagcttccaggttgctttgtttacctactcaagccttggcaatggcgggcacccctcccccagccttgctgccgccttgcagtttgatctcagactgctgtgctagcaatgtgcgaggctctgtgggcgtagtaccctccgagccaggcatgggatataatctcctggtgtgccatttgctaagaccattggaaaagtgcagtattagggtgggagtgacccaattttccaggtgccatctgtcacccctttctttgactacgaaagggaattccctgaccccttgtccttcccagcaagttgctgaaactctctgaacctttatttccttctgcaaagaagggatagtaatatctctttataggcctaggcatatttaccttttggatttttttgtgcttggccaataataaaataaatttacattatctaagcacactag

SEQ ID NO: 479983 - DNA, 528 bp, Homo sapiens
ccgatccgagtcacggcaccaaatttcatgcgctgtttttacttcttttgtggatcttcagttacttcaggccatctggatgtatacgtgcaagtcacaggggatgcgatggcctggcctgggctcagaggcctgacacaatccagtcaaatatgccaaactaatctcaaacacacagctctaagtcttcacatataccattccccttatcctgatttcccatttatttcctttatttttgtttgctttcttcaatatccatctcaagtcacctcttcaaggaaggctttccccaaagatgtaatatttgctcaccacaaagtctgcaagtttacattgcaaggattgatctttcaagcttgcaacattttgaataaacctgagtgggagattgagtcatgagtttattttgtaatcaataatttcatggacagattttatcctttcattgcttaatttctatccttgagtcaataacggccccatattttgatctctgtggtgactttcaatcaactttggggtttc

SEQ ID NO: 479984 - DNA, 697 bp, Homo sapiens
gcctctcctcatgacttcaaagtcaaagaatctaaaataaattatgagggaaccaagaagaagaagacttctccatggtggacttattggaggacagtcacccaacgttggaggcgtagaggggatggggcctttctgggtgaagactacccccggcccagcagcagctgctgcatatgaggtccagacacctttggctgggtccaaacagcatacagacaactatgctggaaaggaggggagggacttccagttccttgcgaccaaggacagccattttccagcaaggcttaacaatcatctggggagattggccaaaaggaaggcaacttcaacagcatacaaacctatcacagtacacacagcccaaacccactgggcctacaaagatgcaggcccagccccagaatgtgcttttaacccaaagctgggaaagttaccacaaaatgtccaggagatatcttataagacattcctggtttaaatgtaacaagaagacggctgttagcttcttgttgcatcctttaagggtcccctctgtgaaaggatgtcttgtattttgcttttgtgatctttggggtgggaagcacagtttggctagaggtaaggggcatggcaaggtgacgggaaagcagttttggacttctgcaagcaagctgtgtactttgggtttttgcatatcctgtcacactagtgt

SEQ ID NO: 479985 - DNA, 1504 bp, Homo sapiens
agcagctccaaggcttgtggctgcggctgacttcccgcgcctgcctctccgcgctgcttagtcctaggtgatggcagcagcagcccatgtgcagtggctgctgcgaagatgctggctgcagcaggggaggcacgggtggggttacctgttctgtggggctggtgagatccaggaacaggcaggagtactgctccctaccaagttgtctgagtgggagccccgcattcccaggcacatctgcagcctcccagccgtggctttggacccaggcatccctgtactctctagggtccaggaagcccctgcccctgcaggctcggaagtgcctgctcctgctatgcagatggtcacagcggaagccgcatgcagtacatctggtccatctgcagcctcatgtggagccagcacctgtgcaggcacctggagctacccatcgcgctgtagcagccagaatgcctggctgtgtacagtggccagacccagcgcttgctggcccacacacccctcactgctccgtgcctggcttgcccttgacagttgatagacatttgggttattttgaaccttatgctgttaaatgaataatgctgctatgaacatttgtgtgtaagtatttttgtggacatgttttcaattctcctacgcatacacctaagattggtattactgagtcatatggtaactctatcatgacacttggagaaattgccaaacccttttccaaacttcctgcagaaatagcaatgtatgaggcttctaatttctccacattttcactatcacttgttattgtgtcttttctttattatagtcatactaatgggtatgaagtggcatctcattgtggctttgatgtatatttctctaaaatctaaagacgtttgttctttgatctatgaattatctagaataaaaacattttccaaattaatgggagatgtttttctattgttattgatttctaaatgaatagtttgatggtcaaagaatgtgatctgtatgatacttattttgggggttgttgaaaatgtcttgtacataatttttaaaaaattcatgtgtttaatatatgtttatgatattaaccttgttaattgtgttcttcaaatcttatatctttactgattctttgtctttttgaattaataattgagagaggtagcacgaaattttccactttgatggtggatttgtccatttcttcctgtaattttatcaattttgtttcatatatttcaaaactacttaatttgatatatgaataggtttcggattgctatatcttcctagtgaatttaatcttttataattatgtagtggtcccctgtatccctaatactgcttcttgtcctagtgtctagttttttgaatattaacatagcaattccagttttctttttgttagtatttgtttggtatatattttcctagctgtttaatcttcaacttttccgtgttattttagttcagatgggtcttttgcaaatagcacataactgcattt

SEQ ID NO: 479986 - DNA, 473 bp, Homo sapiens
aactttgataactctattggtacacgtgcacaatgcgcaggttagttacatatgtatacatgtgccatgctggtgtgctgcacccattaactcgtcatttagcattaggatttaagagtgatgaactaggatatctggcaaaagaaatctttaagcaggaaaatgttgaagctgctgcatggcttcttgtaattgtttatagtaagaagcgagtacagagaaacaatttaaagatgaaatttttaattaaaatggaagtagaacataaagatttgaaaagttttcagcctgactttgtaaacaataaaaaagtgtgtttagaagagaaaaccaagagtgttgccaagctactgtttgataaggttagtatggatagaatgaatccagatgatattcatcaagacaatgggagaatgaccccaaaggcatttcagagatcttggcggatgctatgtccattacaggcctagaat

SEQ ID NO: 479987 - DNA, 669 bp, Homo sapiens
aaggacctttcttcactagttacccaggtaatagagaagaacttcattcatgttttcaggcagattgagagccagagctctgataaaggttgtgaattcaggcaagagccagagggacaggaaaggctccagtttcccagacattttggctcccagcagctccagggatcatgtaggcaggcactgctatagtccttccagagatttattgacattaatggattgcaaacctgaatcttatcaatctttttctaataggaggaataaggtagagagcagaaagacactggagtatggaaaacaaactgctctttgcacttggatgatgttttgtcctatttaccactgtagctttttaagggctggcaccatgtcttattcacttttgcatctgacaccttggccttcaccactgcctaatacagtgcctgatatattatagatgcttagtaaatatttccatacaaacaaaagctaaggttgtatagaactgggcagaggagtagcgatgggggaagtgtttgtggttgtgtccagccatggaaaatgactgagtcataacctttacttgttatgtattcccagagggaaagagaagcagtggtttaagacttttaaaagattgcttgctaactaatgcttaaactgtatgggccaataactcttaga

SEQ ID NO: 479988 - DNA, 1698 bp, Homo sapiens
attgtgagcacacctcaccagttgagaactatcctaagttaaaaagcaaaaagtgcctcctcccgctttgcctttcaccatgagtaaaagctccctggggctacctgagaagcagatgatgctatgcttcctgtacaaccttcagaatatgatccaattaaacctcttcttacaaattacctggtctcagtcaggtccctcagctgcaggtctgttggagtttgctggagtttcactccagaccctgtttgccttggtatcaccagtggaggctgcagaacagcaaatattgcagaacagcaaatattgctgcccaatccttcttctggaagcttcttcccagaggggcagctacctatatgaggtgtctgtcagcccctactgggaggtgactcccaagtggaatttccagttccctactaagcttccagtgatacttccctggctgaaagaggcttcctctgacaccactgcagcagagaagagtagaaacacctcattactgcttggtgccagtggaagtccacgtttcccctgtagtcttcactgatgacgtgggtgttgggaagataaccttgttaccagttggcagtgacaaaagtctcagttcattactttgccttctttgacaccaacctgttgagggtgttatactgcctagttacatccctgagagggtgatagaccctccacttgtcccttacttgcatgggtggggatgggtccacagatattcatctatggtatgttctggatctgtgtccccacccaaatctcatgtgaatttgtagccccagtgttggaggtggagcctgattgaagggggactgtctccataagctctttataaaacataagttatttcatcattctgccacccaaccttcaccataaatttaatatttctttttgcttcaattttgacagaattcgagttgctttggtggaggtttttttcaaactgatattttattcttcttaatatctcaagctagatcctgttcagacattttataacaagttagagtttactttggtgcaaatgagttttgaaatccatgcataattatttcattatacgcattttcaataaacttttgaagacccctcatatatggcctttatcatattgagatacattccttctacacctaattttgagagttattctaatgaaagaaatgttgacttttgttgaatgctttctttgcatctattgagatggtcatatcatttttatccttcattccattaatgtggtatatcacattcattaatttgcacttattaaactattcttccatcccagggatgaatcacacttgatcatggtgaattatccttttaatgtcttgttgaattagggtttctagcattttattgagaatttttgcctatgttcagcagaaatattattctgtagtttacttttcctatggtatcctcatctggctttggtatcaggctaatgctagcctcataaaatgagttggaaaatgtttccttttcttcaattttttaaaagaatttggaaagaattgctatttattcatccttaaatatttggtagagttcaacactaattcaatcaggtcttgggctttcctttgatgacacaaacaaagggaaacatatcccatgctcatggatggatagaatcagtagtgtgaaaaatgatcatactgccaaaggcaacct

SEQ ID NO: 479989 - DNA, 2259 bp, Homo sapiens
gttaataacacaaataactgctcagaagagtcacgatgacctttaagagtgattcaatatgtaattcagagatgacccaccaatatggggtctctgagtggacgtcctttttgttgatgttgatgcatttctttgtgtttgttagttttccttctaacagtcaggcccctctgctgcagagttatgggatttttatctataagcccctgactggggctgctgcctttccctcagagatgccctctccagagaggaggaatctagagagacagtctggccagagtggccttgcagagctgcagtgggctccacccagttcaaatttcctggtggcttttttacactgtgaggctaaaatcgcctactcaagcctcagcaattgcagacgccccacccccaccaagctcgagcatcccaggtccatctcagactgctgtgctggtagtgagaatttaaagccagtggatcttagttttctggtctccattgggaaactcacccctattaccaggtctctgtattgagttttcaaacaagattttgattgaagaaatttaaagaaaataagtttggaaaaaattactggactaggtaaactctaagttccctttctactcagaatgtctctgattctaatcctaaagcccaagcataggactacctccagaaattagatatagctcatttaagaaaatgtatagtaaaaggggatgccaaataatttcattggtcagtaattcttcaatttgtatacttaactacctttgttgtactcttttataaattcctttggtcatttgacagatttatccatgctttcttgtaagcataaatttgtaaacaaaatcccattttcctgttgatttacattttagagtctaaagtgaatatacccacagaaaagataagagcctcaatatgaacaaaaacacacttagaatgcagcttagcttcattttaaagcagaaaacaaaagaacaaatatttttctgaaaaatattagtctgtgtctgcatcacatacaatttgattatgccaccattaaaatatcatgttaatttggcatttgggggaataaaggggggcacctggacatggtcatcttcctaaagtgtaaaatagaaatcatattctcacctccaacagtccataggacatttccctttgaaatttgaaggcaacggctttcatctgactttgccttgaaagttgccaggtatgcatcactattattgaatccagtagcttcaccccattcagtagactctgctaatgaatccttgtgttctttcccatgcatggtgtttgtatgagctgaaaagcataaaaattcagaatagttgttggaaatagcttcatgaccctgttcagcatttcaagtgactttccaataaagttccctttaaatgtacttctaatggtttgtaaataaaagctgttcccttatctccccagctttggcctgctgaacaatgtcaaggaatctttctatgaatcatttggggtaaagctgaagaatctaataattgtaagaagtagtctctaatttgtggcttttaggaaatgtagtttcacatcaattgactcttcctgtagctgaagaaaatccccagaaattcatatagtttcataataaggcacatctgtattctgagtgcctgaaaagccctctaagatgcaagccaaaatataatgcagtgtttctttttaccaactactcacatgtctccacattgtcagggattggggggccaggatgcatgataattcagcaatcctgccctcctaatgattcagagagaccttggtagaacacagcagctatctctttccattgctgtttagttgtccagggaaaaatattgctgagctgtaagaaagataaaatgagggaagactagtttgatttggtggaaaatgttaatgataagctatttgaaaataaaataagtattttttcaaaattttcatacataataaggtgaaacaggctaaccaagggcttcctaataggacttcctccagggatctgctttcaaatactggtaggaagtttagctaattagcttaacaattataaataaatgaagggagtacttttaaagtattgaacaatgcatggaaattttaaagaattttataaatctttgcaggaaaaatttgtttaccattgtaattagcttggcaaattggcttcttagagtataaaaataaagtaggctggttccttgattttcaccaattccaaattaatggatt

SEQ ID NO: 479990 - DNA, 523 bp, Homo sapiens
caggaaagtagacatgataaatattatgatttttattttatggataaaactacaaaaaactgcagaggctattatgaacacctctatgcaaacaaaccagaaaacctaaaagaaatagataagttcctggaagcatacgatcttctaagattgaagcatgaagaagtcattttggagctccatcaggcagggacaactgtttgcagaccagccgtatccttgcagttgtcagccctgtggaggctggcactcctctctctaccactggcctgtgaacctggggatctcaagtctctcagtgatccaagagtgtgggcccatccttgcttaagcaccacacaagacagcaagtcccacttggctaggagatttgggtgtggctgcggtcacctaatctgtccacatgcttcccaggggaacatggggttgtgcctgcccacagagttcaggcagaaacagtaccactggactggaagctctagtggatgtggcccgtctggttatgagaggcagacgtgagtgt

SEQ ID NO: 479991 - DNA, 666 bp, Homo sapiens
ctttttttttttcctgaagatctgtctagtattgacataggcatgggcaaagacgtcacgactaaaacaccaaaagcaatggcaacaaaagccaaaactgacaagcgggatctgattaaactaaagagcttctgcacaacaaaagaaactatcatcagagtgaacaggccacctacagaatgggagaaaatttttgcaatctatccatctgacaaagggttaatatccagactctacaaggaacttaaatttacaagaaaaaaaacaaacaaccgcatcaaaaaaatggcgatcattaaaatgtcaggaaactacacggaatactatgcagccataagaatgaatgaaatcatgtcctttgcagcaacatggatggcagctattatgctaagtgaattaacacaggaacagaacctaataccacatgttctcacttgtagccatgctccctctcagtgctctgagagtgtggactcctttcctacttcagtgctggccacagaccttggcttggcacttccagtctgtgcactgcaggcctggggcaagcttagactttttgcttactcctcagcttagagaaagcaaagttggagacattggcagtggcaatggcaaagcacctttcactagtgtcttagggctccactccagagaaacacagag

SEQ ID NO: 479992 - DNA, 553 bp, Homo sapiens
ttcagaccccctttccgaattcggccatgaatccttctggtcctgggctttttttggttggcccctcttctgcaggtctgctgcagtttgctggaggtccactccagaccttgttcgcctgggtatcaccagtggaggctgcagaacagcaaagattgctgcctgctccttcctctggaagctccctcccagagcggcactggcctgatgccagccggagctctcctcagagctggtgcactgtgctggcagaatgcctcttgtcaggatcagctgctctcttcagagccagcaggcaggaacgattaaatctgctgaagctgcacccacagccgccccttcccccaggtgctctgtccgagggagatgggggttttgtctgtaagcccctgactggggctgttactttcccttcagagatgccctgctcagtgaggaggaatctagagaagcagtctggccacagccactttgctgcgcccatcccagacctcacagcctccttagcactgtcaggggaaaacctcctactaaagcctcagtaatggaggac

SEQ ID NO: 479993 - DNA, 1080 bp, Homo sapiens
aaaaaattaattaaaaagagaagagttttgctcctcataggtaagctttaactctcaacctgctcttactcaaactataacaatttgcattaattcaagttctataacccagttctaccatttttccaaagtataacaatttgcattaattcaagttctataacccagttctaccatttttctgttgggcaccgtagcactcactgcagaaaatcccttccatcttgaacattttccaactttgaccctttctttccattccctttccgtgaaacaggcgtgacttcttaatcctgtattgacatggaatgatactctagtcatcttggcttgatctagtgtgcctcattgtcctgatcagaaaaatcagaaactttgggggacctgaaacatcatctctctggacttgttgcaaagatggaaggtaacaccctggagatggtagagcattgagacgagaagagtgtgggtcattgaagacttcatgaaacacagcagccacacaccagctctggactgccccaccctgactttgacattagagaacctgggcaacatggcaaaaccctgtctctgccaaaaaaaaaacaacaacaaaaaagaaatcagctgggtgtggtggcacgtgcctgtagtctccgctactctaaagggtgaggtgggaggatcacctgagcccaggaggttaagcctgggtgacagagtgagaccctgtcaaaaaaaagaaagaagaaagagaaagaaagaaagaaaaagaaagaaagaaagaagagagagagagagacaaagaaagaaagaagaaagaaagaaagaaagaaagaaagaaagaaagaaagaaagaaagaaagagaaaaagaaagagagggagaaagaaagaaagcaggaaaaaaagaaagaaagagaaagaaagaaagagagaaagaagagaaaggtaaagtttttcctccccaaacctagactcaagtcccactacccaggtgtaacataatgaatctttccagaaagtttttgtttatttaaatctgtaaatgttgactgagcacctatgaagtaccaggcagcagggctaagcacttagga

SEQ ID NO: 479994 - DNA, 1697 bp, Homo sapiens
ttgtttgtttttttcttggctccaccctcgggcctgtgcccacggacctaggtgaggacaggcactcctgccttcactcccaaatgttgcattttccaagaccactctgtgcccacacgcctcatcctgtgcctataaaaccccaagatcctagcgggcagacaacaacaagcggctggacgtcaagagatgcacatcagcagaaggagaacaagtggctggacgtggagaggagcacagcagttgaagagcatgccgacaggcaccagcagacgccagcacaccaggaggccatccactggcgaaacgacacggagtttggcccaggtgatcttggacctcatcagctcagatgtcagatacggcatagcatcaagtcaagaaagttaacaaggtcagaaaaagggatgacaggagagtcaagatactcattatgtggaaatagcctgaagaaaaataacctggtagttcaaactggatttaaaaagcgtctttaaattattatctgaatttttagcagcgttgtgcacatttgaccaaatgatcttgttataactgggctttcatcttttactagaacaatcatcattcatagaaagataatgtgcattagatcaaattattccaactgagcaagatgttaaatgtcattttgggtaatgagataaatgaaggaaatttgtaacaagtggaacagtcgacttattacactctggagaattttaatctgctttcatggtaaaggttaacaaacactcagagagctcctacttgtacttgtcactttaaaagcatttttcctgcaaagatttcaaggtgatggtgtatttgctgcatttcaaagggtatagggtatcctttgtgggaatgacaatttcatcaatatcatcaagagcaaacatatattgaatactttgtagttgtaaggcagtgagctaagtgcctggaacacagatagacataagatatccttttcttacaagaagtctctttacaaaatagcctaaaatatattttcttcagaatataggtttctaatattaggttggtgcaaaaagtaattgtggtttttgccattacttttaataaaatgtggactctgtctatttaaataaaaccctgtatgttcatgtccctaaataaacatttctaatcaaccataggaggcattttgtgtttaatagtaaggacttgaagaagcagatgctaggaacacagagatattttaacttgggacctttgcatttatgttcacaagatttgtctatacttttcttgtacattccttgtctctttgttatcaaggttagattagccttataaatagatctaccatttttattctgtgacaatttgtgttaagctttctactgttaacatttttaaagtgtccatataagctcgttttaggcatttctctttctttgtgtacatatttatgtgtatgtatattcagtttgaaactctgtcttttaataggaaagattcatttgtaagttttagcctgtcatcaacttctaccaccagcagagagtagactgctaaagataattgcagaccagagacaattacgttttgatacattaatagttttaggaaaatacatgaactacagaggtctgcttagcatcatggtgtgttgtgtctcttatgtgaggggtcgtaaggtactgggggaagtagagagaatttcagga

SEQ ID NO: 479995 - DNA, 816 bp, Homo sapiens
ttttttttattattctggaaaaaccttctgaatccactttgtaaaagggttggcacaggaacgaggacatctgatacacctgatatcttcaggatgtgtgctctcactgtagtcatatcactccagaatctgaaggttgcttggcaagcaggaacccaagagtgggagtgggttgttataaagccaggaaacatccgggtttgggtcctcttcacatgtgcctgcttctcctttgaccttttctgccatgttttgagcagcaaaaaggctctcaccagaagccaagcagacatgggtgccatgcctcttgtacagcctacagaacttggttgtactggtttacaaccactttgcatggccatgagagcccaccccttgcatcagtgttccctgaatgtgaaacatggagtcaaagggaatcattttggagctttaatatttaatgacttccttgttggatttcagacttgtatggggcctgtagcccctttgctttggacagtttctcccatttggaatagagtatttatccaaggcctgtacctccattgtatcttggaagtaactagtacaacccagtggttgtactaaatttggcaaatttaatttatgaagacacattctttcaagcacataggggacacttgtgaaaattcaacatgtgtgggatgcaaaagcatatcctaatatagtataaagcatatcccatatagtataaagtagtatatgatacagaccatactctctgtgccccatagaatataattataaaccaaggtatattagtccattctcacacttctataaagaagtgcc

SEQ ID NO: 479996 - DNA, 601 bp, Homo sapiens
acagcagctgatagataaaatggccattataagaaagaaccaaactgatcagatagagctgaaaaacacactacaagaatgtcataatgcaatcacaagtattaactgcagaatacaccaagctggggaagaatctcagagggaccaaatctatgactcattggtatccctgaaagagggggagaaagcaagcaacttggaaaacatattccaggatgttatctatgaaaatttccccaacctctttggagaggccaatattcaaattcaggaaatgccgagaacctctgcaagttactacacaggaagaccatccccaagacacatagtcttcagatttaccaaggttgaaaaggaagaaaaaatgttaaaggcagctagagagaagggacaggtcacctacaaagggaaccccatcaggctaacagcggacctttcagcagaaaccctacaagccagaagggattggggcctatattcagcattcttaaagaaaagaatccaacccagaatttaatgtccagtcaaactaaacttcatcagcaaaggagaaataagatgttttttggacaagcaaatactgagggaatttgttatcacc

SEQ ID NO: 479997 - DNA, 900 bp, Homo sapiens
gggtttatagtgtgatgctaaagtttgagcttctaatgatcccatcgcccaagaagtggacagagcactcaataggaccctcagctgcaggtctgttggagtttgctggaggtccactccagaccctgtttgcctgggtatcagcagcagaggctgcagaacagcaaatattgcagaaaggcacatgttgctgcctgatccttcctctggaagctttgtctcagaggggcacccagctgtatgaggtgtcagttggcccctactgggaggtgtcttccagtttggctacttgggggtgccgtctgttacggctttcctttgctggaaaagggaattccccgacccgttgtgcttcccaggtcgcaaagatgtcccaggctgcaagtcttaccatctgggagaaacctcagcttcagcaactctcctcccactccagtcctatgatgggagagagactaataccagtgcctactgctgaggcgctgtccacactcatcactcaattctggctatgagagcccttccctggctccacagcaagctctccaatctctggcgcaagactaaaatggctgttgtggttgccactgccaggtcaccaaacaatgtctctaaactctcaaaatggtcctagctatggaccattttgtgaccagagagggtggggcccctctcaggaaaagcaaggtatgttcagagatatttatcttttcaaatttgatttgaactatacctgtaactactctgccaataagagtcattttcttagggtagtttggagaaaatttttgagaagcattgggtgaacgggaagtgctcaagagataacctgataggaatgttctaaagaggatttctatactgagaggagagggaatgatgagctctgagctccctttc

SEQ ID NO: 479998 - DNA, 682 bp, Homo sapiens
ctccaacagacctgcagctgagggtcctgactgttagagggaaaactaacaaacagaaaggacatccacaacaaaaccccatctgtacgtcaccatcatcaaagaccaaaggtagataaaaccacaaagatggggagaaaccagagcagaaaagctgaaaattctaaaaatcagagtgactcttctcctccaaaggaatgcagctcctcaccagcaacagaacaaagctggacggagaataactttgatgagttgagagaagaaggcttcagacgatcagtaataacaaacttctccaagctaaaggaggatgttcgaacccattgcaaagaagctaaaaaccttgaaaaaagatcagatgaatggctagctagaataaacagtgtagagaagaccttaaatgacctgatagagctgaaaaccatggcacgagaactacgtgatgcaagcagaagcttcagtagccgatttgatcaagtggaagaaagggtatcagtgatggaagatcaattgaatgaaatgaagcgagaagagaagaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccat

SEQ ID NO: 479999 - DNA, 1000 bp, Homo sapiens
gtgttcattcattcatcccagccagcaggccagtgcaatgtaaatgacccggctgagatgcttgcattgtgagttgtggatggatagcctgtcctcagaccagggactatgctttgccctcactaaatccacaaaatatactgagcttcttgtttgccacaatgccagcttttgggagtgccagattaccaaaggtttgcagatttattgttctttccaacagccctatcagatagaccaggcaagcaagtattattacccccataatattgatgggaaagcctctgagattgagagagataaagtgatgatcccaaggtcgcatagcagtacttactacaagggtcatttctcccagaaaattctaccagaaattgctatgtttcttctaaaaagcgggtttgcttttatcttgcggataccctgaatcaagatacgcttccttttttgctgtggttgttggaaagcccacagccaaatttgtgtcccctcccttctaatcaatgcacaggacctcaccccagcttcacctgtttgtcttcctttatttttccttcatctacatttcttcacttagttgtgctttttggctttcctgttgtttctgggctttctggttttctggtttgttttgatgtttggaagcaatatagtgaggcaagagcagagactctggggactaatatacttaacgcttggctcccagctctaccctttcctatgttaacctttcttttcctcatctgtaaaatggagaaaacaatagtagtcatggggttgttatgagtgttaaatgagaaaatacaagtgtagtgctaagccaacagtaagcactcaagatatgttcattatcaatattataacattgctgccctaaatcatttcaggagcaagaggtgcaaaagagaatataattatttattctcctatttcaaatgttcaatcttatctcccctcttattcttcctgttgcatgaattgtctttcaagcaaattattt

SEQ ID NO: 480000 - DNA, 587 bp, Homo sapiens
ttagtgttcttcagagtcaagtcttttgcaaaaacaaaggaaagtgtccctcaggacacagtctataatggacagtggccaagctggcaggcaggaacgtttaagtctgccgaagctgagcccacagccgccccttcccccaagtgctctgtcccagggagatgggagttttagctctaagcccctgaatggggctgctgcctttgtttcagagatgccctgcccagaaaggaggaatctagagaggcagtcttactacagcagctttgtggagctgcggtgggctccacccagtccaaacttccctgaggctttgtttacactcttgctgggctccatgggggtgggatccactgagctagaccactttgctccctggcttcagccccctttccagattggcgttccaggtgtcactggggtgaggacactgaggctcagagaatttaatgacctttcccaagattgcaaagttagtaagttctacatccagggtttgaaaccagggctctttgagtctccgtatactaataactctccaattttcaatgtcacatcaaacatctaggaatcttttaagatacaga

SEQ ID NO: 480001 - DNA, 669 bp, Homo sapiens
ctctttgcgcttcaacaaagagcctagactaaccttcccccagacaaatatctacctgtctttggagtctgacacaaaatgaccaccgccacccccatgagtccttttctgctggcccaggaggaacaagttttctgtcccccatattcactgcacctggtgccaccacactcccctggccccgtgagtgtcaatgattatgtgacttttggaaatgtagatcttcttcgggggcccatggtgattttgcataaaccacagaggtcaaatgggcccaagcctcttgggccacagagcctatactgtgaaattgcggaggggctgccaaagccctgggttgtggagcttcaagtcttgctactgccagagttgggggcccagaccccaagatcacaccgtgactcaaaagactgggtcctgctgaagccactctactcaccagagcaagctctctttaggggaggccctgctgtctggggcatggtggccacaggaaaggggaggccaggggaaaggagtaggttgtccttcaaagaagcagctctgaggctcaaggaccctggcacccctgattccacagcaataagggagcagctactggaaactccatggatcagaaagtgcttttggagctgccagatgaaagaaaggaaaaaagacgaatagatg

SEQ ID NO: 480002 - DNA, 622 bp, Homo sapiens
ggggcaggtcccccgatgactctgatgataaggggcacctgccagatgccaaccagagctctcctgtgtgaggtatctgttggcccctactgggaggtgtctcccagtcaggatacatggggagctgtcaggcagaggccctgcccagagaagagaaatctggcagtctggccacagcagccttgccgagctgcagtggacttcacccagtttgaacttcccagtggctttgtttacactgtgaacataaagccacctactcaagcctcagcaatggcggacacgccttcccccaccaagtttgaattccctgggttgatctcagactgctgctgtgctggcagtgggaatttcaagccagtggatcttagtttgctgggctctgtggggataaacaaaagcttaaaaagttcattaccactagaacttcgctataagaaatgcttaagggactccttcagaatgaaataaaaggatgttagacagttactcatagccacatgaagatataaagatctccaataaaggcaaatacatgggcaaatatgaaaagtcattttttattgtaattttggttagtaactccactttacattttctatggaatgtaaaagacacttgc

SEQ ID NO: 480003 - DNA, 639 bp, Homo sapiens
ttccctggaaaggcttaagcagaagctgcaagaccaggttcaaatttgagggttaggccccatgagattcagaaaaggaaaaccagacagttattgcagctctttctcaaacctggcatctccccagagcatggaaagggtattagtggaaccaaagctcagtacttccagcagtgggaaggagaatactgaaaagctgcataatcctatatcaaggagcaaggtgcattctggctttgtattactttcctatgaagtggtagtttctggtgcatggaaagctgccctggagcagtggctgcaagggccttcagctgtcataggactcagtgtagacatcagccatcaggacccctaccctggttcttgtaccttagaggaccgcctctggccccatcaggcaaaggagttggagttggacataactgaatttgaagatagatattgcctggttccattccccgtgattgatctatactgacatagtttgcaaactaagagcacaacatcttgtgcacttaatatattctaatctggttcatctacctgatctgattaaaaatccaatatatggagaaaatgagaagtaaagcagcaaaggggaaagtaaaaagcaaatttcaggattgtggtggaata

SEQ ID NO: 480004 - DNA, 889 bp, Homo sapiens
ggtcctgcaagctccattcatgaatgccacgatggtagacaagacattctatgaatccccagatggatgctactggaagaagcattataggaaaggaagacaaattcatatacagaactctcactctaatttctgcaacctaacaaatgcaaacatcccagtacaaatctgggtccttctcgccacatccagcccggtgctaactgatgccagtgctgacagcactcccttgcaccccaattctaatgttttcccatattccccacctgatagcagcaagagagggcctgatccttctggatcttctgctcgcttcctggctggcatgcaccaaccctgtcccttagccacgcagtgtgccacagtgctacaagtaacacttaaaaggcagaatcttcaggccattggagtggagtactgcataagcactctggatagccacaagtacttcaggagagcctcatactgccagatttctcaaatagaagacctagctgcttttgaggatgacaataaagcaaacaggaagacaaaggcctttgatgtgaaaggtgatgtgggccatgtatgttcaaggcactgtctcctgtctgcttctcccttcctacttctctctctgcttcaacatctccccaactggacaagcaacccaagggatatcacaggatccactgctctcttcagagctggcaggcagagatgtttaagtcagctgaagctgtgcccacagctgccctttcccccaggtgctctgtccctgggagatgggagttttatctataagccgctgactggggctgctgccattctttcacagatgccctgcccagtgaagaggaatctagagaggcagtcttaccacagccactttaccatgctgtgttgagtt

SEQ ID NO: 480005 - DNA, 630 bp, Homo sapiens
gtgagaggagccacccctactgccactccctgatttcttagcccatttattatgggtatggagaagataacaccacactgtggtctcacatttaaagcacaaactgcatcctgcctgttcggcaagcactcagatggctggagaaagaagctgactgacattgccagggtgcataattttgtctacctgatattgtcacagtctgtgtccattctgagtcatctgtccacatacttcttccccagacttcctcatatccacaccgctgacccactccacagtaccagctgcatgaaacagcagagccccctttctcctgcaatgtccttccatcgccctctactgaagacctgccaacttcacccctacttttctggggcctggcaaagtaagatcaagagtgaagccgaagacacgctagtgaaaaccccaaactcatcaagcgccccaactctaatggccacaaagctctactcttgaggttctgtcaattaaaacagaaagttgcagaaatcacagacaaaatcaacttgctaatatttccttgttatttattggcactcagaatatagttaagagggtttcttaaaaggcagagtgcaagtaaaataagtggattaactttcattt

SEQ ID NO: 480006 - DNA, 665 bp, Homo sapiens
taccagtgcctcagtttcctcctctgtctctgtacaataggtatgatactaatcaacaaccttgtaagatcagagtcatttggggtctacagcagagttgtcaaagagaacttctttgatgatgttatatttaaatgggcacaagtggctgctggctgccatactggacagcacagctctaaagaaaagggtggaaaaacgggacccatttttgatcctctgtggcagctaaagggatttcaagacccacaggtcagacagaaaggtaggggagcttgggctagaggggaggaggaggacatgtttttgatgagttcaactaaggcccttgcagtcattgggcatcaccttgccttgttccttcatgtggtcattggtttaggctgtgtctacacagacccactgagtcaagctggaggtctgaatgtgaaatacgaattacagagacatagattttacatcccacacagttccccagctcctactgtgcttgtgcagctcaccctggaggcatgtgcagagaggcattcaatctacttgccagggcttggacatttcagagatgatggtaattactgaagcagcttccaaggaggaatgagacactatatcttatggtctttccctttttaattgagttcctctggaaatgtatgtacctgcag

SEQ ID NO: 480007 - DNA, 565 bp, Homo sapiens
tgcacgctgattggtttaatagagccccatctgagccatgagttgggagattttacaatggtggtcccaggttaggaccaacactggggcagctgtgatcttgggacagaaatgtgaaaacacagactgtccagatgcagaacaggtgactttcatcaaatccagtccctccaatgaacataagaggaaactgatgccccatgaggggaagcaacttgtttcaggtcacctaccaggcagaaaatcacatttatatggtagccaggctgtaacacctcatagctacccattgtctctaatcagaaatgacagcctggtgactggctccatgctgggtgaagtccagcaaactgcaggccctgggtccatctttgtccatttgcatgtggacgtcgacttgacccagaatcatttgctgaaaaggctattgttaacagttccctccctgccccatagcagccatgcatggggcaacttccagtgaggtcagagataaccagtttcacacatgtttgtgtctttccacagtgtcagacttttattgatgctatttcaatcacaaaat

SEQ ID NO: 480008 - DNA, 1826 bp, Homo sapiens
aggaggcatccttaagtcctcctcctctttctcccccgaatcccttttccaacaaccgccagtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttg

SEQ ID NO: 480009 - DNA, 601 bp, Homo sapiens
cctacgagcagcgagtgtgcagtttccaggcatggccacaggatggtgcagtgactgtgcagatggtgtatggcaccaggagggaaatcaaggccctctaaatattcagtgttcttgttcttgtttttccatatgggacctaaacatggggaagatagcaaacatggaagagagccaggaaatggaatttcctgtcgacactgaagtcaaaatgggccagcaactgggtctctacatcagtggcaaacaagcaagaggggtcaaacctgcagctttcttgctgaagggctctggctcatgcattcaagaggttcaagatactgaagctcagaattgggatggagttcaaggcatttctagggaaaccttgatgctcgtagcgtggtccatagaccagcagcaccgacatcacctggaactcattggaaatgcagagcctcaggctccttatcagatctacggaatctggatcttccttttaacaaaattcccagatgatttgtacacacattaaaattggagaaacagtgctttagattagtaattatcaaacttttcccttgacaatcacacattagatgataattctgtgcaggacaca

SEQ ID NO: 480010 - DNA, 1459 bp, Homo sapiens
cggccagagtgggcactgaggccgaggaggcaccgagagccagcgagggctgccagcacgctgtcacctctcaatatcaatcaatgtacttctgaaaaccaatttactgttcatcttgattttcgaattatttgaaaaactaagagtaatggtaatgcatttggcctggtccgctccactccagatcaccttctccccggtcagtgcagtgaggacgaatatttctaatgctggccctcatgaggaccaaaagccaaggagagagcctgagaaattcctaatgcttaaaggatggccagaagaagagagatcagaggagactgtgaagaagtggtttattgaagttggagaaggaagaaacacattggtgaaggctggagaaacggtgctgaacatctggtccaagggacaggtaaaaccaccatcagtaaaaggaataatgagatcagaagcagaaagagtcagaagtgatgtagctcaagccaagaaatgccaagaattgatggccacaaccagaagcttcaaagaaacaaggaaatattctacccagagtcacaaagggagcgtggtcctgctgatgataccttgcttttagatatctagtgtccagaattgtgagagaatacatttctgttgttttaagtcaatcagtttgtggtaatctgttttggcacccctaaacctctatttgtattggaaacgaatagagttagcaagtataaaagagtgtcattgctctagggacaagcttccagttaatagaataaatccccaaaaagaagggttattgcaaagattccattcaaacggaaacatctggctacctgatagaagaattgacaagctaagtgatacaaggcttagtgacattccaaggatttgagatgatctttgttcttggagagatttaagctacctgggttcataatttttaaagtttgaactggaaataaaaatttatgtctttgttttgagtgtgtttttcttattacaaatcaaatccagatttttagtctaggttgtatccttatagggataataaatagcaacaaccacaagataattaaaggggaaataaatttttagggagtacatggcctttttattgcctttttatctgcccttctcttttaattaatagactttatttttagagtagttaggtttacagaaaaaatgagcagaaagtacaaagagttcccttatattccctttccctacccctccaccttctgaccaggcgcacagtttccccttttattaacatcttgtattagtgtggtaaatttgttacaatttatgaaccaatattaatacattattattaacctgagtccatagttcactttatggttcactctttgtgttgtgcagttctaccggttatgacatatgcataatggcatgtacagtatcataaggaatagcttcactgccctaaatgtcatgacatatgcat

SEQ ID NO: 480011 - DNA, 862 bp, Homo sapiens
tttttttttttcttttttcccttttttgcccaataaaatcctgccctactcactcttcaatgcgtctgcagctctgagagagctttcatgtacaaatggaaaatggaaacggttcagagaaatggacaaggttagaaaaatacgtggcatctgagaatcatgaggccagaaagaaaggtcattctttggagctcagtgggtggggttatgaggccaaaaggatgcagtgatttactgagtgcaaactttcaaattatgttcagcttatttcctagaaaacttgttgcagctgcctatattggtataggtgtaaaatatgagccttttaaaaaaatgtcagaacatttgcatttttaccgaaaagtaaaacagtctttaaaaagaatccctcctagggtttattcctcaagaagttctgagattcctggatgtagcctgcagaaaaaggcttaccttcagaggggtttaagctctctacctgtgcaaaggctacggagtgttgaaggaggggttcaaatatgtgcacacattggtgaggaatgttctgagcatccccactctcagataggttggtgtggggagaattcagtaacaagggatggagaaaatatagtgaaaaggcagccatttacaaaccaagaagagagcctttaccacagtccaaccatactggcaccctcatcccaggtctccagcctctagaaatgaatattgttgttaccaatttggtgtatattcttccagatttattactatgcatatatctatacatgtgcattgctgaagtgcatatgcatatgtgcatgtgcatatgatgtgccaggcactgtactaagaccttgatgtgaattattttatttaa

SEQ ID NO: 480012 - DNA, 3291 bp, Homo sapiens
cctgagggggtgccactgaaggatttcaagcaggggagtaataggctgagttgtggtccgggtctggtttggggctgaagcaaagcctatgcattactcaccacccccaaaaaggcatctgactgactgggggcaccattcctttcttgaatcatcttggatctgggagaaggaaaatgcttctttcttatttctgtttctttctcaagagattctccccaatttctttgcaggtatctttttactcttcaaataaagaaggatttggctctaggaaggcttccatgcagtgacaactgtacagcgttgatggtatctcacatcttacaatcagaacttggagactttcatgaagaaacagataggaagcatctggcacaaactcggtacttaccaaaccaagactgtttagagggcaagatcatgcactttcatcagaagcacattggcaggagcccagctgaatctgacattctgctactggacatagcaaggaagctggatatgtatggcatcaggcctcaccccgccagtgatggtgaagggatgcagattcacctggctgttgctcacatgggagtactggtgttacggggaaatacaaagatcaatacttttaactgggctaaaatccgcaagttgagttttaagagaaagcattttctcatcaaacttcatgccaatatcttggtgttgtgcaaggataccttggagttcaccatggccagccgagatgcctgcaaggctttctggaagacttgtgtggaataccatgctttcttcaggctttcggaagagcccaaatcaaagcccaaaaccctactctgcagcaagggttccagtttccgctatagtggacgaacccaaaggcaacttttggaatatgggagaaaagggaggctgaagagcttgccatttgaaaggaaacattacccatctcagtaccatgaacgacagtgcaggtcctcaccagacctcctctctgatgtgtcaaaacaagtggaagatttgagactagcatatggtggtggctactaccaaaatgtgaatggagtgcacgcatctgagccagtgctggagagtaggaggaggaattctgcattggaggtgacatttgcaactgagctggagcattccaaaccagaggcggatcccacattgctacatcagtcccaaagcagttcctctttcccttttatttatatggaccctgtctttaacactgagcccaatcctaaccctgatcccagagacattttttcagagaggagttctctaagctccttccaaacaagctgtaagttttctggtaatcacatgagcatatattctggcctcacaagcaaagtgcgtccagcaaagcagctaacttacacggatgtgccctatattccttgtacaggtcagcaggttggtattatgcctccccaggtctttttttatgtggacaagccaccccaggtgcccagatggtccccaattagagcagaggaaaggacaagtccacatagctatgtagagcccactgcaatgaagccagctgaaagaagcccaaggaatatcagaatgaagagctttcagcaagacctgcaagtactccaagaagctatagccaggactagcggtaggagcaacatcaatgtaggtctagaagaggaagacccaaatttggaagatgcatttgtatgtaacattcaagagcaaacccctaaaaggtcccagagccaatcagacatgaaaactattcgttttccttttgggtcagaatttagacctttagggccttgtcctgctctcagtcataaagcagacctgtttacggatatgtttgcagagcaggagttgccagcagttctaatggatcaaagtacagcagaaaggtatgtagctagtgaatccagtgattctgaatcagagattcttaaaccagactactatgctttgtatggcaaagaaataaggtcacccatggccagaatccgcctgtcttctggtagtctacagttagatgaagaagatgaagatgcttatttcaacacaccaactgctgaagacaggacttcactaaaaccatgtaattactttttagcttaaaagtgtgaacctatggacatttctgagccagttccatgttaccgacttaggcagaaaataatgaagttgtagaaaccattttcttggttactacatattcattggtattaaggaaatctcattttggatgcctgccttatgaaagatccagctgttgcctcattccttgagtttcactcttccattacctctgaagggactttagaacatgccctctcctcaccagcactgtggcaaggcaaggtgggtatttgtcatctccactgcatacttcctcatagagacattgtgagtgaaggtcaggctcttcaatgctgaagaatggtgacagtatgggttggcatatggaattagcgtctaatggcatttagtgatttagtagattgtgactgtgttgatctttgtgctcttaaacaacactgaacaaatatttcagtctttactatttgtgtggggcccagtagaaatggtcttgtaatatgctaaatacttccatttttataacatataaaagcagagcatggccctcctacagcctcaggaaggaggtggtggcatagatcctctcaagagaatacaggtttagaattaatctaggacttggcagaattctaaacctaggaaattcatgaattaaatcaatttctagagccagacataaaccagatgaaagtatcatgttgttttacttataacttctatattcttatctactatatctagtaaaagagaaacattatcaggtcagtttgtttatctaatatttcctgccagaatttattttttgtcatagcttcttgcatgtatgcaggccaggaaatgaatgttattgtaataaagtgtgatggaaaatccaggtaattaaaaaataaattataactatgttcttccttttgttttaatcaatttcagaagtgattggttctggcctattactaaggaaagggacagttacagaacatggaaaaggagggaggcaagtgaaaatgtatggtcagggagaggaaaagtagtagaattgaagggtagctgaaacaaagaaggatggtactaataccagggtgagttaatgaaccaaaattccatttttgacccattcagaacttctctaatggtcctcctagaaggtatagcattctatttgagaagtttattttgtttgattttaaagtccaacatatttacaagataatgtta

SEQ ID NO: 480013 - DNA, 2301 bp, Homo sapiens
ctccttgcctctcacatccggctaagacgactgaagtttactcaaaatgtaccaatgtccagtattgaacacaatgaaagggttgccagtgcctttgtcattgccagaaggaattaatcctgaagtctgggcaacagaaggacaatatggacgagcgaagaatgcccatcccattcaagttaaactacaggattctgcctcctttccctaccaaaggcagtactcccttagacccgaggccgatcaaggactccaaaagattgttaaggacctaaaagcccaaggcctagtaaaaccatgcaatagcccctgcagtactccaattttaggagtacagaaacccaacggacagtggagtgaggaacgtattcagcctataccagcttatcctcatcccaaaaccccaaagcaattaagagggttccttggcataacaggcttctgccgaatatggattcccaggtacagcgaaatagccaggccattatacacactaattaagaaaactcagaaagctgatacccatttagtagaatggacacctgaagcagaagtggctttccaggctctaaaggaggccctaacccaagccccagtgttaagcttgccaatgggacaagacgttcctttatatgtcacagaaaaaacaggaatagctctaggagtcctaggagtcctgacacagaaaagaaaggaaagggaaatagaagggaactgccaagcggatattgaagccaaaagagccgcaaggtgggaccctccattacaaatgcttatagaaggactcctagtatggggtaatcccctccaggagaccaagccccagtactcagcagaagaaatagaatggggaacctcacgaagacatagtttcctcccctcaggatggctagccactgaagaaggaaaaataattttgcctgcagctaaccaatggaaattacttaaaacccttcaccagacctttcacttgggcattgatagcacccatcagatggccaaatcattatttactggacgaggccttttcaaaactatcaagcagatagtcagggcctgtgaagtgtgccaaataaataatcccctgccttatcaccaagctcctccaggagagcaaagaacaggccattactcaggagaagactggcaactagattttacccacatgcccaaatctcagggatttcagtatctactagtctgggtagatattttcactggttgggcagaggccttcccttgtaggacagaaaaggaccaagatgtaataaaggcactaattcatgaaataattcccagattcggacttccccgaggcttacagagtgacaatggccccgttttcaaggctacagtaacccagggagtatcccaggcattaggcatacaatatcacttacactgcgcctggaggccacaatcctcaggaaaagtcaagaaaatgaatgaagcactcaaacgacatttaaaaaagctaacccaagaaacccaccttgcatggcctgctctgttgcctacagccttactaagaatccaaaactctccccaaaaagcaggacttagcccatacaaaatgctgtatggatggcccttcctaaccaaggaccttgtgcttgaccgagagatggccagcttagttgcagacatcacctccttggccaaatatcaacaagttcttaaaacattacagggaaccttcaaactctgtatactgccaaaggaacccgaaaatccaggagacaacgctagctattcctgtgaacctctagaggatctgcacctgctcttcaagcgacaaccaatcgaagctgtaaaactacaaatgcttcttaaaatagagccccagatgcagtccatggctaagatctaccacggacccctggaccggcctgctagcccatgctctgatgttgatgacattgaaggcacggcttccgaggaaatctcaactgcacgacccctactacaccccaatttagcgggaagcaattagagcagtcattggccaacctccccaacagcacttactctaagcgatgtaactcaggaatggaaagccaaacatcctatctatgtccatgaatatttctcccttcacttcttgtatcattttttggactacctttctctggtccctccctgattagcttaataactaaccttctgaattctttttcagctggggtagagtgacacaagcacttctgtggccaccaccactcgtattacactgtgtcagacctgaagccagcacagcactgggtcttgctcaaggcctgctgtgaccactacctggctacc

SEQ ID NO: 480014 - DNA, 514 bp, Homo sapiens
agccgcacctccctgctgcagccggaatgatgaccgcagctactgccatcaataccaacatgggcgaagagattccggaattacagaggccacaaggagaagcatatggtctgctgctctgtgaacctctgatgaccctgtatttatgtgaatgtctggggaaattcagacatcagcatgagtatactctagtgctggcccagagggatgccactctcccctgcttcccaagacctttagccacacgaaaagtgctgcattgtacagtcatgtacaaagttccctttgaaatcatgtattgccgaacttttgttttagggcctacacccttagcagactctgagccactcgggagttacctcccctccttaatccagacacggtattttattcgtgaagcagtaaatgaggccatgcctctccctgtcgacacctccttgtcctctcaacataactgtcttgcaggcacagatgtgtttatctgccagcccgaccctcaataaaagctacaacc

SEQ ID NO: 480015 - DNA, 1618 bp, Homo sapiens
ggagaaactatgggtcaaggtgtaggaactggcccgtggggagggaagactaagtcggcctctggcaggaagtccaggcccaggaagttgtagggtggggtcttggtattctcccagtatgggcgggactggaggaagccaccaaccaacgaagtactgggcctgtgggtattcgtctctctccccgcccctgagagtctgggaaaggctgacacgtggtgccttcaggctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatattgtgtattctaagagatttttcaagaagctgataagatatttgtaatttgagagtcaacccagaacaaatatgtgcagaagaaattgttggtgaaaacttgatttgttggctatttgagacctaatatatttatatatttaactgatcacagaaaacaggtgtattcaagacacccacattttaaaaatccttatctgcttcagtgggcattacttgtggcctcactgcacttctttgtacaaggctaatgtgtctggttattttgtaaacaggcctggattcttgagtcttgaatccagaagcagacaacgtgataacttgggaaaatactggagatgtatgctgacggagagattgaacaggccctgacccgaaattgggcttccctgacttctctgaattattccgggagctctgggcaaagacttgatgctaatatgacaaaggtgatatccaagtgtaaaaacctgttgttggcgaggccggacagagccaacagctgccagaagtccgggcacaggaagttgtcgggtggggcttccgttgaggaaaactttcagggcccagtgcagggcttgtgcccattgtctcctgttcctgcccctgtccctcagaagatggttcaggccaattcaccttgttctggagccatagaacctgagctccttatccttcttgctctaggcaacagaggcaccagacttttggtgtccctgagacctccagctgctgttagatgccacctcgaatgagattcatttccccctcctcacattctaactcatgagataaatccaagttgatcatagtttattgtcttttacagaactatggattaaatatgctcatatctttcaatttttaagtcttcacttataattgaagtgagtttgtatttttctcttcagt

SEQ ID NO: 480016 - DNA, 807 bp, Homo sapiens
ggtttgactttgagctagttagttaacctctctctgctcaggtttccttacgtactcaatgaggattgtcatagcagcagcaagctgcggctctcaggcagcaatgtgatcatgagggtacacaactcatacccctatatgagatatttaacattttattataaaacaggcttcatgttagatgatttttcccaatgttacattaatgtcaatgttctgggcatgctatggagttcgctgattaactctcttgaacttccagattgtttcacctcaccatttccagtaatccacggaaagtcacatcctgcagtgtatggaatggcacttcatttgaggctggaagaagtggaaaagccagaccttgtgctgaagctgcataaagaaggatctgctggagggagtttggatctcagcccaggagaggccatgagcgttgttgatatttggagacaaagtgatagtggtgacagccagacatctcttttgagcaagcagccaagggtctggcaggccaaggactcctcttgtgtaaacagaataggggtataaattcaggctgacgcagtctaccccttgatacaataatttggagccatcattttatgagaacaacatgtcctcatttcttttcttggatgaagaagcaatccttcaaattggtggccagttacactctcctaaaaaggcttattgaatgaggattattatgccaacataaagttcctgttactatactgtgtcccagaaccatattgtttacatatttatatttattttttatttttattttttaaaatttacttt

SEQ ID NO: 480017 - DNA, 543 bp, Homo sapiens
agctgccttgcatctctgatcatgaaagacccagtgaaaatacagttcatcttatcccatctagaagtgtgcttcctgctgacagtggctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagc

SEQ ID NO: 480018 - DNA, 1280 bp, Homo sapiens
ttttaagtgtttttcaaaagatgatgtttattctttgtgttggaggtggtggttcttcctttgcttctccttctctcgatacctccccttccttcctcttcctcctttttctcttcctccttaattttcttggctattctaagtttgttgatttttcatacatgattttacattgccttatcaattttttgaaagctgctgagattttgaatagtattttcatgagtgcatacatcaaatttggaagaattgacatctttaatgatattaagtcttccttccatgaacctggcatattaaatttatttaggtcttcttcagtttccttggcagtattttgtagttttcactgtacagatcttataaaaaattttgtaaaatttatccctaattgttttctctgtttacatgctgttgtaaatagaattatcttcttaacatcatttttcatttttttcattgctactatacagaaatataattgatatttgtatattgccctattgtccagtgaccttgctaaattcacctattagttctagtagctttttggtaggttccttgaaattttctgtcgacttcatctgttgtgttgtttatatctttatataagtactgactttctgcattttctgatttactttgagaaatgtgttaatttttcatactacagttgtagatttgtctatttctgctttgttacatgaacttatgtgttatgtatttaaaaatgtgaaatttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaatgtgaaattgtgtgcacaaacatttatgatttttacatctccctgttgaggttgtattatgcccctacgaactagtgatttttgtatcttccatttaattctttcttaatctttgaattctgttgttgaattcctttgccattatgaaatatccttctttcccattgagcattttttcatatgtttatttaccatccaaattatccttttgtgatgtctgttaaaatattttgcctattttattgttataagagatctttatgtattttgtgtacaattcctttatcagatatttgacttttatatacttgctcctaatctgtgatttgccatttaactttcttttttcatttcatttcattttatttttaactgacaaatagtaa

SEQ ID NO: 480019 - DNA, 676 bp, Homo sapiens
ctgggtgggtcatgttaaggaagcataaaggaactttggagagaagtgaaacaaccactgacctaccacccacttatctcgaagtttctgtgggtcagaagtctgggcacagtttagcaggccctctgctaaaggtcttaaaagagaccttcaaggcagtcaagagcatggaaagggtattagtggaaccaaagctcagtacttccagcagtgggaaggagaatactgaaaagctgcataatcctatatcaaggagcaaggtgcattctggctttgtattactttcctatgaagtggtagtttctggtgcatggaaagctgccctggagcagtggctgcaagggccttcagctgtcataggactcagtgtagacatcagccatcaggacccctaccctggttcttgtaccttagaggaccgcctctggccccatcaggcaaaggagttggagttggacataactgaatttgaagatagatattgcctggttccattccccgtgattgatctatactgacatagtttgcaaactaagagcacaacatcttgtgcacttaatatattctaatctggttcatctacctgatctgattaaaaatccaatatatggagaaaatgagaagtaaagcagcaaaggggaaagtaaaaagcaaatttcaggattgtggtggaata

SEQ ID NO: 480020 - DNA, 1839 bp, Homo sapiens
cccgctgcagtggtgagcccagccagagggaggcggcgtctctggtgcatgctcacttccctcttctcggcccagctcagccagaacctcaagggccccaagggagccacagtgaaggcccttgctcggcctctgaagggtcttttgtgtcctcatagtttgggccctgtcccctctcgcttggacgacggccccagcctcgcacccatcctccacatcaaggccagaggaagtgtccttgcccagatgcctggccacttctcctctcagcccccttcagtggcccctcgtggcctcaaggacaaagtccagctccacggccctgagccatctggctcctgctcgcttccccggagtcctctccccgacttcctccaggcccacattccagccccaactcgcgccttgcaatgccagtgtgggaaaggcctctgcccccaggatcccgcagccagcctggccagctgagccagcctaaggcagaggagggtcccccaactctccttccacctccttcagaccatgtggctccacagttggccctggggggaggtgctgccttggctcccgccctgccgtgaaggtggctcacagccccctttggcctggtcttttcccactggctcagtcctttgggggactcgctcacttcccatggacagcttggcttcaccctggacttccctgctgggcctctgggggcctgctgctgacctgtccccaggagggagctgcctctggcctggcaggtgcccccagcacagcgggcaggaccacagctgtgggacggcgcttgctcccctgtgccccggctacctcgcctgcccatcgtgggccagcctgggacaagaggagaacgggagactggagctggggggcagccaggccagccagactgggagggggtggccgggacccagggaggagaggggaactccccgctcccagaccccccgactcttcctccccagcccctcctcacccaccttcacactccagctctttctcctcccttggctctgccaggggctgtctcaccccctggactgctgacctgccgggcagtggccgctttgcaagtggcttctgggccaatgcccggaggggtggcgcgagaagactgaccaagaggaagagatttggctccagggcagtgagtggaaggctctttcccccgggtaccccgtctacccttcaaagagggggagggtacgccagccatgcctcaacaacagtcgtccatttcagaggctgcccagaccaccctctgctccctgcaggaaatactgaacctcttcattcattcattcattcattcaacacatattgaagcacctgtgctggtgatagaagagtggactcgaccaagtgtctgtcgccatgactttgatatcctagctggggagtcggaaggttacctgaatgaagaaggatgcctgtcattagatttggcaccccctgccccccgtcatgtaggcttactgtcatcacatctgcagataccctctttcctaaaagggtcccactcacaggctccagaatgtggacacatcttttggggaccagcacaccccgacaggcaccccatttctgaggacagcagcagatgtgtgtttttgtaagaaactgccaactgctttcccgagtggctgcccggtttgacatatccactagcgatggctggtgatgctgagccccttttcgtgtacctcttgacgacggtggggcaggaatagccagatagccatgtgagtcttctttctatacatcacccttcagagtcacaagccagtccccaacaacttctgcaagtgacccacaattaagaatattctgact

SEQ ID NO: 480021 - DNA, 1089 bp, Homo sapiens
tgggaactggacagtagagacatctggaagatgccaccttaaccacatgatcaaagtgatcatcatcagcaatgggacaaggggactggtgtcgtggcctcctgatgccatacacagagagggaagcagcacttctgagctattcccatggaaagtgcaaaacctggatggaatcatgaggaaacatcagccaagccccaacacacagaaatgctgcaaaatcactggcccatatgctcctgaaaactgtcgaaaaccacgaagaacaaagagctggtccagacttaaggagactaaagagctaggtcaactgcatagaacgtgtgatcagaggtgctccttttctggaaagaacattatagaaaagatattattggcacaatcaataaactctaagggcgtgagcagctgcaaacactggcctcgcctccctagcatcctgccctggaagttcttcatcctctttttgctctatgatgccttcaagcaggatgagattcagctacacagatgaccaaatatatatatatatacccatacacacacacacacacatacatatgtatatatgtatatatatatgtgtatatatgtatatatgtatatatgtgtatatatgtatatatatgtgtatatatgtatatatgtgtgtatatatgtatatatgtatatatatgtgtatatatgtatatatgtatatatgtgtatatatgtatatatgtgtatatatgtatatatgtgtgaatatatgtatatatgtatatatgtgtgtatatatgtatatatgtatatatgtgtatatatgtatatatgtgtatatatgtatatgtgtatatatgtatatatgtatatatgtgtgtatatatgtatatatgtatatatgtgtgtatatatgtatatatgtatatatgtgtgtgtatatatgtatatatgtgtgtgtatatatgtatatatgtgtgtgtatatatatgtatatacatatgtgtatatatatatgcaaacgaatgggggagagggagggagggaaggagtcctacagacctaacaagaatgggtgattatttgtaatagcaaagtactggaaacgac

SEQ ID NO: 480022 - DNA, 1700 bp, Homo sapiens
agccctagggaactgatctaccttcttaggcagaggatgctgactgtcatttcatggttgattgtcggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaatagggacccttggctttgctctgcagcgcatgctgcacatgggggtgtgaggggccctcagagactggttccctcagagtgctctcaggtagagtgtgtcccagccatcaggcggcaggcctggggttagggaggatcacttgcattcagaaaagtgagtcctgatcgaacgtaactaaaagtaatgcgtttttaaatgtcaaggtagccagtctggatggggaggctggagaaactcagagctgtggcccccagcacccctctgactccttgctcaaaagccagtgggtaagaaatagaccagtccaggaggcgctctctaggtcccctttcaggctagacgtacgttcagcacgtggcgtagggccgggggactggtaggtttacacaggagggtgggctccggctcctgcaggtgtgggggcaggggtgatgcaggtcagggcagagtcttgcttgactttacagagcgactatgttcagtgtcttcagaatgaagtatctgagcagatgtcacaggcttccctggtgggcaggcttgccctggctgacctgcccttcatttcgtagaactcccctgtgggttttgatgattaacttctcctaaatgtgggctcctgctttacctgttgtaagccttttaagact

SEQ ID NO: 480023 - DNA, 526 bp, Homo sapiens
ccaccctggcgatggcactaagaccacactcccctcatttcattggacttctcttccccttttcgacttggcagcaccggaagacgcattttccaggaaggctgccaagagaggagaaaaatggcttcaaagtcattcaaagcatcagagtccatgcttctaaaactggcaaaaagaccaatcaggccgggcacgctggcccttcatggagagacatcatgctaccccaaaagaatcgcaaatttgtgtctgtgaatcccttgtccacaagcttctgcttcaaacatgacacaggttccacaggggaaaatcggaactcagtgaaacagctgagtcctgggagtaaaggcttgcgcaggggtctgggggaggcccgtgtccaagtggtctaactccagaacccactcttcgtttcttggaatgttaaaatgtatttgaatgctaaaatgtgtcttgtcttgtctttcctgtgtcttgtcttttgtcttgtcttgtctttcctgtgtcttgtcttttgtcttgtctt

SEQ ID NO: 480024 - DNA, 642 bp, Homo sapiens
acagctatgatcttactacttgttatttgccagttcagatatttgagaggacttgggtgttgtgatctaaggtgtatcaactttaagaggcaccataagcccagtgacactgtggtttttgcagacccatagaggtacgacttttatggtcttggaccaaatccaggctcaccaaggccctcgacatagtacctgggtatcactgtttgctattcaggacccaagggctcttcagttagcaggtgatgagtgctggcaagaccggattcttttcttcaaggctgcccagattcctgagaactgccaggaggaaaggctaagtctgctgctccacagagactgtggttacccctcctcctatgggctcatgcccagggacatcagggtcctgtccctgagcctctggatggagttgttcaagttcctgcagggaggcaccacccagcctgaagaggtggtctggctgcagtctgccacagcaggtgtgttgagctgtggggaaaacctcttgggaccaagccatctatcctccctggctccagcaggggaaaagagtggcctggagctatagagatggatgccaccttccccccaccccatcgcatagggagcttaagagtgttaggcagttatgagttttgt

SEQ ID NO: 480025 - DNA, 658 bp, Homo sapiens
gacagcttagtttacactgtgagggtaaaaccgcctacttaagcctcagcaatgatggatgcccctccccccacaaagctggagcatcccagtcgggcccctcttctgaaggtctgctggagtttgctggaggtccgctctagatcctgtttgcctgggtatcaccagcggaggctgcagaacagcaaagattgctgcctgctccttcctctggaagctttgtcccagaggggcacccaccagatgtcagctgaagctctcctgtatgaggtgtctgtcgacccctgctgggaggtgtctcctcgtcaggaggctcagggaaatgtggtctccgtcttcagacctccgaagagctgtcattgtaacgaagaagacaaggtctgctgtggcctgaatgtgtcctcccaaattcatgtgctaaaacataatggccaatgtgatagtattaaaagtatggagcccttgaagggtttagaatatggctgcaacatgatcaggcctgtgtttttggaagtttactctagctggcaggattggagcattgagagactggaacagagaaaccaattaagaggatcaatgagagaatatatgtgaaagcacttttcagctgtaatgcactatataaatatgagttattatggttataactcacatc

SEQ ID NO: 480026 - DNA, 1046 bp, Homo sapiens
cggtcctcggaacccttgtttcccagagcgtggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtactttaacccaagcggtgagcccctggaattggactcccgcttctgggaactccgggacagcatcgtgcagtgtgagcttctcatgctgagagttctgcgcttccaggtctccttccagcatccacacaagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcagttgccatttaggggtcccggatgtcgaacaggagtgctggcctccaccgacgtcgccggtgtcccgggaggagggttgccccagcggagaaccgcttttactgaattgagtgggaacttgactgtgatcacaggttactaaacctggcttcccatcagaaacatctggggtgctttatggagagggctggatggctaggtggctggtgctgttctgcatagaggtagccctgcctctcttccctggcccgtgtgccttgtggaagaccacagcatttgctgatttttgcgtgtttattgtgtaatctcgtatccccagtcagctccttcctggaaaatgcgtcttccggtgctgccaagtcgaaaaggggaagagaagtccaatgaaatgaggggagtgtggtcttagtgccatcgccagggtggtcattggcaagtcttggccacaggattgccttcctggctcttctgggctcaagcagggatgggaccatggagca

SEQ ID NO: 480027 - DNA, 572 bp, Homo sapiens
ctctgtgagacacggatgcgcgtgcgcgcgcgatgcggggcgcagggtgcagggtgcggggcgctgcccgccggcctggggccccggggtgacgcgcggccgcagtgccgcaaggacacgcaggcccggcgcggggctcaggtgcctcgggcggggacccgtgtccccctacctgccgccgcaccacctgccgggtcatcctcccatccccacccgcgcctgtgcccgcgccgcgcccgcgcccaccccggcggcgcccgcgcgcccagagcaccacttacccgggcatgggcacggccgccgccgcggcctcggctccggcgggcgctgtcgctgcgggcgggcgtcaggcgggcaacgatccgctccaaggatggaaaggcctgggcacggggcggcctggccggcggcgcgggacgcgaccctctgcggcgggcgagggctgcggccgagtagaggctctgggcgggagcctgaggcaggtgcaagaggcctggacgcagcctcaaattctttcttgccttggacaaagagggccctggacatgctgtgtgccagaccagagctgaata

SEQ ID NO: 480028 - DNA, 643 bp, Homo sapiens
aaggttaaagcatctcatctgtcttgggggggcaacaaaggaagggaccttattaatggttgtagggtcttttgctcacctgctagagcctccaccccagagaatgcagtccatgggtggaaagggcagttccactgccgaggtagtggcagagaggctttcagttgcccctggaggctttgtccagggagcttttgaccagagaacaccagttggggtaacaggagaccctggttggaagtccccacctggttatgaggaatgggatgaagaacccactgtgcaatgctgctaccggtggctggctggaattccaagccagggagtcttatcctgcaagttcctgtggaagtgggatttgcaggctttcactgctcagccctttgattcagcctctttcctagaggttcatcaaggtgaacctgtcactggaatgggtcctgagcttgagtctgcaggctctggcaaggtactgagatgagcttagtgcctgaaacaactggcataggcttggatcctgagtccataaggactggtccggtactaagtcaggccttgaaacttattccatggaggtgggtgtaggtcctgggcacgtgagagctggcctgcagactgggcctgaagaggtggtgttagagcc

SEQ ID NO: 480029 - DNA, 1081 bp, Homo sapiens
agcttctgtaaacagggctgcaacaaacaaaggagtgtagatacctctttgatatactgatttcctctctttttgagtttctctctctctctctctcctctctcctgagccacctaaagctgagaatagagtgacacaagcacccctgtgaccaccaccactgtgactgtactgagtcaaatccgaagccactatgggggtttcacccaaggcctactataaccacttcctggctactgcttatgttagctctaggccctgggcctctacaatcagccagcagtctttaactcttcacctgccacattacccagagatgagcgtttctgaagttcatctaactgatgaattaacaagacatcagttggtgatccagacttcaagagcctgggtggaaggtagaccaattttaaaggagaggccactgatgcctggctctacctcaaatcatggacttcacacttcatacaccatcactgtgctccccagctgccttaggtgcagttctgacaggcctcagagcagcatgcactgtgcccggcaaagctgtggtcatggctgcctccacatagattttaaaggatgcccccagagagctgtggagctcctgtaggaaaccattgtggagttgaggccaccagagagaacccacaccagggtaaggcccagtggagccatggagtggggctgcccccaagactccagactagtatagtcagtgccgtttgattccagattgagagagccacaggcatgagactcaaacctgcaagagctgtaacatggactgcatctagtaaagccaagtgggtaaggccgcccaaatctgtagatgtgggaccttcactccagtgtgtctaaaaggtggaacgcccacccttgtgggcatggagggcagcacattgagtcaatgaagactattcttgagccttaagatttaatattacttgccatgctgaattttggactcatttggcacctttcactgcttccttcttttccagttctcatttttggaatggaatgtctgtcctgtgccttctctaccactgtattttgaaagcacatattttgtttgatt

SEQ ID NO: 480030 - DNA, 786 bp, Homo sapiens
ttgaagaggtggaatgggacaaggccatgagggcctcatacgctatccaaggagtttgaattttatctttaagatccttgacacaaatgaaaatgttccacagttgtcctggggcagtatggtcattttcacagtattgatgagtatccatgggcatggatgtgtttccatttgtttggtctttcgactcattggggacccagagagctcccagggcctttctgcttcttcctctacccctgtatttcacttggctctccaaattgactcagctccaggcccttcttctgcaggtctgctgcagtttgctggaggaccactccagacccttttcgcctgggtatcacaaatgggagctgcagaacaaaaaagattgcttcctgctacttcctctggaagctttgtcccagaggggcactggcttgatgccagctggagctctctggtggagcagaaaattcagccagccagatcttacctgaattcctaaccaaccaaaataataaggtataataaagtggttgtgttttaagttacaaaagcattggagaatagtttgatacacaataatacatagccagaacagtcagagatatgcaaagataaactgggctgcttctgatctgcctttggtccttggaggccaataactcttagatttgcccttttgaagatattttatagatcctgtaagcatgcttcatctttttattcttttctcttttgtgtcctctgtgtattttcaaatagtctgtcttcaagctgactaaatctttcttcttcttg

SEQ ID NO: 480031 - DNA, 859 bp, Homo sapiens
gtttaacagacctaaaacgtgcagagaactaaccagacaccgtgaatgatgggaggtggagggtgggcaagggatgtatccccactttctggcctttgacacaggcgcgtcgcgctcttcagctgaccgcgctgccgcctccaccaccaatgtgtccacacacgcgagcaatatcccaaccaaccttggatttcactccctgctctaccacgtggagcatgaccctttggaaaatgacaaactccaggtgcgatcccctccggagccgcggtgcgctgaccacttcgaccccagccttcagagcagcccagacagaaagcggaagtgcctcggggcgcgtggggagccaggccagacgcccctgtggggcgggcgcggggcgggccgccatccctctgcgccgcgcatgctccatgccccccccacaacgcgccccgttcccacgctgccgccgccccggccccgcccgctcccggcccgctcgtcggcgcaccagactgagactccccttcaggacgctcttcgcgagcggtacccagaggcgaagtcgagacaagcccaggagcccccaccccccgcccgcgtttcctggggacgcggcctcggagggcttctaggaggaggcggcggccttggcctcgggcctgccgggagcaggaagggaggccgactccctcggctgcccgccgagcccagccaccggtcccgaggctggctaaagagcatcctgtcgctgatctgcctggtgcttctgtcctcagatgcacggagtagtgcccacctgggtgttatttgagttctatgggcacagggtttgtcgtgtctttctttccaggagttgaaattgtagatgattttc

SEQ ID NO: 480032 - DNA, 1576 bp, Homo sapiens
gacaaaacaaggaggcagaggaactccagccctgccccctcacccccacacacgctgtgtcggagactgcaacagtcagcacacattcctgattgatcaggctccctccctcaagtcctctgcgatggctctggcgatgcttcgggactggtgcaggtggatgggtgcgaacgcagagcgctccctgctcatcctgggtatccctgatgactgcaaggaacatgagttccaggaggccgtgcgggctgccctgtcgcccctgggcaggagggagcagccaggctgcgaggaagagtcctttgagagctgggtggagcatgccaaggatatgctgcagctgtggtgccatgcgtcggaaagggagaagaagaggtggctgctggagagcttgggcggcccggccctggaagtcgtgagcggcctcctggaggaagataccaacttgtccgcgctggactgcctggcggcgctggggcaggtatttaggaaccaggacactcgaatgacttcgaggctgaagttcctgacctgcacgcaggggccccaggaggggctgtttgccttcgtggtgcgcctggaaggcctgctgcagagggctgtggagaagggggccgtctgcccagccttggccaattacctgcgactacagcaggtgctgtcttgggcccgccccagcgaggcactccaggataccctgagagggatgcagctggagaagaggccacctggcttcctggggctgctccggctcatccgggagatggaggcatgggcagccttcccagcgaggagccagcagggtgtggcctgggcagcggccccagtggagagtgaagacccagctgctgcccaggcctccccagcccaggggaatgccagcgaggctggtcccggagcagaagatgctgccgaggccgcttctgccaccaaagaggctgcaaggggagcccctgccgctggggaaggtgaaagtgcccctgcaggccccgaaggcctaggtcaggcaaggcccatagaggtcccctggggctcctccccagcccggatgagcagtgctgtctgggtgttcccaagaggtcttagctggggtccagagggcctcatccaggtgagaggccaggaagccaggaaacccccactggaggggctccagaccatcttggaggagccggaaaacgaggatgaggatggggccggggacgagggccagcccaagtcctcccagggcaaataggctcctagggccccggggcctcctctcctctcaggcagcagcgccttggaggcagacagaggccaggccagggccagtccctcaccccacattcaggagtaagggccccccacctcccccaaggggctctggtcaccacccccattccttccctgtgacccggatgaccacgtttgatacaaaatggggtggggagaggcgcccccccgctcccttgcacccagcacacccagccccagccccaaaccctgccgccacggggggctggcctggagggagccctgagtgggcagctgtggcctgggtgggggcacctgaagatgtctgcccccaacccaggcc

SEQ ID NO: 480033 - DNA, 581 bp, Homo sapiens
cacagcagaatcttcaacaggccattttatcattggccagatcaacggctgcctacagaatgttggaagagcgggaacagaagtacaaccttaggactatatctattctctggctcactgtcataatccacgttgaatggagcttgattgttgtgaatgttgtgctggtttattacactgatgacatatgtactggacctgatgatctagagagcctgaacctcagcaaagtttttagatggtctggaccacgttgggtattcaacatgttgttgtaccgcttaccacctaccactcagaaagaggcacggcatttggtgtggatgtttgaattttgtaggcaacatatgctacatttaattgtgccgcaccaatgcactcagcaagtcatctgtagggttgcatgttttcggggagagatccagggcaagaaaaggctctgtgacaggtccaggccacttgacccttatgaccatgtagattcaacaggtacaggacctttgacacactgggaggctacacggagcctctggcaagtcccagtaggagaaacacacagcaaagccctagagttttgaagt

SEQ ID NO: 480034 - DNA, 850 bp, Homo sapiens
tttcgggtcacaacctagatacacctttatcagcgcctgggaatgttcaagggaggcaaggacggaagcagaaagacagagatgatggtgggtagcagtggaggtggtgtgaagtggcaggattctggatacgttttgcgggagtccatggaaccccagaagctgctgataattggatttctgctatgctctctaacttgcctcttgttggagacagtagcttcctctcctttgcctttgtctgccttgggaatacaagaaaaaacaggatcgaaaccacgctcagggggtaatcacaggtcctggctgaacaacttcagggattacttatggcaacttatcaagagtgccttacctccagcagccattgttgcttttcttctcacctcagcactaatggggatcctctgctgcttcaccattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgccttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaaca

SEQ ID NO: 480035 - DNA, 498 bp, Homo sapiens
gttaccagagagactggggggccacattttgctctggaaagggaaagaaagtccagtgattttcttcgtcagacttagaatgagtacaagacttttctatgctatatttcaggccattattcgcatcttccaaaatgaggaaactgaggcactgagagcgtacataacttccctgagatcatacaactgtgttagaaagatcaatctggctgaagtatcaatagactgtggggctagagtaaaacaggatcagtcatccagagagagggcagagtataatggcaaaatagaaggctccaatgattgtcccccttcacaaagacaccactataacaactatctacataaaaatagcaccttcataagaaccaaaaatcagagcagaaaggaaaaccagacccaactcagctggcagccacccacagcactgaaaccagtgctaagcgaggggaattgccaattccagcagccagaacttgagtttatgtgagcctcact

SEQ ID NO: 480036 - DNA, 1415 bp, Homo sapiens
ctcgggacaggctaaccaggaggacaggagccccaagaggccccagagcagcactgacgaagacctgtaagtcagcctttgttagaacctccaaggttcggttctcagctgaagtctctcacacactccctctctccccaggcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaagaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttggctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatc

SEQ ID NO: 480037 - DNA, 574 bp, Homo sapiens
gtgaagacggacatgtttgcttccccttctgccatgattatctcacaaagtctttgctagtccaatttggagctctgaagcaaagattgcttggaggaggggtcccttttatgggactttctaagccattttaccctcgacttgctcagtcattggctggtggcctttctgagaagttgtgttcacctggaggactctcccttgcagagctctggggtgtgagattggatgcagggagggtgagcctggaggaattcttcaaagcaactctcacagacctatgtgttgatctaggtcctggttcaatagccctggttattgccccaagcaggactagaacaagttatatcatgtctatacagctcaaagatgtgggattaaacaatccaagaaaatatttggagcaggctacaaagaagtacgtaacacagcaagataaaatgcattacacacaaataaaacaaagggatcccagagataaatcaagtgagaagatggtggagcctgaagcaggcttagaacctcaaatatatgccaggaagtccagcctccaggaagacttccattgaccttt

SEQ ID NO: 480038 - DNA, 1422 bp, Homo sapiens
agtgaacagcaaggtgaagaaattgaatcatgccactgccctttatcatatcctgtctcccttctcactttctgtgtatgcctagatcacagcttcaggcccaaagcccacttaacgtttttctgctatcaaagtacactgtacccacagcattgtatccaaagaataattgggcttgcctttcacctggggaagctcttcatgagagtcagaggccagcactgcagaaaggacccccaggcctctcaaaaagtatcaagaaactgaaactcaccaggccaccacatctagacaatgagattccaggcccctcattcatcatgattgctctcttgcccctcccaagttcctgttttcccacacgtagttacatttgttccctgccatataaacttctaatttcagttggtcagagagatggatttgagactgatctttcatctcctaggctgcagcaaccaattaaagacttctctggcaatacttgtctcagcgattggctggctgtgtgaccagcaggacctagaccaaatacctggcattttggtaacataactagtctgttactctgggaaccggaactttgactaattatcaagtgtcgttgatctgtcccagatcactttcaataaaaaatgtcacagggtctctttaaacatataacttcatggagacaacaaaaatattaacttggaattactgaagaaacactatagaatgacagttttctaaattgttaagcatatatgcatacacatactgcaaatttttagtgctctgatactaatatttaattttcctgcagaaagtggtgtgtgtgtgcacgcgtgtgttttaaaagctttaaccacttgaggaaaagaacatttctatggtcctatctgatccacatttctttaatttgggtttaatttgggtttaatttgagttgtccaagttcttctgaaccttgttaaagtggcctgagctgttcttgccctgtgctgctctgccctaggggtattctatactaggtcccattatttcagcccctctgattaaatacttgctcaaaaatcattttcagtttggaatattatcagttttattcctaaagaattatggattctctcggaaacatctgctgtgcgttacttattacgttgggaatattttccatgtttcttcggccctttagctttctaattctctttcttgtgaatgtattttctacctagcagcctctgtccacactgtgtagaaacagtgttttaaataccacatatcctggtggagaaattaacttccagattgaatctaagttgtaatgtctgaagcttgcatgctatagcatttcctatttaacactattaaacattcccctctggctacaccagttcaggattttatttttatcctctgatgtgaactaagcttgattgt

SEQ ID NO: 480039 - DNA, 3042 bp, Homo sapiens
aaggaaccacttcaaaaggtgtcctatatctctcccctggagaaatgtacatcaaatacaccttgaaatacaaccaggaagctattagaggggccactgtgacaatgactgaccatgtccggggctgcagaaaatgtggagcagctggaacactccgacagtgctgtttaaacaaatattatttatcatctgtcaatattacaggcctgatggtggatagtggagatggggtcacttgcactgtccacatctatgagggttactccctgcctcatgcagtcactgagctctttgtagcagggagggacatcataaagcacctcacctggctcctctttgctagtgggtgtacttttccttgcatactctacaaggctttggtaaataacatcaacgggaagctgtgcaacatcgccttggagccacataaaaagctatgcgagaggccggagacatcctgagagaatacaaactgtcagatgggaatgtcatccacattggggaccaactgtatcaagtgcccgaagttctttttgcccctgaccagctgggaatccacagcccgggactctcaataatggcctccagcaacataatgaactgtgacactgacatccagaagaaagtttttgcagagattgtactgtctgggggcaccactctcttttctgggccagaggaaaggctcatgaaagaactggaacagctagcttccaaaggtacttacatcaaaattatggcttctgttgttcgatgcttctttgtgtggattggtatatccattcgtgacctctctgagcagtttcaaacaaatgtgggttacctctgcagattttagtgattatgggacatctgtggttcagagaagatgcttttaaagatccttgagctcagggaacaacccgataggtgagatcacagaagcaccagtgggaggtgccactgtccttaaggctttttcaggatgttgaataaaagtgttttcacattttatgtttctatatatttttctttgcacattgttgtaaatgttgtgcaagtatctatttgagtccccgctgaattcttttggctatatactgcctgggtttgattcctaaatcaagccctttcttgtttgatatttggtacttctgaaatagcagccatttgtcctagctgaaatatggaaatgaaatttaaaaatcttttcttcaagacgtataatagttaaaagtcagcttaattaaaaactaacatccaagatgtgcgtgtgtatgtgtgcgtgtgtatgtgtgcatgtgtgcgtgtttgtatttaaaaggccttcatgtctttgttttttatttacctcctaaaaccttgtctttttttgagcaaagtttttttcttctcagttgactgaattctgttttcttcatttacttctgctgtctctcctttcttttgcaccctctgctgcatgagggacctaaaatagtttataatagcctgagcttccttaaagaaaatggagaaggcaccagactccctttgtgaggagaaacatctgtttttccttatggaaccccaataatgtaaacagagaagtttatctcagttcttaaactgcttgattttgtattgcgttacctgatattttaactaaaatagttattgcagcagagcatacttgggtttttaaggaagagtgtagacacttagaaatgtctttgttaaaaaatttaagtgcactataaaagcatcatgttgtctagcctcataataattctccctttttggagacccaggattcagtgtgggctctgcccagagctcagtgatccagctaaaagataggcagtctctatctaaataaaattggtctctttataaaatcctatcatagatttctatacattttatgtttgacttggtaccaacctttaatctccccctgcaaccaccagacttattctttctatacattgagatgtaaattttgctatctgattttttatctaagagttgtttccttcaatatgcagatttagggctatttacttgacaactgacagagtaatgaaacaggtcatcaagagtttgctagtctaaggaaacaaaggaggttgtaggaatctataatatgtacttctatctgtatgcctaatacagctatgtatttatgttttgtgtacacaatgttttattactgaaaatatataaaagagatctaactaattggcttaagaaaataaaagtgcttgaatcaaatactttatcaggaaaaaagaaaagactagtcaaatgcttttttaagtttatgtaacttaagtaaaatcttttataaataagctagctttaaaattacttgttaggtaatattagaaatgtcttaagaattgccagcatacatttttgtttgcatttattaatcaggaaatttcatacttatccctgccaaataataaaaggtgtcaaaatttggcacaggggttacaaaactataaacccaaccccaaacaaaatatctttgtttgtgtaatttttataaataaggcattgatattggtttaataataatagctacattttgaatttagtaagattactgtaacttctaacattgtggctttaggtgattcagtccacaggcagtaaggtttgttatcctctctgtttcaaagctaaactataaactaaatttctcccaaagttagttcagcctacacccaggactgaacaaggacagcttggaggttaaaagcaagatagagtaagttatgtcaaatgtttttcactatctcacttataattttgcaatagtggttcaataacttcaaatgatgactattgcagttttcataaataatctaggtaaacaattaaaataaaataatgaagtaagtgtaatgggataaatacttgtggacaaatgtcataatatattaaattaaatactatacattttatttgagtatttcccaataaaaatatatttgtagaaaaacattctttctaaaaaaagtgtgtccttttaaaaaataatttaaaggtttttaaacgtcatgtataaaacaaggt

SEQ ID NO: 480040 - DNA, 644 bp, Homo sapiens
gattttgctttctgctatgacagtgcaggattgaaatgatagatccactgacagcttgcaccgtgcacctgtataagctgcagacactcaatgctagcccatgaaagcagccgggagggaggctgtactctacaaagccacaggggcacagctgcccaagaccatgggaactcatctcttacatcagcatgacctggatgtgagacatggagtcaaaggagatcattttggagctttaagatttgactgccctactggattctggacttgcatggggcctcctgacaatgtgatagaaaaggaaaactcatttttcaaggagaaattcaagctggctgcagaaatttgcataaataacgaggagccaagtgttaatctccaagacaatgataaaaatgtctccagggcatgtcagagacctgtgtgccagttcctcccatcacaggactggaggcctaggaggaaaaatggtttcatgggccaggcccagggtccctgctctatgcagtctcaggactgggtaccctgcatctcagttgctccagccatggctaaaaagccaaggtacagctcgggccatggcttcagagggtacaagccccaagccttggcagttttcacgtggtgttgagcctgtgggtgga

SEQ ID NO: 480041 - DNA, 2427 bp, Homo sapiens
cctaacaacacctgggtgtatttgagcttcatctgcagctggaatagggggaacgatgtttttggcagtagattctcatcccatttccaccaacacaacaggcccagagggaatactgccaggataccaccgatgctcacttaaggcccaagaactcttcaatcagcttgtagtgaatgctgccagacgtgggacttgcccttcagggaagtgggctcccctcttgcccacagaaggtgcagaaatgccatccaatagccaaatcctggaactggggactccaacacagaatgagtctcattatagtcaccacagttgggaatatgctgggtctcacctgaaggcagcacatctcaaaatctcacccaagacctatggcctactacctgagtatgactgctggttattcagggcccaaggatactatacaataaattatgtgagatattcaacactttattataaaataggatttgtgttagatgattttgctcaactgaaggctaattgatttctgagataaatagaaaattcttaccttatattgccatgttcagatgggtatcatagtatgcattttccatgtattttgcaaaactaatatttttgagtattaaaaaaattcttggaatatatgtaattattggggaaatgtgtatatgtatacatttttaagttatcaatttgtccatagtatgtttcttcaattattaaagtctttttatccccctttactaaaagtaaagccttttagtgatttcctaaactgctgaatattcctttgatgaatccatccccactgagagctgtcattttatcatttcagaactgactatggcctcatagtactgaattaaaaaaaaaatcaagcaatgttatattgtttttcctttctgtgcaattgtgatttttgacatgtctcatcaaaacattgaaaatttcacatgataaggcaaaagaaaatgtggactacttttcacttgctagaattagaaagtttacctaacctttctaaggaccaaaccaatatttttttttaaaaaagggaactggtgcttttacacaaagcaatgagagtcttgtaaaaaacaataatataaactaataaaggcagttttgattctgtcatatttatttcccagaactagtgccttttttttttttagtttttaaaacactttatgaaacaacttgaattacttttaaaggtcaccatttgcatttgcttttttaagcctcattcctcttatgtgagatcagcatgtgtgtccaccaagctttgattttctgtaacaaacatggaagaacactgacaattggaaggacttacttattcccaaatactgtatcatctattccactgatctgaggcattttctggttgaactggtacctgaatgctgagcatacagagggaaagccatttttccatttgaaaaatctgaacattacacaatagagataacaccacatatctgcagatgcctttctagtcaagctgtaatagctcttgacaaagaacagtaaacatcaataatattttaaagggaccaaaaagttattaaatccagagactgcagcttctttaaaccttgagtagcattttgcttggcattcaatacacccaagcttcattagtataaactcccatacttgagaatttaatagaatttgacaggatttcatctaaaatctcagctaattatgctaaatttaaacttcttatcatcttattaaaactaagactctatcctggagtttatattattaaactgattttctttatatactaaaaagaaattaattttataaaaatgaattattcaaattcttgccaaaaactgttgatattggtgaagattttattaaatgccattttgctacctttgttacatgtgtgtacatgggtgtatgctttatataattggcaattttatttacattgacacagttcaggagacaaggatcatgtgaaaatttttatataatgtatagttcagggaaatgtttcattctttgaaacagtttagctaaggaggcaaagagaaaaaatcatatttatgcaatattctattcattgtattgatttcttttgaaacttgatcatatttaatttctcagattaactgcaacaactattagtttcatagaaggtcatctgcatgtctttatgaaacttagaattgcagtttaaaaaatattttgactctgccactgattccctaggtgaccttaaataggtaatttacctctcttcattcctgatatcccaatagagataaggttaatgataattgccatctatttacctcacagttgtgttgaagatgtgatcactgtaaaatgcttttggaagctaagtgagaaataaatgcctattaaaattagtaatttacatgtgagtaactgataaataaaacaggttaa

SEQ ID NO: 480042 - DNA, 656 bp, Homo sapiens
actgacaccatacacggcctgtgtggccttctgcatcagggaaatggcctcaaagtggtgctccttccagaagcgattcctgtgggtctcagcccagctattcccaaagaagtggcccccagactgtttcctgcccttgtcctcatacttgtacttgccggtcagcagacccccagccagaggagggtacagatctcggccacttcccccagccggcatagttggagaggccaagctccacgaacttgccctcctggtgtcgctggtggcaagcacacagcgtctcttccactggggtgccgtggtcaggtgcatggttggccttggtggccaatttcactcagcagtcgccgccgcccagccccagcctcaggccgcccaggatgattttggactggccatcgctgtacatgaaggccatgtccagctcggtgtggccacgctccaggaaagcgtgcacggccgtggcgctggcagatgtgtccatgaccagagtatgctggtccagcacagagtatgctgatatcccaaggttttatataaagggaggataatgttttaaaatcttattttctgtgagaaaacattttaaatggtccattttcaaggtatgataaatctaagtactggcagccagcctgcggacgtgacaaacc

SEQ ID NO: 480043 - DNA, 1116 bp, Homo sapiens
tttaaatctttcatgcatctagaattattttgagataatgcactctgccaggactgggtccttcccttcaaggcagcaggtttgcttctggcccaaggaaagtctagaaatgtcatcccggagtaaaacaaaaagaattttagttgagcaaattgtcactcagctaaaagacaatttctcagctttctttgcatgtgttcatgtgactaagttctggttaatgagattaaagtggtcacgttatgtgatacttttcgaggaatctcctttaaaaggtagagatcacacatttcctttcttctttctccagtacactgtcaggaatatggatgtaatggctggaataccaatattcatcttgcgccatgaaggcacataccttaggaatggcagagtgcacaccgagaaggaatctgggtccctgaagatttcatggtactgccatactagctctggactgcttacttttgagattctatcttatttaagccaaccttattttatgtctatgctcacagaggaaatagggtttttttgaggcaatagttttgaggaggaagaggatgagtttgattttgggcatgtgaatatgaagtattggcaggtcactcaggtagacatgtagaagagttagagttatggagagatggtagggctgaattaaaccatgcaactttctgtgcttctgctctcatgctgtctggtgttattgaaatccagaagaaatagagttagctctacagagttcactctgggaaatgtttgcctacattagaaggccaatagccttctaacaggtgtcttcacttccagtccttgctttttgaaactactttatacattgtcctcaaagtaactccttaaaactggtttgatctgtgactactgactagagtctgacttttttatgctgacactcaaggacttccacaatctggtttgaatctactttcccagtttgtttattcactgtgttttctcaggcacctgtgctttactcagactgatgtactctctctgttctatttatgctccacaattttctcttttatgcttttgcacatactcaggatcattgccagcccatatggattcttggcacaaaatagaaaaagg

SEQ ID NO: 480044 - DNA, 568 bp, Homo sapiens
actgggtgatcaaagttgactggggtgatcaaagaaggcttcatggaagaggcggatcttgagttggaccttgaaagtttcaagtctgcctatcagaggttaaaggagttagagaggagaggttatatctggcaaagggaccaatgtgagcaaattcacacagacagaagaagaagaaaagaagaaaggaagaaaagaagaagaagaaaagaaaaagaagaaaagaagaagaagaagaagaagaagaagaagaagaagaagaagaagaagaagaagaagaagaagaagaagaagaaggaggaggaggaggaggaggaggagaaggaagaagaagaagaagaagaagaagaagaagaagaagaagaagaaggaggaggaggaggaggaggaggaggaggaggaggaggaggaggagaaggagaagaaaagaagaaggagaagaagaagaagaagaagaggaagaagaaggagaagtaggaggaggaggaggagaggaggaggaggggagggggaggaagaggaaggaggagggggagaggaaggggaggggggaggaggaggaggaggc

SEQ ID NO: 480045 - DNA, 1027 bp, Homo sapiens
gaatatgctttgagtcctgctggatagagccctcatggagaacctatgctagggcagtgaagaagggaaatgtggggtcagagcccccacacagagtccctgctagggcactgcctagtggagctgtgtgaagagggctaccatcctccagattccaaaatggtagatccactgacagcttgcactgtgccaactggaaaagtcacagacactcaatggcagcttgtgaaagcagccaggagaggagctgtaccctgccaagccacaggagcagagctgcccaagtttgtgggagcccacctcttacatcagtgtgacctgggtgtgagacatggagtaaaaggagatcatgttggagctttaagatttgactgccccgctggatttcagacttgcataggcttctcttacatctccatttttatctttgatcaacacaaatattttgagcgcccttctatacaacaagtactgtgctataggtatctagagtacctctactgagtatagagcaatgaacaaaactgacaaggccctcacccttatgagtcttgtggggaagagaaaacctaatcaagtaatcacacaaatgtcaaaagtataactgttgtgagtgtaaagtatgaaagctacatggtcctataaccttgttacaaaggtgaggcaactcaggtgtctagagtttgcttccacattcaaggttacacaatgattagcagaacaagaacttgactgcccctctgagtactgtgctttttctattacactaagttgcctctttttgccctcaccagtattaagcagggtcccttgtcatctgtttgcattggggtctttcagaaggcttggcaaatgataggtattcaacatatattagttcctctgcatgtaaactttctgaaagctctggagtcagaaaaacctgagtttcagtcctatctctgccattttttatgtatgtgactgtagcaagttatgtgttcattcactcaattaatttgatcaataatttttatatttgttgact

SEQ ID NO: 480046 - DNA, 631 bp, Homo sapiens
aaccagtgacatttgcccaggttgtcagggaatatgatgaaacctgagctgaatcggaaagttcagtgtgaggagggtactctaggcagaaaaagctatatatgtaaaagtatggaccggaaatacagatatagtgatgattgctatgaagaaaaatggaaggagatagggtggtcatgcaagtaccctccaaggactttgaatgtgacattggagtatgttgatgaagggacaaagaaaggtttggcagattacagcattgatcatctgtgctgtgtgctgcatttgaagcctgaaaaggcaggccatcaatattgggatgatgatgatgacaacaatgacaatgaagatgatgatggcgtccatccaataaaaatcaaggacatgcaggtttgttacataggtaaatgtgttccatggcagtttgctgcacctatcaacctatcactagatttgttatataggtaaacttctgtcatgagggtttattgcacagatttcatcactcaggtattaagcctagtacccattagttatttttcctgatctcctccctcctcccaccctccatcttccaataggtcccagtgtgtgtcactttcttctatgtgtccatgtgttctcatcattt

SEQ ID NO: 480047 - DNA, 4156 bp, Homo sapiens
ggcacccgcactacctgtcattccagatgcttaccgctttagtgcctctttcagcaatatgaagttaaatccaggtctggtgcctgcatccacaggggtggacctggagcctgtgtccactggagcaggtctagatcttgggttcatggtggccagcctgacagtaaggctcactgaagttgtcctaatgagataccctgcccagagaggagaaatctggcagcctggccacagtggctatgccaagctttggtgggctctacccagtttgaacttccaggtggctttgtttacactgagggtaaaacctcctactcaagcctcagtaatggcagacgcccttcccccaccaagttcaatatcccaggttgatctcagtctgctgctgttctggcagcgagaatttcaagccagtggatctagtttgctgggctccatggggcagcaatccctgccagctcaagtgtccttgggggtcatggtgtttcctgctaccaggattccagatgttcatggcaagagcatgacactctttgcctgttcaacttaccccttccccaggagtcactgagggccaggaatgagccctggtgcttgatttattagagcaaatttccttgagtcatttgggatataacactaaatcatactaatgaaataaaatcaaccaattgcacttatatcagatgctatacaaccataaattatgacatataattacctattgagattattatttacaatttatagtaactctgatttggaatttattttgctaatttaaaagaatatatttaatatggaagtagaatgtgatagaaggtgatgggatagaatgccagttaagtgcatggatttttaaagtaaggtctattggtttaaatatttgttacaatattgtggaaccattgggcaaattatattttgtaacttatctcagcctcagttttctcatctatgtgacagaaaaaaaagtctaccttatagtattctcagtgaagattaaatcaatgaaataagtcatatagaacatttagctcatggctaaattgccaaactatcaaaggtaaataaacataactggtgctcaataaatgtaagttatttctgctgccactactactgtttttagtcatttgaacatcataaaacaatctttaaaaatcatcatttggataaaaaatcaagtatattctttctatttgaatctgaccttttattggattatgacttatatgtctatttagcatattaatgtttacactttgtccactctagtacgttggtcatttaggaaatggtgctagtaaaaatatttgtgcataacactgcatgagaatcaacaattcagaatatacagctggacaatcaaaatgagcagtggccctaacaattcacaaggccttaatatctgactgaatattagcttacttttgacacataataaaggtgtggcaaaaatttaggtatttcaaaagccaaaattatatagcatgatcaggcaggtctgagtatggacagattcacaaagataaatgtctaatgtgtgctgtggcatattattctttactacaatccttggaaatagtatgaatttatgttctagttttccatacattaaactcttggggatgagtatagtctgggatagaatgactatgtggctaagttggaaacaggtgtgatttctgctttcttcagttatttaggtagtaataaaggcagtaggttggctcaagattgaagtggaaaatctgtgtctttacactaccaaatcatcaattaattttacttccaaagcattttgaacctggcctataaatgccccttaagttaacaatagtgatattcaagccttgtttgacatcccagagtaactctacatatttagagacattggccagattcttagatcaaatatattttaactataaaaagtatctataacatatagtacattttcttagggaaggaaaaaagtattataaatcaaatttaaaagggaattataactccaaaataattaggaatccctggcagtgtttttgagtggtagaggaataacagctaatttgattgaggcaaaggggaaatgaggaaagattgaacacattttcagaaacagaaaaaaaaaagccattgaaggagagtgttgattgatggaaaaggactcttttatgctcttaaaaataattgaggacctcaaagagctttggtttatgtgagttatatttatcaatgcttaatgttagaaatttaaaaatatttattaatttaaaataataaacatgtttacatgcatatttaatgacaaataactatatttccaccaatacaaaagtctaggttctctagagggacaaaacaatggaatatatgtgtgtgtgtatatatatatatatatatatggaatatatatatggaatatatacatatggaatatatatatggaatatatacatatggaatatatatatggaatatatacatatggaatatatatatggaatatatacatatggaatatatatatggaatatatacatatggaatatatatatggaatatatacatatggaatatatatatggaatatatacatatggaatatatacatatggaatatacacatggaatatatacatatggaatatacacatggaatatatacatatggaatatacacatatggaatatatacatatggaatatacacatatggaatatatacatagggaatatacacatatggaatatatacatagggaatatacacatacggaatatatacatagggaatatacacatacggaatatatgcatggaatatacacatacggaatatatacgtatggaatatacacatacggaatatatacatggaatatatatatggaatatatacatggaatatatatatggaatatatacatggaatatatatatacggaatatatacatggaatatatatatacggaatatatacatggaatatatatatatacggaatatatacatggaatatatatatacggaatatatatatacggaatatataaacggaatatatatatacggaatatatatacatggaatatatatacatggaatatatacatggaatatatatacatggaatatatatacatggaatatatacatggaatatatatggaatatatacatggaatatatatggaatatatacatggaatatatacatggaatatatatacatggaatatatatatggaatacatatggtatacatatggaatatatatatggtatacatatagaatacatatggtatacatatatatggaatacatatggaatacatgtggaatacatatatatggaatacatatggaatatatatggaatacatatggaatacatatggaatacatatatatggaatacatatggaatacatatggaatatatatatatggaatttatatggaatatatatggaatacatatatacggaatacatatatacgggatacatatatacggaatacatatatatgggatacatatatatggaatacatatggaatacatatatatggaatacatatggaatacatatatatggaatacatatatatggaatacatatggaatacatatatatggaatacatatatggaatacatatggaatacatatatatggaatacatatggaatacatatatatggaatacatatatggaatacatatggaatacatatggaatacatatatggaatacatatatatggaatacatatatatggaatacatatatggaatacatatatatggaatatatatataatatatgtggaatatatatatggaatatatatatatggaacatatatataatatatatggaatatatatataatatatataggaatatatatatggaatatatatatttggaatatatatatatggaatatatatatttggaatatatatatatggaatatatatatttggaatatatatatatggaatatatatatttggaatatatatatatggaatatatatatttggaatatatatatatggaatatatatatttggaatatatatatatggaatatatatatttggaatatatatatggaagattattacatattaact

SEQ ID NO: 480048 - DNA, 691 bp, Homo sapiens
tcctgccttgcttttctctgttctccgtgggtatatttcctaatgctatccctgcccccttcccccaccccacaacaggccccggtgtttaatgttccccttcctgtgtccaagtgttctcattgttcaattccgacctatgaagcaatgagtcagcaatctggggaaagtaatacactgaaggaccaaactactgaaaagcaaacccaacagctggtcaaaaggtcaatgtcagaagagcctcaagcaatgacaaggcaaaatgaattagaaaacactcttgaggaatatgaagagtatgaggaagcaattcctgttccaaatgaaggaaaaaagggaacgaggaacacagaaggctataaagaacagaggaaagatcttccagttaggccacaaactctattggatcttataagaactctttctcagttctgctgctgtcaaagtcagataaagtgcaaagaagggctatgaggcagttttgggcaatggcctccagctacattcatgtttcaatctagaatgggtgttgtctgttctctaggcatgggccacaattgtcccataacctcctttcatcattctgtgttggatcacctgttcaatagattccattgtctctctaggtttattctctcactttgataaagcatatgccacctaagaaaagacacatggaaaacaaaatttc

SEQ ID NO: 480049 - DNA, 1199 bp, Homo sapiens
agccattgggtcagggtttcttcactatagtcccttctgtggtggccagaaatatgtcccaggaaaggggacccgaccccatgtcccaagagagggttcttggatctcacacaagaaagaatttcagggcgagtccgcagtgcaaagtgaaagcaagtttactaagaaaattcaccaggacagtgctgaagagaagtccgcagatcagtcctcctgggaatttagttgtgagtgaatgtgaaggggagccagcgggctttggacaggtcctgcggcacagaaaccacagtccgtggcttctgagagaaaagggcctcgccgtcgacgtccggctcctcccaggtcgcgacgccccatgggcctttgtcgtcgtttctgggccaggacgacggaggaaggtggaccgtagaggggaggaatcacgtgaagatggggcgagtgctgggcgtgctgttggagtggacatcaaagaacaagatccagatctagagaaagaagagatgatcaagactctaatcatccagtaggggctgtggttgcccaggagctgcccagtaatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgcagtctttatgttggaaacttcaccagtaaaattctctcaataaagtttcacaattgtctgcaaagaagtcttgtgcaacttatgtgttgtattaagtcttaatgattaagtctttaatccattttcatttgatttttatgtatggtataagagtgctttggttatttggggtcttttgtggtttcacataaatggctatcagtggatttctcagctgaaatcttgcaggccaggtgagagtgggatgatatattcaaagtgttaactgcccctctccacatgtaaaccaataatactttatctagaaaagttgttcttcagaaatgagggagaaatatagaatttcccaggcaaacaaaagctgaaggagtccatc

SEQ ID NO: 480050 - DNA, 618 bp, Homo sapiens
cacccccttgtgttatctggcacatgatcctgttgctctgggactgattatgggatctgcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtgggtctaccacctctctgagctgatgacccagactcctgggccttttgttcagtattctcttttgctctgggcttcaattgtagagctctcagtattcttggttctctgaatgtccacctaggctaggcttttgt

SEQ ID NO: 480051 - DNA, 713 bp, Homo sapiens
tgcaactctgagacctgaagttcagccagagcttttcagagaagtctgcaaggtgctgcaattgatgtgcgcgccttcctgtgcacccaaggaagagggggcagtcagtggaaaggccttgagacaagagcatgctgacaagttcaaggaacaagaaagagacggttttcaaagggagtacttccagcttttgtccattcagtgtgatgtcggctgtgggtttgtcatagatggctcttattattttgaggtgtatgattgtagcaggacaagccacagacaaaacccctcagacaccgagttaaagaaggaagcagtttattcggctgggagcatgggcaagactcctgtctcaagagccgagctccccgagtcagcatcagccgctgctatcagccaagagtattctttacattcaaggatactgagagttctctggtcatcacgtcttcatttgtactcttgtaccattgttaagtggaagcaatagctgttgcatatacactgtgatgagaagaataacctttgagagttattttaaataacattttctctattttaactgaaattgtgtgattaggatttttagttacccatatgaccaagaaggggagctcctccatgtttttcaaacttagacgttcaatgtttagattcaaatatgatatctaatgtaggagtttttcttgtacacaagacgtgagatatggatc

SEQ ID NO: 480052 - DNA, 608 bp, Homo sapiens
atctttagaaatgctttggtagcgaacagtaatttataaatatggaagagaaaacccaaaatggatctgccgagcagcgagtggaagttagcatccgccaaaacctgttctcgctccccggctcccgggggaaccggcttggagaaattgaccatgataatagcaattatgaggatgaggatgatgagcgaccaggggtgaaacccacgtggtcgttgggaaggttcccgcagcagcagagagaaagtttgctagccacgcggcttgctgaagcacgtctgggcttcggagcggcgctcgccgagcggcccagagcctgtaagactgagccggagcggtccgcggcgaggctcggggtaccgggttccgccgggaccgaaggctctgctttcttggcatttgcggcgcgtactgcctcttcaggttctctaggctgcggctcggcagagcgctgcaaggatcctacagtctaagcagaaaataacaccacttatgtttcaatttatgctgcaagcttcacacctgttatatatttatatcatttatatgtaatttcatttgaaattaaaatgttattcactcagtaaagattataagatgctttctac

SEQ ID NO: 480053 - DNA, 782 bp, Homo sapiens
cacagataaacaagagggaggctttatgatcctggaggagtgaatataggagaaaggaaggaggaggaggattttagcctcttctacaaaaggaaagaaagtcaaaagggctgagaggttcagtgcaaggttcctggatgccctgctaggatgtggcttggaaacctgagaagttcaaggaaaatccaagaacaaactggcaaagacaactgtttaaagtcctggaaggagtcaggcccctctgctgcaggtctgctggagtttgctggtagtctgctccagaccctgtttgcctgggtatcaccagcagaggctgcagaacagcaaagattgctgactgttccttcctctggaagctttgtcctagaagggcacccaccagctggagctctcctctatgaggtagatgccttgcccaaagaggagaactctagagaggcagtctggctaaagcggctttgccaagttgcagtgggctccacccagtttgaacttcccagtggctttgtttatactgtgagggggaaaaagcctactcaagcctcagtaatggcagatgcccctccccccaccaagctggagcatcccaggtcaacttcagactgctgtgttggcagcgagaatttcaagccagtggatcttagcttgctgggctctgtggggatggggtccactgagctagaccacttgtcttgctggtgttccaggcgccactggggtatgaaaagagactccctgtagctagcttggtgtctgcccaaatggccgcctggttttgtgct

SEQ ID NO: 480054 - DNA, 753 bp, Homo sapiens
cccagccatctggaactaagaagacaggaaaatgtgggaaagtttggaacttcctagagacttgttgaatggctttgatcaaaatgctgatagtgatatggacaatgaaatccaggctgaggtggtctcagatggagatgaggaacctatcaggaactggagcaaaggtgactcttgttatgtgttagcaaagagactggcagcattttgcccccaccctagggatttgtggaactttgaacttgagagagatgatttagggtttctggtggaagaaatttataagcagcaaagcattcaagagaacatgccaccccaaaatatagcaacttggtatactaaatattttaaactgaaggaaattgagaaaactgaagcaggaaggccactctctcaccttctctcacctttcttctctgaagcaagccataaagaattctctggcctacctagccagaaagtaggtcataagaccttcattccagaagtgtcctgctctatacctacagaccaagaagaagctaaataaacagaccttgctgatttctccttggtttattaccattaggtcatacccattttgtccaatcatacttctccataactatccatctctccatcaaacctaagcatgaaaatacacaagtttacttttttctttgaatcttcatttctgaaggcttccatttcatataaaactaatattaaataaatttgtatacttttctcatattagtctgtcatttgttataa

SEQ ID NO: 480055 - DNA, 864 bp, Homo sapiens
ctaaatgagcatggtaaacgatggtgtctgctggggtctcatagatacctggggacttcattccagtgaagtggttctccttgatgtcaatacggcccaagctgtacttgcccacgtcttcgttcaggtacaggaagagctccaaggaggtctggtgggtggtgccatccttgacgttggtcactttcatggggactccttatttgaactcgatctcgagaatgtcaggggttctgggggctttggccgggtcctgggtcttcgtggagagacctggaaatgcttggttcttagggttctccaagattccagcctcattgctgatctgcatgaggttctcgtccatgttccacaggttcttgggagtgactgggatgggaatcccgtgttgctttgtgtgttccataaggtcatttcggaccttgaacctgttgtagaacttgggcatcctccagggagcaatgacctttatctgggggggccagagagtagcaggcctggtgagagaggtgcccaggaggtagtggtcctcatacagtgcgctggactggatggccagccagatgaactccttcacaaactccttgctgacttcctcaatgaacacctttttgcccccaagcttcagtgccttcttcctggcttcctcaaagtcttccttctggccagtgttggccacgtaggcaatgatgtcatagccttgttccttcattatgattttttaacctaaaaaaatggatgcttagctcattagtattcagcctttcttctctcgtatgaacttaatggtcactgagcacccacaatttctgatacatgctatatgattgttaacgtagggaaaaatacctaattatagtggat

SEQ ID NO: 480056 - DNA, 1032 bp, Homo sapiens
ggagctgatttcttgggtggttcactatacagggcccacagcctgtaggaatgccgggaactcgtgcctccaattccagatgctatgtccagcaaaggctctgtggttctggcctacagtggcggcctggacacctcctgcatcctcgtgttactgaaggaacaaggctatgacatcattgcctacgtggccaacactggccagaaggaagactttgaggaagccaggaagaaggcactgaagcttgggggcaaaaaggtgttcattgaggaagtcagcaaggagtttgtgaaggagttcatctggctggccatccagtccagcgcactgtatgaggaccactacctcctgggcacctctctcaccaggccctgcatcgcccgaaaacaagtggaaatcgcccagcaggagagggccaagatgcccaagttctacaacaggttcaaggtccgaaatgaccttatggaacacacaaagcaacacgggattcccatcccagtcactcccaagaacctgtggaacatggacgagaacctcatgcagatcagcaatgaggctggaatcttggagaaccctaagaaccaagcatttccaggagtccccatgaaagtgaccaacgtcaaggatggcaccacccaccagacctccttggagctcttcctgtacctgaacgaagacgtgggcaagtacagcttgggccgtattgacatcaaggagaaccacttcactggaatgaagtccccaggtatctatgagaccccagcagacaccatcgtttaccatgctcatttagacatcagggccttcaccatggaccgggaagagctggtgagcatgaacgtgcaggttgattatgagccaatcgatgccaccattctggaggatgggaagtccaagatcaaggtgctgacatcttgtgagggctttgtgttgcttcatttcatggaggaaggctgaaaaggaagagagcatgagagagcaaaagggaaggatgccaaactcattgtttcatgaggaacccaatcctatgat

SEQ ID NO: 480057 - DNA, 2435 bp, Homo sapiens
ctcacagtaacaatcaaaggtaaatagtttattatttatgatgtattcttctttgtggttttaataatacatgcttactgtgggcaatttagaaagttatatgcatttcatgagaaagtcattagagtactttcaaacctttctattggcttccaatcttgaatggatcagcacacacactctcttggtaacttgggcaaatcctgaagccaaggttcagcagacattggcttgttgtgctgtgtaccaggtccttatgattatgttttatttatcaaaagtattgggggcagggagagataaggggaccagaaatggagctgatattgttggttccaaagaggatgacactggcgaaggcattcttcctcagcttgtccagtcactggaacattccagtgatgagattgcagctcatgaaggtctgagtgaattcttcagggaagcgacactctgagtaccacagggaccagcagtccttatcaaagtgctcccagaaatatggcagtgccacagagagtgtgtctcattggagtacttgagcttcaattcatccaacacaaaggtactcttgggcagcctggggcttctgcttctcttcccgtgaacgcttctctttccgtggtgtgtcctttttaggctggctttccacaaactttttagcatcagactgggccatcttctcacatagttttgctttccccaagacagtgcagaactgaggctggttaatgcagatataggatttacaaaaattttctcccattgtgtgaattttgttttcactttcttgatggtgtcctttgaagcatagaagttttaaattttgatgttatttggtatatatatatatatattcagtatatatatagtatatatatatatattcagtatatatatagtatatatatatattcagtatatatatagtatatatatatattcagtatatatatagtatatatatattcagtatatatatagtatatatatattcagtatatatagtatatatatattcagtatatatatagtatatatatattcagtatatatatactatatatatattcagtatatatatagtatatatatatattcagtatatatatagtatatatattcagtatatatacactatatatattcagtatatatatactatatatatattcagtatatatatactatatatatattcagtatatatagtatatatatattcagtatatatatagtatatatatattcagtatatatatagtatatatatattcagtatatatagtatatatatattcagtatatatatagtatatatatattcagtatatatatagtatatatatattcagtatatatatagtatatatatattcagtatatatatagtatatatatattcagtatatatatagtatatatatattcagtatatatatagtatatatatatattcagtatatatatagtatatatatatattcagtatatatatagtatatatatatattcagtatatatatagtatatatatattcagtatatatatagtatatatatattcagtatatatatagtatatatattcagtatatatatagtatatatattcagtatatatatagtatatatatattcagtatatatagtatatatattcagtatatatagtatataaattcagtatatatatagtatatataaattcagcatatatatagtatatatatattcagcatatatatagtatatatatattcagcatatatatagtatatatatattcagcatatatatagtatatatatattcagcatatatatagtatatatatattcagcatatatatagtatatatatattcagtatatatatagtatatatatattcagtatatatatagtatatatatattcagtatatatatagtatatatattcagtatatatatagtatatatatattcagtatatatactatatatattcagtgtatatatagtatatatatattcagtatatatactatatatattcagtatatatatagtatatatatatattcagtatatatatagtacatatatattcagtatatatggtacatatatattcagtatatatatatagtacatatatatagtacatatatagtacacacacatatatagtacacatatatagtacatatatatagtacacacacacacatatatatatagtacacacacacacacacacacacatatatatatatatatatatatatatatatatattttagattttccattttctttattttttccttcctggaggcagctacgatcacctgaacgggtacttttctcaagtgtattgttcatgtgattgctacctagtatgaattttctctagatttttatttgaaaactaaaacattttaccaaaaaa

SEQ ID NO: 480058 - DNA, 1993 bp, Homo sapiens
acaagaaaggaaattggtcaatcactttgaattgggaacaaccattacttcttttgaaagatgatcttaaactctggtccacagcaactgtccaatggcattatgaatattaaaaaggaaagaaagaagatccaaataaacacaattagaaacaagaaggatgctaccactgaccccacagaaacacaaataaccaccagagaatattatgaattcctctatgcacatgaactagaaaatgtagaagaaatcgacaagttcctaggcacatacaccctcctaagactgaactggaaagaaataaaatcccatcatcctcataccaaaatctggcggagacaaaaaacaaaacaaaaacaaacaaacaaaaaaaccttcaggccaatatccttgttgagcatcaatgcaaaaatccttaacaaaatactggcaaatctaatccagcagcagatcaaaaagccacatcttcatgttaaaaactgttagtaatctaggtcaaattctcacttatgagctcagttttgtaaggtgcatattaataagcacatgctaaagtgccatctataaaatgccaataattttattagttgtgattagtacatagattcatttctattaattttctgtttttctttaccatttttctctttgttctttttttccctttcttgtcatgtattgaattgaccaaattttcatcatttatctcttacatttttttctttcctctatttgtctggaatttatattttctattttattttgatgattttctttacatttcaacaggtgcacttaagctgaaattgttatagtcagtgtctatattttctttcctcagagacaaagatcttagaatactttgattcaaatatatctcttccaatctttcatactattgtctagctttctaggtgcacattgttattaagcctcacagtaattattattataattgattggtacttttatttacagtttgattggaactttcgtgtagcgttaaccattactgattcaaatttaccaactagttttaccaatttctttcttcatcattgctcttgcctccaagcccttcatttcttttttcaaacttaagtacattttatagtagtaaacccacacattttgtctgtacttctttaagaagcattagttttttcttaagtttcttctgttataaaatacaattaaaatgtatttaaatatgtaaacacttgtactgacaggaatggcatataaagcctgatgagtaagggaatggttgttcttcatcccttctggctgtttttaacttgatattttactcaaaatacatttgatgtttttgttccttgcatatgggtggagagggggattttctaaatacctacatttgattatatgtctatcattatgtatttttaaattaatacctctattctcaaataaagaattagctctatgagggtaaagaacattgactaattttgttaatcgtcatatcaccagtaactagcactgtattttgcacatagattttgctaagtatttgctgaataaataaataataagcaaaattcaataaaatcaccacagttaggcagcaatcctgagagctaaaggcttaagtggaggtttataaagttaggtatgaaagtttagaaacagatgcagaggaaaagtaattatgaactaaagcatggcttataagtttttatctctgtgttgaagaggttggccacgtgactcactttgtccaatgggacatcagcaaatgtgatgcaagcataggtttgacaagcacctgtaactgagtccaaagctgatactgctgacggcatgacagccgtgctttgtaaaaagaaatactcttttacacatggaaaagcctcaactaactcctgtttttactgaagcaaatgaaagtaaaactttgttgtccattggagaacttagaatagaaaatctgaaagtgtttaattattgcaaaagtaatggcttatttatt

SEQ ID NO: 480059 - DNA, 2004 bp, Homo sapiens
atcatcaattgtgctgtgataaacatagaagtgcagggtttgtttttttttttttttgatataatgacttattttcttttgaatggagacgaggaatttattgagggctggagcaaaggtgacacttgttgtattttagcaaagagactggtggcatttttcccctgccctagagatttgtggaactttgaacttgagagagatgatttagggtatctggtggaagaaatttctaagcagcagaggattcaaaaggtgccctgggtgctattaaaagcattccattttaaaagggaaacagagcataaaagttcagaaaatttgcagcctgacaatgcagtagaaaaacaaaaacaaaaacaaaaaccatgttttgaggagaaatccaagctggctgcagaaatttgtataagtagcaaggagcctaatggtaatccccaagaccatggggaaagtgtttccaggccatgtcagagaccttcatggaaacccctcccatcacaggcccagaggcccaggagggaaaagtggtttggtgggctgggcccaaggtctctgtactgtgtgcagcctagggacttggtgcccagtgtcccagacactccagatgtggctgaaaggggccaatatagagctctagctatggcttcagagggtagaagtcccaagccttggcagcttccatgtggtgttgagcctatgggtacacaagaaataaagaattgaggtttcagaacctctgcctagatttcagaagatgtatggaaatgcctggattcccaagcaaaataaatgaggccataaggagagcccaatatgtagttaatgtttaatacaagttttgataatgatgatgatgatgatattaaacattcataaaattttcaaacaaataagttttgtaatatatgatataggaaaaaactgttatatttctgctgcaaaaaataaggcaaatattcagagataaaatgtaatggcttataagatttggagactgacagaataattcaaaatgaagctacactacatgtttcacagtaaatggtttcaacaattttttcttctcttatacacaagaaagaggtcatgtacataattttacactcccgtagggcttactccaacatatactcaattccatctctagtctccaaactctacctttttttttacttcagtcaaaatgttaaattgtgagtatgaatggcataattttataataatcttgagctgactctattttgttcgagtgaagcactgtggtctgcctcttggaatggtaagctgaatgttgtgggccaacactcttattgagaactaaaatggataaaaaataatttaaaaatccatgtgaaataactagtgcatgacatttcagtgagttactgttcaaccatgatacatgttttagtgagttattgtttatgatacagatgaaagagaaggaaagcccacagatatgaacttagaatttggggtaacattttcccagaggcatttgcagattctgaaagttaagcttaatggttaagttgagcattggtttcaataaacccactgacatgccaggtcatcaatgttaaagaccagggctttccaaggaggaatcaccttagtcaaaccatcctcatctgactgaagactctgagggagtataatttaagggaaaagagaagtagaactagaccagatttcacagagactaaactttatctttgaatgacaacaaccctgatggggttattggtaagggattactactttctgtagctagtctcctgtcaaaatatacttctaaatctaatgtgtaatattcctagggacagagataatatcattcaacatcttcaaataactctataatttttgaaacataatttatgatacacaatgaaaattaccaggcatataagtagttacagcaagtcaccaaaagctaaagaatattacagacatatgaaaaaaccccataagttatttaaataatagaggatttttttc

SEQ ID NO: 480060 - DNA, 676 bp, Homo sapiens
ggcgtatgctaataagttgtctgagaagacctacccctaatgtctttctttgcttttagacctataactaggcacaagtcccagcaggccctaaaggcaagtgcttttttatttacgtctgttaataaagaccaccagaagcagttgactttccgccgacaagaccggcaatacccctttactgttatactccatgggtatatcaatgctccagccctatgccatcatagatgcaggactaccagtagccaagaccctacaagaatgaaggtttgtgttacccaccagacaaagaaccatggccaactgacattcttgctgagaacaaagaatgcaagcaatggaaagtgggaaaagcatgacatcctgtttcgtcggaatgatttgtctgctgttattgacaattgcatcaaaatcacgttaaaatctggcctgcaagggcaattgcattttccaggcactaatatgtcctcacctgatagatgttctgatcatataattttactgtgcatgtaaacttctgcaagcatattcaatgttgtataatttttgttgtagagattgttcacttctttggttaagttaattccttggtatttaattctatttctagcttttgtgaataaagttagttttcttttttatacttttaagttttagggtacatgtgcacaac

SEQ ID NO: 480061 - DNA, 715 bp, Homo sapiens
tcttccccagaagagaagaggcatgaggagcccacgttgtccaggtgacaatttatacttccagttcaatgaaattattgctgtatctcctggtaaaatcattcctccttttggagctaagacctctgggccaacagagtataaggtcatgggaataagaaacaaaaactttcctagtgggtcactgagtctgctaagccaagaagatctgggaaggagtcagagagccttgggccagagttccagggtctctgagagtggctaccaggtgagttggacagtccgatttccagaggggtcccacacagatgggacacggcttaggagcagtcccgggctgcaggcattccttggcctggtggccagatttctggcacttgtagcaagcttctgggagaggcgggcctggaggaatgcctggccgctgcggtttaggcgtttggagttcttgtgtgctggagatgtgactggggtttgtctcacagtggaggtgggaattgaacaatgagaactcatggacacaggaaggggaacatcacactctggggactgttgtggggtggggggaggggggagggatagcattgggagatatacctaatgctagatgacgagttagtgggtgcagcgcaccagcatggcacgtgtatacatatgtaactaacctgcacattgtgcacatataccctaaaacttaaagtataataataataat

SEQ ID NO: 480062 - DNA, 4749 bp, Homo sapiens
ttctaactggtgtgagatgagaaccctgactaatacagattttggtccaggagtggttctagaggaacaaaattttaaggatggatttcttcagttggttttggggtttctaggttggctgcttaacatgattagactccaaaatgctaaggactctatttctaatagtatggagaacactgatagtcattggtgtaagctgtttagagaaatatgcagaataaatgcatttgatacttctgattcaccgcttttgagaggcaagaagtttagtgactctatacacaatatctttgaccgtatgtggaaaatcaagggatataatgaagttgtttggttgcttctaagttcactggacaaagtgatgaacgaaaacctttcagaaggaatggtagcagctccttcttgtacctctggtagaatttggctgtgaatccatctggtcctggactttttttggttgtattaactttcaaaattatatttttgcttaagttttaataagtacatttcttgtcttttttttctttgtctggaagtgaaatgtttatttattctcaataatcatagcttaatgttttactccaaataaaatgtaatacacttgttcctcactgatttcccactaggccttttataaacttttatattatgtattttgttaatatgtgatgaatttatatttgctatctttcagatgctaattattatcaaaaagtcttatgtggagaagaataacatctgattaatttaaaaaaaatacttaaaactgcacattccctgaaagcaatgctaaaagtacttaaaactacaaattccctaaaagcaattccctaaaagcacatacaaatattgaaacattgtgttttaattataatttatttaaacatttttctaatttcccttttacatatacgtatgtgttttgaccagtaagttagtgagaatgctgttgcttgccgtccaaatactcaaagattttctagatattttactgttacttatttctaatcagctctttaccaagagaatattttttcagttctatttttactacaaatatttcataatgttattatattttaacctttatttcagtttcagggatacatgtgcaggtacaccaacaatgtccaagctgagagccaaatcatgcattcaatatcattcacaatagccacaacaataaaatatctaggaatacaactaaccagggaggtgaaagatctctaccacaagaattacaaaacactgctgaaagaaatcagagatgacacaaacaaagggaaaaacattccatactcatgaattggaaaatcaatattgtcaaaatggccatactgcccaagcaaattacagattcaatgctattcctatcaaactatcaatgacattcttcacagagctagaaaaaactattttaaaattcatatggaaccaaaaaagagcccaaatagccaagctattttgaaatatacattagacttttgtaaactctattcaccctgctgttcttttaacactaaatctttcttcaaactgcatatttgtacccattaatcaacttgtcttcatcccctcacccactaccctccctggcttctggtaactgccaatcaactctctattttcatgaccacttttatacccacatatgtataaaaatgtgtgatatttgtctttctgtgcttgacttatttcatttaacataatgaccttcagttccatccattttgctgcaaatactaggatttcattcctttaatggccgaatacaatttgtgtatatgtacaatgctttctttatcctttcttcctttgataggtatttacgtcatttctatattttggctattgcaaatagtgctttacatgagagcgaagatgtcttttcaatatattgattttcttttcatgaatatatgcccagtagtgaaattgctgtatttgtaagcataaaagaaaagacttttttcataatcatgaaccataagggacctaaatttatgctacaatcaagcataccatagacaattttttttatgtatattgtaatatgtatatttgttctgtttttacaaatgtttaaagacctgtgcttggttattggcttgtaactttagagggatgacagttacatagatcttcaaataacaataaagaaagaaactagtcaaatggaaaattgcagtcacaaatttgaatagaaagccttacaaaattaagaactgttagctattacaaaacttggactcataaattaagtttctgtttggttacatggtaagttaggttgcactttgttgcataaaaattcaaattgtgaagacagactcagtctagtgacatactgcttagataatacaccgaaagcacaaagagcaacatcaaaataatttgggccttttcaacattttaaaaagaaatttttcctaaatgggcactatcatggaagtgaaaaggcaatcacagaatgaaaaaagtatattttcaaattataaaaggtatattgtccaggatatataaacagcctttacaattcagtagtaaagaatgtataactctattaaaaatgggcaaaggatttaaatagacatttctatgaagaggatatgcaaggaattaataagcacataaaatgctcaatatcatcagacattacagaaatgtaaatcaaaactacaattagatatcacttcacacctattagaatagctatggaaaaactaaaacaaaagtttcaaatagagtttggaaatattggaactgtcatggattgacattgaaaaagtaaagtaatgtaactactgtggagtactgtttctcagttcctcaaaatttagtcttggagttaccatataatccagcagttctactcctagatatacagacaagaaaagttataatataatgaccgcataaaaaggtgcatatgaatgtttatagtgacattattcacaataaccaaaaagtagaaacaatccaagtatcattcaagagatggacaagacaaatgaagtatatacatacaatgaactattatttatcaatatagataaatgacattctgatacatcctacaacatggatgaaccttgaaaatattatactaaatgatacaagccaaacataaaggggtacatatgaatgtgaagttcacaagtacttctgactctacatttcgtttttggcagcttagtcaagaaagcttgaaaattttcagaagcgtccatatggtgacttcagaatttttaatgatttatctcattcatttggttaaaaatacctgtcaggatgttgataatatcaatttggaggagatctttatatatacaaattttagctttttgtctctaaggccaaaattatcagtaagccttttgtttgtattttataattgtgtatagtatttttaccatgcaagcttttaaaaaactgtatatagaacaatgtttcattatcttcatttattatttctggatttggggtcatcatttgaaagattactctacaccttcctatgataaagaatttgacacatgttttcttctaatacttatatatttttatttttacttatggatctctgatacatttggaatttatattagtgcatcatatgaatactatattcagttttatattattccatataactatctggctttttaaaatatcacttattaaaatgtccctcttttctctaaagagtgaagattttgtcttcatcatttattgaatttccatgtgagcttgagccaattggggaagttgaaaaattctatttcattaattcgtctattgaagcaccaaagtcacttgattttaaaagaaattttcagtctgtttaaaggtttattagggttggcccgctctcattattctttattacagatttttatgtcattctttctcgttcactctttcaaataaactccataatcacttgtcaagctaatgttatttttaattgttttacattaaaatatatttctcttctgatcatttcaattttcttggtaaaacagaatgaaagatcaactaaaagtaaagatggaagagatattggaatttgaggaggaaaaatgtataaagtagctatctagaagaaaggagagctgtcattatatgacatcattaagagctcattttaggtttgtgttcttgaatttaaagggagatcagtctatagattgtgtattttcctctagtcacattcagctgcactgtactgatgggcaataaacaggtaattgcatttggtttggccaattttgtttaggaaaggcaaagagtagaagctgaagtataaataaaaagaatgattaaaataattaactatggagtttaattttataagaaaagagacaaggatatcaaaggaataaagggcgtatcaataaattttattgctagttttggtgtattagaggaaatgagctcatgttattagtgtgagttataataattaaacatttgtaccatttatttagctcttaatgttttccagacactctgagagttgctatatatgtagtatgtatttcttagttatttgaggtaagtactgttataatactcatttttaaatgagtagatcagtctattatgaaataagaagccaagagacacctataaaaaatctatacctaacatcatgtttaatggtgaaaggttgaatgcatttcttctaaatttgagaacaagaaaaggatatctgcttttgccacttcagtgttttattggagg

SEQ ID NO: 480063 - DNA, 593 bp, Homo sapiens
gcatactacttgatatggtttggatctgtgtccctgccaaaatctcatgttgaattcttaaacaataccttctatgaagaacgccgtagatggaattacccctatcatacaagattatctgaaaaagctgctggctcattattccctgcacaagcctccgcaactgccctatattccccgcaaagaaaccaagtgggagaggatggaggtttttgcaggacttgcgaaagacctacaagagacaccactggataatgctgagatagaatggtatacagatgggtcttatataagagaagaggatggaaattttacagcaggatatgctgtggttttattactagaggtaattgaagccagtcctcttccccaagccagatcagctcaagcggccaaattgattgccctgacccgagcttgtcaactggcaaaagacaagactgcaaacatttacactgacagccactatggggttgctcatgactttgggatactatgaaaagagagagtatatttaacctcctcagggcaacccataaaaatggacaacaagtatcacagctgttagaagctattctaaaaccaaaatgttt

SEQ ID NO: 480064 - DNA, 2076 bp, Homo sapiens
tttgttacctctgtggcacacaataatttaatgaggaaagaagaatacattcaagaaaacatgattatcaccgtgaatctttcttccacactgaccattggctgttctcctccaggtaacgtcaagaacttctccaaacagaacttcagcttctctagtgggggtgtgtgttcaaaaaacgggggtctcccattcccacttccacagctggggcactatcagtatttgagatgtctcctgggtcctgcaggagcagtctgctgccttcagagggtctgtggttactctcaggattgctggtttgttcttgcagtcgatctggagctaaaattcacagtgcaagcctttgcaatgctgctctatctggagctgcaatctagtcctacctcctgtctgccattatctgcagaagctccaggactacattacaatgtgacatttggaggggacaaatatccgaatgataaaaaccatttttttaacttttgttgatttaacgtctgttttatcaaatataagcatagctacttcttcttgctttttgtttctatttgtgtggaatatatttttgaccctttaaatttgtgtctgcagtgtctttaccagttagctgagttttttataagcagtatatacttggattctgtttttttgttttttttttaaatccatttcatcaatctgtgcttttcagtggagcatttaacacacttacattcaaagttaatattgaaatgtgaggttttgttcctgtcttaatgttaatttttaccttgttcctttgtagtctcaattgtgtaattgttttataatatctgttagttttaaacttttgtatgttttgatgattgtgggtagtgacctttcactacaatgtttagaagtcccttgagcatttcttgtaagactggtctagttgtaatgaactcctttagtgtttgcttaagtggaaaaggttttatttctcttttatttataaagcttagtttagctgaaacaatattcttggctgaaattttttcttttagaacgctggaagtagaaacccagtctcttctgtttttcttttaggtttttgctgagaaatccactgtcagtctgataagacttccttcattggtgattagacacttctttcttgctgcttttggatttttttttccttcacattgattttgggtagaatgaaggcaatataccttgatgaggttcttcttgcaatatatcttccaggagttcaggtgttctctgagcttcttgcatctggaattctaaaactctggcaagaccagggaaattttcttgaattatttccttcaataggttttttatactttttatttttttctccctatggaatacctgtaaatcatactttggatactttgcataatcccgtatttcacaaatgctttgttcatttttaaaaattgtttttctttatttttatctgactgggttaattcaaaacacctgtcttccagctctgaaattccttcatctgtttagtctagcatatttttaaagctttaacatgtgttttataatttcttcaaaatttttttgtttctataaattctgttttcatttaaaaatatttatgtcttctttcatattctgaattgttattctgatttctttgtgttggtttttaactttctcttggatctcactgagtttccttccaatccatattttgaattctttatctcttatttcagaattctcattttgattagatctattgctagagaggtggtgatgctttgtggggatcataacactatgttttttcatactgccagagttcttacactggttccttctcactgtaaaagctgtctcttcttattttttaatttactttcatttccctggaatatgtgactataatgtttgttgtgcatggtcatttggcttcactcattatagataggtgttgtggagtggctttctcaaatgtttcatgtactagtgatttactgggcatatgagcaggcacgctgacttctgaagtaccaggattgtggaggtctcagaaagcttctttctttccttagtactgtgtgcttgtgt

SEQ ID NO: 480065 - DNA, 500 bp, Homo sapiens
tacccttcacagcatctattgcacgtggctggggaggcctcacaatcatggcagaaggcaaaggaggagaaaagtcacttcttacatggtggcagtcaagagagaagggcaaagcaaaaggggaaaaacccctcacgaagccatcagatctcatagatggaacagcatgtggagattcacattgtgaacttttgcttcaaggactaccacaggaacatagcaggaaaaccaaaagaattcacagaacctttgaaggaagcagcttgccactgcaagcttcctgtgacagccaaaaaactgtgagtgcccaaggtgtgagagaagaaaggtccacttctgaacacaaatcatccctggggaacctgaaaatccacatcatggagaaggatttaatcttccctagagctaaaacaaatttagagtgtgaagcaaaatataaaggtagaagaagcagcagaaagagccctgtgggtactcgcaatccccaatgaagccatttt

SEQ ID NO: 480066 - DNA, 921 bp, Homo sapiens
cagttaaagaagactaactttggcagggagaaaagtttaattgctgtagaatggagcagaactctttggctgggagagggggagactccatgagggcctggcggggaactccagctagccgtgcagggcccttgggccatttgtcccaacctggtcaggaagaggagagtgactgctcacctgtctgtcccaaaaaaggaaggaaaaggccatggaaaggctgggttggactgaaaccaacatttctgacacccaggagcaataggggatggggcacagttgcctctaccctccgaagaaatccgcgggacccgaagcttaggagcaaaagagagaaaggtttttttgtgtgtgcttctggcatctttactgagaatcagttggatgcagatgcatggaattattttgttcagtttatccatgtgtttggctttatgcctgtggcatgctgctttggttactttgtagtatattttgaagttaggtagtgttatgcttatagcttcataatttttgcttaattgctttggctattgaaagtattttgtggttctaaatgaattgtagaatgttttttgctatttctttgatgaatgttattgatattttgatagagattgcattgagtctgtacatcactttgggtcattggtacattttaacgataatatttatctctattcaagggcacaggatatctttttatttatttatgccttcaattttttgtcagtgatttatacattttagtggagtgacctctcaccttcttggttaaatttatttctaagtatcttatatttttatagctattattttgactctgcttattttatgtttaaatgttaaacatctttattgaggtatagttgatgtacaataaactgcatatattaaagtatacaatttgttaagttttga

SEQ ID NO: 480067 - DNA, 828 bp, Homo sapiens
cactagtgacaataaagcaatataagcatggaaatgttaaatacaaaatgtctccctagagacttgttaaatggctttcaacaaaatgctgataatgatgtggacaatgaaatccaggctgaggtgatctcagatggagatgaggaacttgttgctgctccagctgtgcctgaaaggagcaaatgtagagcttgggtcatggcttcagagggtgcaagccccaagccttggcagcttccatgtggtgttgagcctgcgagtgcacagaagtcaagaattgtggtttgggaacttccgtctagatttcacaagatgtatggaaatgcctggatacccaggcagaagattgctgcaggggcagggccctcatggagaacctctgctctgacagtgcggaagggaaatgtggggttggagtccccacacagagtccctactggagtactgcctagtggagctgtgagaaaaggaccaccatccttcagaccccagaatggtagatccactgacagcttgcaccgtgcacctggaaaagccgcagacactcaacgccagccatcaaggcagccagagggaggctgtaccttgcaaagccatgtgggcagagctgcccaagagcatgggaacctacctcttgcatcagcccgggaatggactaatacaataataattcataaatgtaagatagcagcaaaattagaagtcaacagatcttgtgtagaggtgatagatcaaggctagaggcaaagtatattacggtatgaagacaaccacaagaactaaaagtagaaactcttaatggtgtttatttatgtgtagtgaggctaa

SEQ ID NO: 480068 - DNA, 823 bp, Homo sapiens
ttctcctatctgtgcagctgattccatatgtgcctgagcagctgcttgtctgagacgctaggtagctctgtgtgtcagactgaaggccctggtggagtgggttcacagggttatctcttgaccttaggcttgcaaagatccatagaagaagcatggtttcccaaggctgcacatttattcaccacttcactgggttgtggaggttccattaactccatgtcactcccaggaaaaatgtataatttggtttggctttgtgaagagacccattctctgtgcataaactctccaaattatagtgacttcagtattcaactgaaacttaagggagaactttctcatactagtataactgtattatataaagatactattgctgattctgtgataccaatattatggaattgcagagaagaaatatttctattcaagtttataatgttttctaatgtataaatacttaacagactgaaaatttcaattttaaagcagataaattaataattgataactcacattataaaataatcacattacaaagtaacctttacttaataactgactttttttaaagtagtgagatttttttagactaatgatactttgcctataagtgagtttaaaatttcagttcctatatttatatagaaacttttcaagtttagcctattttgatctcattttacatcctatctccacaagtattatatctgtaactaaagcaatatgaacaatttcaaagatatttttgcttgatttctatataaaaagcaaatagatataaatttcacttctaactaatatagaataataaatatgattt

SEQ ID NO: 480069 - DNA, 687 bp, Homo sapiens
ttgaagatgagatttaggtcttcgaagaattgccacagtcttccacaatgattgaactaatgtacattcccaccaacagttctgatgatggcaagggcagttccactgcagaggcagtggcagagaggccttcagttgctcctggaggctctgcacagggagttacctgtgtcttgatggttctggtggaggatggctggaatctgaagcctggagcacctgcctggtgcccaaacagcaaagatggtggcccacccttccccctaggaagctccttcttagggaagggcaatgccactaccagtggctggctggaattccaagccagtgggtcttatcttgtgaggtgccacggaagtagagccttcaggctgtcactgctcagccccctggattcagcctctttcctggggaacagatgtggggatcatgactacactttttcccaacagagaacttacacaagattacatgatccttattcccaactcaatcaaaaaggttggtgttaatggcatccggtcttgcaaaataattttcaaatctcatcacaatggaaaaagaaaactctggaagcttactatataacattttgcaataatatgcttcctaaacaaatagctaagccttggttttctttttgaattttctgacaaaatgttattttaattgaaggctttaaagttc

SEQ ID NO: 480070 - DNA, 587 bp, Homo sapiens
agctcaaggtttgtaaaggtaccagtcaaaatggaccaatcagctctctgtaaaatggaccaatcagcaggatgtgggtggggtcagataagggaataaaagcaggctgcctgagccagcagctgcaacccccttgggtccttttccacgctgtggaagctttgttctttcactcttcagctgtaacactcaccctgaaggtctgcagcttcactcctgaagccagcgagaccatgaacccaccggtagcgagaccacgaacccaccagaaggaagaaactccagacacgtctgaacatcagaaggaacaaactccggacacaccatctttaagaactgtaacactcaccatgagggtccacagcttcattcttgaagtcagtgagaccaagaacccaccaattctggacacaggtagcaagaccacagaagtaatggaaggatacaggatgccatacttcagtgactgtcaatgcctgactcagaaaaaaacaaactgacaattcaccttgtttaacagagagtctatatatacacgatgttgtcacactgactttgtgaaatagaactattacatttctgatctt

SEQ ID NO: 480071 - DNA, 1320 bp, Homo sapiens
gcgtagtgccgtggaaaagaactgtatctccacttcctcggttctctggaataaattacaaccttatgactcatgagtccaaacaggacagtctttacgtctacccatcttatgactgatgtggctctcaaggaacaataaaacctaagcaaattatgggaacaagcatttatcaaccacgcaaatgaagccattctttgtatgtattatgcatctcaatctccatatatggttatcaacgtaataattcaagtaaagagtttttctacaccaggagttccaaaatcaagctacattcaaagagagaaacaacacattggatactcaagttatgaaccgtgagaagagtcagaaattccttataggatagaacatgtgcaattgaaatctaatattaagttttctgtggaaaaacacatatatgtgtactatatggctatctgatcattttaaaaacatactcagaatactttaataaaacactgtgagtatgaattatctatgctttaaacactttacttctctttctgcatttatgccatcacttcttatctcttcataccttgaactttttcttttccccctctctcactctatgactcctgaacaaaactgtcatttccaatatctaacttcattaactaagtagggatggcagatgtttattatcaccaaaatgcagcataacatttgcaaactggtttatgacatgcatctttataaagtgctcagtgaaatgcataaacgattgattgaaaattggtcaaagagaatattgagtactttattagttactggctaaagctaaggagttacagaaaagcatcatatctaaataaggagttttatttgaaatatgtaatttcattatgaataaattccataaaataaactaagaattgctaaatgatttctaaggctccaccaatcgctgcacattacccccagcaaggacaccaatttaacaactatctacacagaaaaaaacacccatataagaaccgaaattcaggagttgaggaggagatcaaaaggaacactcctagttccgataagtggcaaaggaagaccttgaattcagatctgactctaatgtcagtgctcttaactattgtattagtttcctgtggctgccataacaaattaccacaaattgggttacataaaacagcagctatttattctctcacggttctggaggccagaagttttaaatcaaggtgtcagcagggtcacgctccctccagaggctctaggggaaaatccattccttacctcttccaacttctgatggcttcggtatttcttggcttgtagcca

SEQ ID NO: 480072 - DNA, 1728 bp, Homo sapiens
tgttacctggactccttgccttctgtcatgatttttttacaagggtgttctttgcaataccttattgggaacagctcccgtcgacagttcccagcgtgagcaacgccaaagatggtgatttctgcatttccatctgaggtaccggcttcatctcactagggggtgccagacagtgggcgcaggtcagtgggtgcgcgcacggtgcgggagccgaagcagggtgaggcattgcctcacttgggaagcacaaggggtcagggagttccctttcctagtcaaagaaaagggtgacagacggcacctggaaaatcgggtcactcccacccgaatactccgcttttccgacgggcttaaaaaactgcacaccaggagattataaaccacacctggctcggaggctcctatgcccatggagtctcgctgattgctagcacagcagtctgagatcaaactgcaaggcggcagcgaggctgggggaggggcgcccaccattgcccaggcttgcttaggtaaacaaagcagcagggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacccctgacccccgagcagcctaactgggaggcaccccccagcaggggcaaactgacacctcacacagagtactccaacagacctgcagatgagggccctgtctgttagaaggaaaactaacaaacagaaaggacatccacaccaaaaacccatctgtacatcaccatcatcaaagaccaaaagtagataaaaccacaaagatggggaaaaaacagagcagaagaactggaaactctaaaacgcagagcgcctctcctcctccaaaggaacgcagttcctcaccagcaacggaacaaagctggatggagaatgactttgacgagcggagagaaggcttcagacgatcaaattactccgagctactggaggacattcaaaccaaaggcaaagaagttgaaaactttgaaaaaaatttagaagaatgtataactacaataaccaatacagagaagtgcttaaaggagctgatggagctgaaaaccaaggctcaagaactaccaaggcaggccaacattcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagccgatcagactaacagcagatctttcggcagaaactctacacgccagaagagagtgggggccaatattcaactttcttaaagaaaagaattttcaagccagaatttcatatccagccaaactaagcttcataagtgaaggagaaataaaatactttacagacaagcaaatgttgagagattttgtcaccaccaggcctgccctaaaagagctcctgaaggaagcgctaaacatagaaaggaacaaccagtaccagccactgcaaaatcatgccaaaatgtaaagatcatcgagactaggaagaaactgcatcaactaac

SEQ ID NO: 480073 - DNA, 737 bp, Homo sapiens
ttatcaaaatgagtccaggaacgtccaccctgcaaagaaatttaaatttacatgcagttccggaaacttcaaggactaaaactaggagttacattccagagagagaaacaaatggctcagccccagggagatccaggttctgtctctgagcctctggatggagttattggagttcctgcagaaaagcctcacccactgaggaagaatgaatcagggtctagcctgaagaggcattctgtctgcagtctgccacgccagtgtgttgagctgtggaggacaaatctgagcagctctggagtttggacgctaggccccggtggcataggatcgctagtgggatcttccgatccatgggttgcacagttccatggaagaagcacagtttccccagttcttgttacttatgataatgccctttcctcaaaaaaaaaacagaggaattttaaactttatgatagtgtcaaaatgatacatcatcagtagaaacaatacttcaagtactcatacaaccattctggttttcactttcagtacgttattcaataaattacataagatattcaacactttgtaataaaatagactgcattagatgattttgtctagttgtaggctaatgtaagtgttctgagcatgtttaaggtatgtttggctaagctatcatgttcagtaggttaagtgtattaaaagcattttcaacttagtatattttcaacttacaatgagtttattgtgac

SEQ ID NO: 480074 - DNA, 739 bp, Homo sapiens
cagttattaacctactaggcaatgatattatccagatcagcttatcccaggaccttatcaaacaccttgatgaaatctagggatgtggcttcctacaagcaggactgcagtgattattatttctctcctgggtctagccatccagcagagcttatgggctctgggctggtactggggagtgtctgcaaaaagtcctgtgatgtgatctgtcttcaggtctctcagctgtggataacagcacctgctccagtggaggtgagtctagctgtggccgctgtgggggatgggagtgtgtttctcaggccaatggagttacgttcccaggggaattatggctgcctctgctgcatcttacaggtcaccagggaaatgggaaaccaagcagagctttcaggttttgcccctcctggtcgcagcttctatgctcctatctgcactttctgtttgcccccatacctccagattctgccctggaaaatttgtgctcagtcaaaattactacaaagttcagctggaattttccttctctctgtggtcttttcccagttccactggccgccctcctcaaggacccctgtgagataaagtcagaaatagttccttgggcttccttggggaccaggagtgcctaaagggcttttcccatggcttcttctacttttatatttcatttggctgtctaaatttgtttcagctctgggtaaagttaaatctttctcctgtgatctggattttcagg

SEQ ID NO: 480075 - DNA, 452 bp, Homo sapiens
aggtgctttatgtacactgtctcatttaattatctcaacactgtgaggcgcagtagatctatacagcctcatcatatggttccctgtgtcccagctgctccatctcgagccatagctaaaaggggtgaaggtgtgcagaagacaggagttgaggtttgggaacctctgcctaggtttcagaggatgtatggaaatgcctggatgtccaggcagaagtcttctgcagaagcagagacctcatggagaacctctgctatggcagtgcagagggtaaatatgagcttagagcccccatacagagtccccactgggcactgccaagtggagctgttagaaaagggccaccatcctccaggccccagaatggtagatctaccaacagcttgcaccatgcacctggaagagccacagacactcaacaccagcccatgaaaacagctatgagggctgtg

SEQ ID NO: 480076 - DNA, 1058 bp, Homo sapiens
gcaaagatccctaggaaggtcctgggcctggagcgagtgtccctggcacccaggcctctgtgggcatccctcagcatgcagaccctccccaagggggatgggctgccctccgtggcccaccagcccagctccagaagtccagaagctgaccctgaggccaaggcccagcagcatgaggggacttctgcagagccccgggcagcaggacactctctgggggctcagccgcccagagtgcagcaagtctgttcctatctcaggacagaccccaggattttgggcgatttctgtgtgggtgtcctctcccaaaactccccatgtacctggacatccagggctcatggtttctacagtgcagctttgagcaggcatgctgaactcctattccttccacatctgctctggacatcgccaggaccaatggacaggcccatccctgcaaccccagcagggctccaacaaccagacccggcccaccccactgaaaacccagagagccatggggctgcgatccagcccaagccctccccaaccaaagccctaagagaaaaaggacccaggggagccatgggtgccccagaaacagctaagatggatacacaggggactgagttcctgggacactggccagaactagactgtggcccaaggcagggcaagccccttaaagcagtgtgtgggtacgcagggcctgtgcatgcctggcagagccaagccagtgacgttaccaggctcaaagagcaaccatccacgacggccatggtggggcaggagcaggtgcattttgccactgggaaaagtcagaaaaggtggcctcagtccatgtaagcaggctccaaagtaggcaccatagctgcagggggagaaggagctcctggcggcactggaataggctctggcaggatcccagattctgtgattctgtcccccgcaacctgttttttgttttgtttttttttttgttttttttttttttttttccccttgagtgcttggaatcgtccccattttacacggagtctgcagccattgacaatcagtttattagaggacttgtc

SEQ ID NO: 480077 - DNA, 447 bp, Homo sapiens
caagttaacatttgtccacggatgtggacaaatatagctatcctctcaagtgcattttcccaatcacagtactctgtttgcagagtgaaatatgagttggagcccagtgtgccagagcctcaacaagaagaaccaccagctgaaagttgggatcctacacctggtcagaagagagaagaagatcagggtgcagctgagattcaaggtgctgggaagggaaaaaaagaatgtttattgggagaaggaggcctatatgggcatcatggcttatgccatgaccaagaagaagactggggtcctcctcaagttgaagaaattctgcctccaccctgcccttggatttgggctctcatatcacctctgccctggctctccagcctgacatcctgctctgggagatttggacttgccagtcgcaacagctgcatgagctaggtcttcaaaacc

SEQ ID NO: 480078 - DNA, 525 bp, Homo sapiens
gtccctgatattgtttatttgttgtcttcttttttttaagctgtcagttgtgcttaagttttatcaattttgtttgatgtataggtaaactcgtgtcatggggatttgttgtatagatgattttgtcacccagggcagtgtggaagcaaaatgtggggtggagcctctacacagagtccccactgggacactgcctagtggagctgtgagaagagggccactgtcctccagaccccagaatggtagatccaccaacagcttgcaccatgcgactggaaaagccacagacactcaatgccagcccgtgaaagcagctaagaggaaggctctacactgcaaagccataggggtggagctgcccagagctgtgggagcataccccttgcatcagtgtgacctagatgtgagacatggagtcaaaggagatcattttagaactttaaggtttaatgactgccctattggattttacacttgcatggggcttgtagcccctttgttctggccaatttctcccatttagaa

SEQ ID NO: 480079 - DNA, 597 bp, Homo sapiens
tgtaaaacttcaatttctaacatggactacaaagctctgtgtgatctcgtcatttcctgtttccatccacatcttgggctatcaaaatgttcaactgtaaagagtcaagcaacaggcaaatatctacctccctctatcttttccatcctgttctttcactccttttccgcaaacgagaaaggccttggggaatttttgtcccgggactcctcattctttcttcccatctcaaagccttttgatttatattgggaggaccatggtgtggttgcaggtaatggcaagcaggacacattcttccaaggctctgaagctgcagaggcctgcacaaggagctgtatggctaccaagatcctcttcaaaacccataagcagaagatcgtagttttcatctctgcagagattgaggaggttggacttaaagaaactctggacttgcagaagctagatgcagttcagggtgaagtaccagatttaacatagggtaaaaatttttcagtgtcaacacattttcagggcaaacttttaacttgacaatgctgtgagacatgttttgtatgttctgctctctacttcactgattttcaaagcacaaaa

SEQ ID NO: 480080 - DNA, 693 bp, Homo sapiens
cccagcaggggagctgaggtggctccaaccctttacccgataagacctcagtgcaactcactgagagctcctcaagcaacctcggtcaaggctggggcctctgcccagcattggtcattccatctccagccatggctaaatgggtcccagatgtgtctcaggccactgctccagagggtgcaagccataagccttggaggcttccaagtggtgttaagcctgcaagtgctcagaggaaaagaattgaagcttgggagcttctgcctagatttcagaggatgtatggaaccaactggatgtccaggcagaagtctgctgcaggggcaaagtcctcatggagaacctctagtggggcagtgcagatgggaaatatgggattggaacccccacacagagttcccactcaggtactgcctagtggagctgcgagaagagggccaccatcctccagaccacagaatattagatccaccaacagtcttcactgggctcctagaaaagccacaggtactcaacgccagcccatgaaagcagccaaggaggctataccctgcaaagccacagggcagagctacccaagtctttgggagaccccctcttgcatcgtgtggcctggatgtgagacatggaatcaaaggagagtattttgaagcattaaaatttaatgattgccctggtgtttcttggactagt

SEQ ID NO: 480081 - DNA, 999 bp, Homo sapiens
ccctgtagcctttttttttttttttttttgaccaatttctcccttttggaatgagaatttacagaaatcctttctctctcggtctgtaccgtccatgacaactattacaaatccagttagcatatatcaagtagtggggcagttttggaggcgattaagtcacgagcacactgtcctcatgaataaggttagtgttcttacaaaagagattgaagggaatgccctgccctgcttcacctcttcaaatgtgaggatgatggaaaagctgcctatgagaaatgggtcctcactagacatcaaatctgctggtgccttcagtttggacttcttagcctctagaattcaaagaaaactatcaggaacagagagattctttaatgttaaaagtggcaattcaccacaacgacctaaatgtgctaaatatacacccataaaggaacaaaacttcaaattgtataacacaaaactgatagaactgaaagaaaaaaatacacattagaaattagaaagaaaattagaaagaaaaggatgttaacgtccgatgagtaatcatctgacactacaaaactcactaagaatatagtaagtacacagaaaaacactgagtattatgaaactgtaactgtgatgtgtaaacaacacttatcctgagtagaaagactaaataatgaacaaatcaaaaatagtaagtacaacaactttgcaaaacatggacaacccgataagatataaataggaacaacaaaaagttaaaatgcggggagataaagtaaaggtgtatagaatttaacagtttcatttttgcttgttttttgattatgtaaagagtgttcagttgttatcagttttaagtaatgggttataaggtagtatttgcaagtctcatagtaacctcaaaataaaaaacatacaaaggatgcacaaaaaataaaaagcaataaagtaaatcatattacctgagaaaatcacctgctctaaaggaagacagggagaaacatt

SEQ ID NO: 480082 - DNA, 687 bp, Homo sapiens
tcctgcctaaaggtttgcagacaagaaagaaaacccatacccagaacaggaaactctcatatttcttctgccatgctcgatgtcaatttggaacttccaagaagcagattttcccctgtgtcttctcatgcagaagaagtctttcactctagccaccacagctgggaatgtgctgcatcacccaaaagccagcatgtctcagagcccaaggcccacagcactccctggatattgctcctggttattcaaggccaaagagctctttattcaggagttgatcaattctgccagaactgggctcttgctttcaaggcggtgtgttcccttttagcccaggagatatctagaaatgttatcttggggataggacctggaaagggtacctcacatctctgcctggtaccctatcctactatggctaagctggtatccaagatgcaaaacaaaatcctctttactctgttctcctctactaaagcagaaggaaagagtcacctttgttactgtgagctgcactgcctggggttggaggagggagggcaagagcactcccatagccatgccagctggtgtctccctaggtcatgtgccactctagtacactggctctaagcccagcctagtactaggaattgcctaggaattgcagttcttgtgtgctagactgccttccaagtttacctagga

SEQ ID NO: 480083 - DNA, 509 bp, Homo sapiens
ataactgctgtgctgtgctcactcaagtcccgtgtcacctggagcttcccttggatgtcccacaagtacctcaaattcaatttgttcaacagtaagcctattatctctcctcctccaatgtactgcttatcaatgtccccagttacagtgctgaaagctctccaatggctacccgtgaacattaaacaagaagtcagtcagtgtgcaactcagaagataagagaatcctcatcagaaataaacaatgctggcatcctgattcccaacttgcagacttcagaactggcaagccccttctgcctacaagcctgtaaaattaaaaagcaagttagttacttcctcgagacaatggaggtacaagtattgggtaaatacaactattcccaatgggagaaattggccagaataaaggagctaaaggccccatacaagtccaaaatccagcgaggcagtcaaatcttaaagctccaaaatgatctcctttgactccatgcctcacatccaggtca

SEQ ID NO: 480084 - DNA, 638 bp, Homo sapiens
ggaagctgaagtctgagagcagggtgccagcattattatgttctgaagagggctgctctcttccagaatgttgaatattggctaccaatttcttctggcctgtagagtttctgctgagaggtctactgttagtctgatgggtttccctttttttgagtgtggtccagaacgggagaaagctctgcaacaggtccaggctgctgtgcaggctgctgggcaagctgctctgccacttgagccatatgacccagcagatccaatggtgcttgcagtgtcagtggaagataggaatgctgtttggagcctttggcagctccccataggagaaccacagaagggatctctaggattttggagcaaggccttgccttcttctgcagataactactctccttttgagagacagctcttggcccgttactgggctttggtggaaaccgaatgtttgactacgggtcatcaagtcaccatgtgaacttaactgcctatcataaactgggtgctttctaacccatctagtcataaagtggctcatgcacagtaatgttccatcatcaaataaaagtggtatatatgtgattgggcttgatcaggtcctgaaggcacaaataagttatatgaggaagtggatcaaatgc

SEQ ID NO: 480085 - DNA, 593 bp, Homo sapiens
tgcttttctccattctcctctcatgagatctgacggttttataaagggcagtttcctgcacatgctctcttggctgctgccatgtaagatgtgcctttgttccctcttcaccttccaccataattgtgaggcctcaccagccacgtggaacttgtcatttacagtgcccctgccagtaaatctaagatgggtagagaaaaaatattttccttccctgcactataatgtacagcaaagcctacccacaagaaagaattatccaaccctaaatgtcaataatgctatgatcctatttgcctggtctcttccacacctggaggtgtcaccagtggaggctgcagagctgcaaagatggctgaatgctccttcttctgggatctctttcccagaggggcaccgacctgatgctggcatgaacactcctgtaaaagatcaatgacctggatacttctcctgatgttttcttgtaaaattttcatagtttgaggtcttaggtttaagtatttagcctattttaatttgattttcatatatgagtcatagaggtactgccttgatggtcttggacaagatccaggagatttctctgcatt

SEQ ID NO: 480086 - DNA, 770 bp, Homo sapiens
aattatgtcgtataaatatgatccatgtactacgtgggacatacttatattaagcaattatttattgttcatctgaaattcatatttaactgggcatcctgcattttatccagcagctgcattcctgcggcccacgtggtgaatttgagaacagtcagtgtgtgcgacagtcattactccttggagactcccactccgccagccgggcgcccttcgtgcgttcttggtgccacagcggcctccagtggttctctgaggaaccacacgctgtctccaccgccaggctccagcttgtccctaaagccagggcggaaggcggcggcgccctgtggctgcccaggggcctgggctgtgtggccggatcagagctgtaaggcacaaatccaagtgcgcgccgccgtggaaacaaagcccttccctgttgctgtgaagctcagaccagacagggttctatttcatcttccacgccaacgtgtaacgtatctgctgacccaattttacagatgttctcttcaaaacggactcggctttgtgaatatttttctctatcaagctgtggtgatagaaatgtcaaaaagcagtgggaaaggtaaaaccactggaattaggaccccctacccctgcccagtgcctcttaccgccaacctagcaacagcctcgcttcatttcctagaaagggcggcaccagcgatccattattgaaaacacgcgactcccataaccttgttcattttcatatgtgtagctcagggcaagaggttctctgctac

SEQ ID NO: 480087 - DNA, 563 bp, Homo sapiens
acttcttttgtggatcttcagttacttcaggccatctgggtgtatacgtgcaagtcacaggggatgcaatggcttggcttgggctcagaggcctgacacttatcaccagtataattgacggccattctagcctcccactgcatgaaggagtgagaaccacttcccaacataaagttgccaaaaaccaaaggagacgtcagcttatgcaggacttccaatctgcagccctctcccctggaacagctttggagaagttctcacttctttacctctttttcccgcagctcttcagagtgagcaatgccagtttcttgaatgctattgctgatgctgaagggaacgtggtcatgatggtcaaaggaaatgcacattggagcattttggattttgaattttcagatcaggcatgctcaaacaactggaatgtagagaaactgggggagcaagagagaacaatcatggctttggtcaccaggcaattgacagaagttcaatatctggtagccccatatgattggtcattttcttttcagcactgggagtccactaacctgttctagact

SEQ ID NO: 480088 - DNA, 594 bp, Homo sapiens
ctgatttacacacccaccagcacgtctgattatgttggctttgagtttgtcatgagtttgtcatggatggctcttactactctgcgaagaagacaaaaaagagggaaagtttggaacttactagagacttggagggctcagaagacaagatgtgggaaactttggaacttcttagagacttgttgaatgtctttgaccagaatactgatagtgatatggacaataaagtccaggctaaggtggtctcagatggaaatgaagaacttgttgggaactggagtaaagatcactcttgttatagagagagactggcagcattttgcctctgccctagagatttgtggaactttaaacttgagagagttgatttagggtatctggcagaagaaatttctaagcagaaaagtgttgaagaggaagcagaacataaaaatttggaaaatgtgcagcctgactatgtgataaagaagaaaaccccattttctggggagaaattcaagcttgctgcagaaatttgcatgagtgactaggtgcaaaatgttaatcaccaagacaatggggaaaatgtctccagggcatgtcagagtcctttac

SEQ ID NO: 480089 - DNA, 584 bp, Homo sapiens
acaaggtgtaccagagacaaggcctgtagttcatctgctcctcagcaccatgggtgtagtcactatcctgggggcatgcaagctggagctggggtgcttagggattcaaggaccttgggctccatggaggcctgagcagcagctctttccagcttccatgcagctctcaattcagtctggaggccctgggaggagggagcaagggagaatttcctatgcccaggattgcaaaagtctgtggcagaagtgtcagtctctaggggttctcactcactcatttcccacggtgaaaaagaagggaacttcctcaacctactgcatctatgaaaaacctacaaatgtcattatacataatggtgagggactgaatgctgtcccccaagatcaggaagaagaaaaatatgttcactctttccacttccattcaacactgtactgaagtttcaagccaggacaatcaggcaataaaacaaaatagagtattctggcagtcgttcaaattattaaacatagagttacctcgtatgacacaaatttcaccatctccttgactctctttttaattgtcattctaatccagattt

SEQ ID NO: 480090 - DNA, 614 bp, Homo sapiens
gagggtccgtggcttccttcttgaagtcagcagcaccctaccccatcattccccctgagaatctcactaccgtcctcctatttacagccctgactgaatgcatctctctcaaccacccatcagttgtttggaacttgagaagcatttttcccatggaaacaatgttacaaatggtgagaaggttcccaggccagtccacaaaggcctatttaaccaagaatatggctggactatagggcccatagcactagaaagccagccgccattaagattattgtttctatgggaaaatgtgctcccggggctaattgtggatgccagcagcaattccatagccctgtctagcctctggcagctggagcctggactaccccagtctcctctttccttcaggcttgcaaggtggaaaggtgaaaagtcccaggggaatcagagagagagcgtgggagaactactcagcttcaaaatacactataaggctacagtaaccacaacagcatggtactagtacaataacagacacatagacaaatggaacagaatagaaaactcagaaataaagatgcacacctacaaccatcagctcttccacaaggccaacaaaaccaagcaat

SEQ ID NO: 480091 - DNA, 680 bp, Homo sapiens
cccaccggaaggaacgaactctggacacatcagcattccaaggatggggcttccagagagccagaatgcagtgattgttatttctcttctggctgtggataccagcacctgctccggtggaggtggcaggggagtgaagtggactttgcgtgggaccttggttgtagttttgtttcgtgtgctggttttctcaaatgctggttgtcctggcagtaaagttgtcgtgtggacagactcaggacctctggctagccaggatgttacaggtgttgaggtagctggtgagcagggctgggaatttgccccaggctataagcctccccacaggactttcaggcttcactccctccatggcatggcttctgtgctcatacctgcacttccaattcgccctgaacccccggattctgccctggaaaattcacgcccagtcaaaattattataaagttcaactggaagtttccttctccctgtggtctttccccaattccactggaagcctcccaaaggatccctgtgagataaagtcagaaatgggtttcattggcttcgctcaggtctgggaatgcctgcagggctcttcctgctgcttcttctacttttatatttctctcagctctctaaatttgtttcagctctaggtaaggttaaatccttctcccatgatctggattttcag

SEQ ID NO: 480092 - DNA, 2368 bp, Homo sapiens
ttcagctaaagccaatttccaaagagagctgacagctgaaaactataagcccagcagctccagtggaagctagggaaataaatccttcagtcctgaaggcacatttggattgtacatttttaacaaccactagagtccatctcttctgccacttggacccccttctttatagaaattctgggagcatcaactccagaactctgagttgtcccacattacagcaaggtgtctgtgcccacaaaccttaccaatggcaagtcactggatgcaggctgcacctgaaaagggtaaagccctcctgaactggattagtgcccttataaaagaggccacagagagcttgcttgctatctttctgctttgtgaggacacaagaagacagcattctgtgaccaagaagagggtcctcaccagaattcaaccatgctggcaccctgatctcagactgccagactctggaactgggacatgggaatgctggtatggtttggagctgtcatgccacaagacacgtaggaagtgggaccctcatgctcatcttcagccctggaagaagcttagcacaagaggcaatgcagaaaggaacacctttaggcaattcctaaaagctggtcacagtggccagatactgttggcctgctctctttctcatgttttcttaaagaggtgactataaaacagtatcagaagcatcaagtttggaaaagaactaaaactgtgtttatttgcagatggcttgatcatttatgtagaatatccaatgaaatctacaaaaaaactactaaaactggtaagtgattttagcaaagttgcaagataaaaatcaatatataaattcatttttaaatatactaggacaaataatcaaaatatttttaaaaagtaaaggcatttccactagcattaacgtatgaaatacttagggatatatctcacaaaatatgtggaagacaacaacataaaaaaatagacaacagatttgtacagccaattcattgaaaaagatataggaatgtaagtaagcactacacacctgcatggatggctatgatgaagaaacagaaaacatcaagtgtgacaaggatgttgagaaattgaaactttcatacattgctggtgggaaagtaaaatggtgcaatctctgtggaaaatattttggaatttccttaggaagttaacatagggatatcatatgatccagaaattccactcctaggcgtctaccaaagaaaactgaaaacgtatgcatacacaaagacttgaacacaaatgttcatagcagcattatttctaataaccaacaagtgaaagcaacccaaagatccatcaactgaataaacgaaacttggtatatccgtacaataaaatattatctggccataaaaggactggagttttgatgcatgctacaacatgctacagttctgaaataattatgttaatttaaagaagacagacacaaaaagctatatattgtgtgattacactcatatgaaatatccatactaggcaattctatagagacagaaaatacattagtggatgccagggcctaggacagggggaggtggaaggaaggtgactgctaaccagtagtcttattgtgtctcttcttaaggtaatgaaaattttctagaattaggcagtgatgatggttgcaaaagctatgcatatactaaaaaccactaaattgtacactttaaatgatgaattttctcccaaaccaccaacatagaattctatgttcagcaaaattatcctttaaaactgaaagagaaatagacattcttatataaacaaaaattcagggaattcactcttggcagacctgttatgcaagaaatattaaaagttattcacacagaagccaaatgatattggacagaatctagattctacataaaggaaggaagagtgtcataaaatgaatacatgaagggcatagattatttatttaataatatatattataaaccataggacaacactaaaattttttacaaatcatgtataaattatatgcaaataaaatgaataaattggaatcatataaaatgctcacctaaaactagagaaaacagaaagagagggagaaaaagaaataaataaaaagaaaatatttgcaaaaatggtagatcaataaccactgccaatatgaattctctaaatatgccagttaagagcagaagttgtcagaataaattttaaatagaaaggtaaagtgcatattgtttataaaattaattatgaagattcaaataggttaaaagtaaagatgaagaaagttaccttatgtgaacactaatcaaaagaaagctggagtagctctcttaattttagacaagcaaactttagaataatgaagatt

SEQ ID NO: 480093 - DNA, 538 bp, Homo sapiens
gcagccctgtgggaaatcgagatgtttagtgtcatccctgaccttcactcactggatgccagtagcaccaccctcccctcagtaataacaaccaaaaatgtctgtagacattgctcagtgtcccctgaatcctttgcttcacactcagcagtgaccattatcatcatcatcacaggcatggaagagatttcaggttttgaagattatctgttttctagagctaggcctcattatctttctggatgtctgggtttcaactacagccaaatagaaagaaaaggagtgaaacaccaggaagattgggttctgatcttgtgtaactttggacaaatccttgcccttctctgtacctcatttggacatgtgtgcaaggagaaggtattttattatggtctcacaaatacagattctgatgtgagtccaaaatgaccacattaatgtttgcaaggtactggagaggtgagggtgagggtaaatataagagtgcttttagaaaactcttttgtaatgtttccaggtttgcactctgttcattatc

SEQ ID NO: 480094 - DNA, 683 bp, Homo sapiens
ctgtccactcagcctttttcctgctattttcatttatgtccaaaatgcaagagacaaagaactgtaagttctggcccttggctgtgctctccttagcctggctcacctatgattggaacacccacagtcaaggtggcaggcgttcagcttgggtacgaaactggaccctatggaagtatttccgaaattacttcccagtaaagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatggcttcaagtcagggcactgtgacaaatgtctctctctctggacaaatagtcatccttctggacaccagaaaacaactgaagccaaacatccaaagcatggccctggagcaggaatacttctcaatggctagagtctggaggcaatttctgccatcacagtagacaatagaagggatgtttgggcctccagatacatttcagtgggcacttttcttacttgaagttggagaaagaacagcagaagaaaaccttttactttctgcccattggcctggt

SEQ ID NO: 480095 - DNA, 760 bp, Homo sapiens
gttaaatcctcacaatacactgaagagatagtctgttctctctctctctctctctcacattctctctctctctctctctctctcgcttgcgcacacacacacacacacacacgcacacctctttttagtttagctcagaggtatggggtggtcgctgagtcaaggctctacagaaaaggtagctcaagaagttgctgtgggggctggtccttatgataaaaaactgagtactctgtgtaccctcagaatagtgggcaatggatgctggaaatgtgaacaactgttctctacatgtgtctcgcagactgtcatctttgtgtgtttgcctaatggggttccctctacctggaatgcccttgccttcagcattgcccacctaaatctaagctggcctttcaagtctccccatttcccttgctctgtgattcctccaccccaagctggcccagggcatccccacttcatttcctcatcttcttattggaccacagcacttactgttgggccttggattgggggtcacttggatttatgttggtctcacctctgaggctaggcctccttggagagcaccaaggcagtcttaactgttttgaggccttcctgggccccaacccagcaagcagtgcctgtcattggagatacttgatacattttgtttaactgaataggctacttaaagagaacaagctgtttttaagccccctcaaatatttcaaaagcactatttacacacttgagaatgtgttccagtcactct

SEQ ID NO: 480096 - DNA, 823 bp, Homo sapiens
atctgggcctgcagctcctgcctctcgcgttggtggcggcgcagtatgcgctgctgttcactcttcggatcatccatgatgttgaatggcaagcgggagttgaaatttgctggcagttcaagtaccgaacagaccagaagtcctcagcctgtcctaacggtcgctctctttcacctcaccggctctaaccgccgctctaggctcacctcagcctccgcttcccctcccccattcgcattcttctctgcctttggtcactgtgtctccatggccacgcccccgcaagtgctaggccacttgctgggccacccgcaaatgcccagtgctaggattggctgttgggagaccggaagtatgagcccattggaccccacagcaaaggtttttggcgggattcaaatatggccttcctgcaatgtgtgtggcagttgggcctgtagagtctttcgctgattgagagccgacttcatttccaagtctgcacacaatgcaggcagtagccatgcctgacagccacatgacagatactacaccgctgaatgtgctctaaccctggacttggcattgcccctactgttgaggaagcagtgcgtttttctccagtctttcaggtcccttcaccagggaaccattaacttattctgcagaaggaatgacaggtccctctgaatgtcaaatcccattgtgtgggtttgtttttgtggcctgaagtgcagaaaaaccagctttgcaaatgttgagctttcctgtctgtagtttgtgttaaggaaaccatagttattataatatcgaatgtgccttttccagctctgaactgaagcct

SEQ ID NO: 480097 - DNA, 680 bp, Homo sapiens
aaaaagggggtgttgctaaaggagagagagtgaagcaaataaaacaccatcagggaagcagagagcggccctcagacaacgaacatgccagaccttgatcttggacttccttttaaaaagcgtccaggcccagatggtttcactcacaaattctacgaaacacttaagaaagaaataatgtcagttgtacataatcttaaaaagaagaagaagaagaagaagaagaagaagaagaagaagaagaagaaagaagaaggaggaggaagaggagaaggacaagaacaggagggagaacttcccaactcattgccctgtggtgctagaagtgaggaagagaaagcagcaccatttaaaagggtttcagagagtgaagaccttagaggagaatttgatttcagtaaagcacaaaaaatgaagggaacgtataaagaagcagttgtggatacaggggaatggggacttccttctatatttcttgtagtgcaggtggtgatgaattcttttggctattaaatttatccaacacaaatactaccacttctaccaaaatatgtgtaccaaaatatttattgtaaagtcattgtaataaaaacaattcggacacataaatggccagcagtagtggattgtacatccatacaatgcaaccatcaaagagaatgtgaagatatatgctgatc

SEQ ID NO: 480098 - DNA, 567 bp, Homo sapiens
gtaaaggttctccaagtccccaccagactcaggagcccagctggctttacccagtggatcccgcactggggccacaggtggagctgcctgtcagtcccatacgcggcactcctcaacccttgggtggtctatgggactgggcgccatggagcagggagtaaagcttgcatggcaggctgcaggttccgagccctgccctgcggggaggcagctaaggcctgtcgagaaatcgagcacagcagctgctggcccaggtgctcagcccctcactgcccggggcttgcgggccagccggctgctccgagtgttgggtggccaagcccatgcccacccggaactcgcgctggccccggttcccacgtgcgcctctccctccacacctccccacaacctgagggagccagctccggccttggctggcccaaaggggctcccacagtgcagtggggggctgaagggctcctcaagcacggccagagtgggcgccaaggccgaggaggcgctgagagcaagcgagggctgcgaggactgccagcagctgtcacttctcaacactacttgactttg

SEQ ID NO: 480099 - DNA, 918 bp, Homo sapiens
ctgtggggccccagggggcagagatgcctgggcaaaagccacagggaaacagagttcttcagcttaatccaaaaaataattgtcttaagaactgtccaagcatgaaattggagaggaaggagatagtgagtgccccattactggagatgtgtgaacaagggctggacagccacattgtggatattcaaagagtagaggcggatggtctcttggcatcctctggcgaccctgtcatgagactgcctggctccatgaatgaggttactcacctgtgtgagatgcaacccaaggaaagagcactcactccttggagctctccaagggatggtgacttgagtctgtacctcccaagacacctagctcgatgtgataacatcatgtgagcatttgcttatgtggctgtgctgttctttcatcattggatccacaggccttgggcctcttacaatatcagcaacatcagcatctcaacacactgagtagagtggacatgtttgatgatacattttttttcataccgcatggctcctaatagcttcctatggggctcaatccagaaagcagcgattggtttcaacttcatgggcaattgaagggattctccggggtgattttgactacctgcaattgagtcttatagactgacttaagatgctaagctcatactcagaccatttttttccatctcaccagtttcattttggtccaagccaccatcatctcattggagcaatcccaagagcttcctcactgctttctctgcattcactcctgccttccatgctgtttgttcaccccaaagtggctagatcatttctgttaagatctatctggcttataatgtctgttttattatttttctcctccccttcactgtcattctcaccttctctgtgtgtatattttccccttcctctg

SEQ ID NO: 480100 - DNA, 1340 bp, Homo sapiens
agtgatgtgggacactgacatccacagaagttcagtgagttgcccaaggccacaaagtaatttccaaacccaaaatttcaacttagagattccttccacccctcctgggcactggttgcttcccagtgcccaatctacccttgaaccatagtagacaaaacattttctgagcctctccactgacactgaacatgcagaagatagccgaaagacatgatagtctccacctgctggatctggggtgcaaggcagaggcacaagttgctgtgaaaccagttgcaggtgatgatgacacccaagccaggggtctaagagtccaggtgaagcttcagctgagtttaaaggtcaaccccaggggccagggtgctggctctgtggccacagctgtagccataaggggctgcaggccgaagaaaccaggaggggccctgctagctctggctgatgatgacccagggccccacctgctgtgccccattgtgccaggcctcccgatcccactagtggtgcccaaggactcagttccttttctcaaggcactgtcctttgaaaccttccccacgcagccagccacaccaagtcagccagggctgtgtggtgggctcaggcccaggccattgtgatgacaatggcaaagcgtgacagagctcactcattcatttatctaataatcatagattgccacccacagggtgtcaggcaatgtccaatctcataaagcccaagagacttatcaaattcatagctctttgcttggggacctctgcctggcctctctccagctcagcaatttcttccccaagctctagagaggctgcccccagcttccatcccttgcctacctccagtctagactaatgtccagtggcccccgaactgacattttctggatggctgccaggctactcttccaggacctcatcccagctttgtcagaatggggctccagcccctccactcctgagcttaccttgcgtgggctatttagcccttgtctcccgttccctctccaaacactagagagtcttccccttgctttgctctatccaaggtgtggctgagccccatgtctcccagccggagccttctggatccagtctacattcatacgactcccccaacccccgctccacacacccctccctgtctcctctgccccagcacctcctctgtgcagctgtgggtagtcatatcaacaaagggagacccagggcagccagcggggaggggcctgtgaatcagtgtgggtgcgcctgtgtgaggggatggtgaggaggggatgggatgggcagttgcaggcgagtgggcgaatggggatggtggagtgtgtatctggggac

SEQ ID NO: 480101 - DNA, 505 bp, Homo sapiens
ggggaaatgtttggagccaagtctcctgaacttaacttttggttcactacttagtagctctgtgacttaggggtttagcatgggccacagagcacacacccatttgctgacccctggccccagacctggagaaagggagacatacattgccagagatcagggagaccctggtttgactggtgtgggaagaagccatctggtgtggagacatgcaaacacatatgcacacgcactaaggcacccaaatgagttggagcggactgtggggggtcttgtgacttcctatgtgactgtgccacacaaagacgctcttgcccaagtgtccagggtcttaatgaacacagggaaggacaaacgggaattgggtgctcttggtcttcagagatctggtggtgaccaggccttctgtgtcctcctccgaatcactgataaccttggtgtgcaggatgggatcaaggcccagggccctgtggcagctgctaaataactgcttccaggttgacat

SEQ ID NO: 480102 - DNA, 910 bp, Homo sapiens
cacccgatattgctgcaggggccaaatcagggctgtgagatgagcagcactctagtatggtggattagccccaatgctgtctgccattgatgagctggcattatgccaccagcctcttgctcgggctccttcgtccctgcattggccacagcagctcatcggtgatccgtgggcatgcagatttgacaagggagaggcttgacctcatcaagttgctggcatgtgttggtcacagagctgggatgtcagagatcctgcagagcagctgctcagaaccaatagtcctggatgaatactcagggccagattggaaggaccccaagatctcccttcaggctacagaggcccaaagcaggggaggaatgtggccccagtcaggcagcctgtcagtggcttacctgggactcaaactcggagatactgtcttccagtccagtgcctacatcaccacatcactccctaggcccactctgtggcctttggcaagtcctaccctgttggggacatacacatgtttgtggtggtggccctgagtctgcttgattttctgatgtctgtggcttggcaagacttaagaaaacccactctcggttgcctctgcatgcatgtgcgtgtgcgtgggtgtgtgcttgcatgtgtgtatgtgatgtacccttacctaccaaggctccgtcctcacttaggcctcgaatccactgccctgctactttttcctcacccatgcactcctccagcttctgcctcatcactctgctttccttcacagtgggacctctcacaccagatttctacactcaatgtgtctgcttcctcacagcccattctcacctctagctaccctagaggacttccatcctcactgaaattgctcttgtcaaagatcaccaatgacccaacattgccaacccca

SEQ ID NO: 480103 - DNA, 1104 bp, Homo sapiens
acggcccctcccctgagccttgtgggtaattggagggctgcctgctctgggctagtcggtcagcatgggctctccagtgcccactcatcgcctcatcacagaaggatcattaaggcaagaaaacaggctggggcacgtgcctgacaccccaggtggcacctcatgcaccacccaccgtctgcccttctccctggtgttccacagctcctggcccagcccaaagccagccaacagacctagcagggcaggatggggcaggttgaagggagaaggaggtgcagaaagaccgccatgcagccagcatggctgcctgccagctggatatggattcctccaacctcggcttctcaggaacacccgcttccctgggccttgctgccgggacccctgcctgctggggactgtgcttcaagagaaggaacagagagggctttttggtgttcttttcagggggtcttgctcccccttgccccatccagggcatgttattactatcagaaatatcagacatttcaactcaaattaaagtcaggttaaatgtctccactgcagaaattccacatggttccagatggagaggagaaattcactctcagccttttgccttctctccctccctccccaagagtagaataaaagcgttaacttatagtctgttttcagaccattcaatccagtcttctcagcttatagatgggcaaaatgaggcctagaatgagggatggccctgtccaagttcactcagcaagttagtggcagagctaggaccaggacccaggtgtcctgatctctagcccacagagttattttcatagcacacatctgcagccctgtcagacctagaacttctcttgaccttgtaaacttcgaaattgccaccagagatggcctagcatttctgatgttgggacaaaagcaggaagcagggcctcttaactcctggccagcaaaagtcccataacattccttgctacagaggctatataatcatgggcaagtccctaccctactctgggcctcactttcctcatctatgaaatgagaaatgcagaggcccattgttttcattcgctcagcatccattccttcttttctgtaactgcc

SEQ ID NO: 480104 - DNA, 688 bp, Homo sapiens
tgctccttgtgagcatctggtatgtaccaggccctgtggatgaaaacaaacatggtgccaccctcaaggagcttccagaagacaggtgtggatccacaggggagccagcacggcgggagaactgggaaacctcaatgtggagacccactctggagcaggacaccactctcatccctgagctgggggcacagggctagagcccagaagccctttgtctctgaccacagctatccccctggcttcccctccccctgcctgctgaccttgcctaccttagttgaacccaccgcacagcctcgaattgcagataaaattccttctcttttcttccccctcatcgtggccaggaaagctgaggaaggagtgtgtgtgagcaagactctgttcgtgtgcatgtacatgcttgtgtccagcaggggtgaagacaggtccaggcggggtaggggctgtgcctctgtgggtctgctgggaagaggcattgcaaatatatagaggatgtgtgatttcatgtttgtggggctgcacagggcctgggccactaaacatgagcaaaatttgtagcatgaatgtgtgtgtgcacaatgcatgtgtctgtgcacatacaaatcccttgtggcagaaaaagctgctagctcttgtcagagaggcagtacattagagtggtcaaaagcatggactttgggacaga

SEQ ID NO: 480105 - DNA, 969 bp, Homo sapiens
cgtgttgaattttaattgccattgtaatattagcaaggggctcatcttccaactaggacctcctccaagaagtccagtctccccttacccagggtactccaggtccccaattctgccaccaaatacctactctgtgctgggctctggatatacagaagccaagtggggaatggcaggaaacaactagtgacaggaaataaggatacaagcgggttgaggaatggcggcagccggggtgacaacagggagtggtgggggctgtggtgaagtgatctctcctttcgtctttggggaaagaagacacttatgaacggaaaaatgcctacagcaaatgccacccacttggtggcaactcagccctctttcctggtctctgccattcagggcatggcctgttgggaaacctccaagtttctgcttggaaacttgcagctgatcaaacacatgctaggaggtctgcgtttgaactccggctcaaggggtggctggtatgtggtccccaccaatgaattgcaggcagcagctgcctgctgtgggtcgccccacgaggaggagctaacaggactgagctttgtgggtgggggccaggcagggcccatgctgacttgggggagaaggacgcatgtgagaaagaaggctatccatgcgggcttgagggctgtgaggcctcagacactgagcccgtgtcatgcgggcagagagtaccatcaatatctgcagctgtcaaaactctcaactcagcaaaaacccgactcagacttcagcctggctggggcaggaaagccatgtccctgaagggcggcctcttggcagatgcaaagctggaggcagaaccacaaaggcccacatcctgggtcacctcccactcagaaccacaaagaatctggacaagaactctaacatttctctaaactgccagaatgcattgcctcttctcttccctgcccttcttttctcatctcctcaccc

SEQ ID NO: 480106 - DNA, 747 bp, Homo sapiens
ggtgtgcggcacatgtgcggtggtgtgagtgaggccgtgtgcctacacagagtggagaaggggtggtttatgtgtgggtgtgtgatgggggcatcagataaggaaattgagacatggggaggtaaacggattgcccaaggtcatgcagctgcccaggggctgctgggagtgaagactggagaggccacagcttggccagagtctgatggtaaagctgcaaggaagcagcaagaggatgaatgcccagagctgcattgcatctgggacatgctgcaccgggccttgtggatagagcacccagagagccagggtgctgggaagcgggcccaggcccctgctcctgatgccaagcaggctagacagcctggctcggcagtcacagacattccttattctctcaatgaatcctcacaaaaggccctgtcagacagcaggcctctgaatgccatcctccccagcattcttggcaaggcggctgaaactccagcacttttgctctctttccaggaagcatatctgaatgcaagaccctccatggctctcacccaaggcatttcaaacccttgcctgccccagagaagggaggagagagctggggatgtgaagaagagagagacctatctattgtttgtgggcctttgaaggtggggaccacaatgatacatttcattaatggtaaaaatggtagtggtgagcatattactgccaataaagatgttgacagtgtcaatggtagtgatgaaggtg

SEQ ID NO: 480107 - DNA, 530 bp, Homo sapiens
acaagtctatgagttaggaccaagatgtgctattggctgtgctgtgtgggaacatgtgggaagtgctcttgttccttatccctgacctggcagggcccttgggagaaggatacaatgaccaatcccttgtgtctgggttctggaaagagagccaaccacatcctggacttagagcatcctcctaccctgcccactgggctctgcctgcttgggaaggaacagagattctgccctctgtcacaggaggggtagagagtgagagagagaaattcacagagggtgcaagatccagacaccaagaagaggaagccccagcaactgagaggaagaaagaaggagaaagagaggaaaagatgtggaaaaacagaaaccaggcagacaaaaacagagagatagtaagagtgggagagagcctgcgagacacttgtgcaatggagagagagagagtgtgtgcatgagagcccaagtttttccatgttctgtgcttcctcctccttacctcactttgcaggcctgcctttcactctcct

SEQ ID NO: 480108 - DNA, 802 bp, Homo sapiens
gaagctccccaagtgaaagctgtcccttgtgaaaacggagcagcaatgggtggttgggagcgggcatgttctctccagactgcagtgggtatcaggcccctgctgctggagaggaaatggctgtgccattcttggtggcctttggtgaccatgggtctctcagagggcagaaggagggggaggtcagtggaggaataagcgtgtctgcccagggccacttctcactaagagggagggctgggcccccgagggcatggactctggggacctggaacttagacttcagagaagccaaagaaaagaatgagggacagtacccacgtgagaagaggcccagtctctacccctatccatcagaggctgcccgaaaacctgcccctaccccagccaccagttcctccctggatacctctgagtatccagagcccagccctcggctcctgacatttttggaccccccaaaaaagcaagcaggaggcagaagcattgaagtggctgctgacaagttggaacagcttaacaaattactcctaataaactaccgggggcgagaggagaggaggccggaagccagtctgctcccggagaggcacctccatctgtgccctggtgcaccgggctgccccctcagccagtctgcctacctggcctggcttccaggagagccacaggctttcctgcagtcccaggaagttcccttaggcctggagagggaggcaagccagaccctgggccttgtggagctacagcaggggctcctgacagctccctgggatgtcatcactgctgcctcttagagaag

SEQ ID NO: 480109 - DNA, 3339 bp, Homo sapiens
gtgaaaaagtcaagaatccaggaccgaagagggagattccaacagagatcctgccagtctctcccaggaataagcatagtggagttttttaaaaaaacatgaaaagatgttggattttatcaaatgcttcttctgtgtctattcatatgattatgtgatttttgccctttattctgataatacttcacagaatgaattgggaagcattatttccttgtatcagtcagggttcaccagagaaacaattggagagagatcatgcgtgcaagagagactgatttattataaggaatcagctcatgtgattagggtgcatgaagaggaggtaaagtccttgcatgatatctactcttcttctaatatccagaaaattaaatattatgatgtgaagctgccccaaagaatcccagagaggcccaagcccctgctctcttgtttctacctcttggcagcaggctcaggccctgtgactgtgaaggaggcagagagagggaggaagtataggagatctgcaggatcttctctgggatatgaaagagtaaatcccttgcgttggcccacaggagagataaaacgggaggtggaacaggcccagcagattcggtgatagatggggaagagaaaagctcctctcttcctttctacatcccatctttcatcacgtatacttttaatttcacattgtcaagattgatgacatttccataagcctaattaagtcttccgtggcttctctgcatgttgattttaaaagttgaaaacaagcaataatggcattatggtggctatgtacattgtgtttccttcatatccaagtagtttatgatgcaaccatttccctttcttagccttttttagacagctttttgttttcctggagctttcctttcttttcttttttttttaaattaggacaaaatacacataacataaatttaccattttaaccattgttaacatgtacaattcattggcaactagtccattcatagttttgttcaaccatcaccactatctagctccagaacattttaatcttcctaatggaaaacttgtaacattcccctctccctccaacccctggcagcccctctactttctgtctgtggatttatctatcctgggtacctcatataaatgaaatgatatgatatgtggtcttttgcgcctgccttgtttcaaagttcatccatgttgtagcaagtatcagtacttcatttcattttgtgactaaaaaatattatattttatggatatgccacattttgtttatccattgacagacatttgagctgtttccaccttttggctactgtgaatagtgctgctataaacattcgtttacaaatttttatttgaacatttctttttaattctttagagtatatatgtaggagtaggattgcttggtcatatggtaattttctgtttaatatattgagtagtcaccaaattgtttttcacagtgtgtgtaccattttacatttacaccagcaatgtacacaggtctcaatttcttcacctatcattttctattttttaaattatgcccaatctagtggaagtgaaataagctctttagctttgatttgcattcccataatgattagtgacactgacaaatttttaatgtacatgttgaccatttgtatgtcttatttggagaaatgtctattcaagtgctttgtccatttttaaattgggttgtttgtctttctcttgagttgtaagagttcttcatatagtccagatagacccttacaggcacatgattcacaagtattttctcccactgtgtggaatgtctttttactctcttgatagtattccttgatgcacaacagtttttaattttgatgaaattctattaatctattttttattttactgcttgtgcttttagtgtcacatctaaaaaaacattgccaaatccagtcataaaaatttacttctgtgttttcttctgagagttttaaaaaataatcttcactcttatatttaggtatttgatccatttttagttaatttttgtattcggtttgaggtaagggtccaacttcattcttttgcatgtagatatctagctgccccagcatcatttgttgaaaagatctttcttccctgttgagtagtgttgacacctttgtcaaaaattagttgaccatagacatttgggtttatttctggactttaaatttgattccaatcatcaatgtatctatccttaggccaggaccagactgttgtaaatactgtagctttctagtaagttttgaaagggtgttgaattttgtcaaattatttttcaacataagttgagattagaatgtggatttttccccttcattctgttaatacggtatattacattggttggtttttgtacattgaaagatacttgcattcctgggataaatcacccttggtaacatgtataaagcttttaatatgctgttgaatttagcttactgttaatgtgttgaatatttttcatctatattcacaagtgttatttatctgtttttttaacgtgatatttttgtctgactttagtatcagagtaatactgacataattaaattagttagaaagtgttcctttatcctccattttttggaaggttttgagaagaattggcctgtgcttaaatgtcaccttttcagggatgccttccttgatctccctactgatcatcgaaacacatgctcccttaggaagttcttagctcccttccatacttaatgattgtccatagatttataaccacctaacattctagatattttatttacattctcaattgtctgtcttcctccactggaatataagctgcatgagagaagggatttttgtacattttagtctcttatattcactgctatgctcctcggtgtctagaacagtacctggcacatcatgagtgttcaacaaatattttggggagtgaatgaggtctcacagccaacttcaccctctgccagccaaccaactgcaaacaccacggtgggtacaatcatgctgctagccccatgtagcacaggagggatgaacagattttaagtgtggttgcagaggactgcctggtgcactggaagcactaacgctgtctttccttagggtttccatataatgacatacaccccactttcctaaaggtgtctttccttagggtttccatataatgacatacacccccacctccaccctcccctgcaggccaaacaggcttctccttctctcaactcatgtagtccttcctagcagaaacttcagattccagccaaaattgtgctccactaccttaaactctttcccaatactaccccccatttcattgct

SEQ ID NO: 480110 - DNA, 889 bp, Homo sapiens
aggcagggactgatgcaattgggcctatgtttcggaaggctccctctggatgctgtgtgggttgtggactggagagggagagagaagcagcagggagatggggaaatagattactgccattgtccaggcaggagaaatgagagtcctgcacatagcaagggtgcagcatgggtggccatggcattggagcctgtctcgtctttgaattgggctcagtcaatgcaccctgaagcctgcccatattcaagaactgagccccttgatcaggccagtttcaccctagaggctttggtggctttttctacccagacatctgccacttcccaggaccttctgcagggtccagatctcaagtcagacctcaattcctccaggaaactttccttggtcttcttccccaatctcagtctgtggtcggtgcccctgtgctttcttcacgtagcactgacaccactgcattttcatcactgatttttgtggctgtcttctcaactaactatgtatctttgggagttccctggaaaccactaatctgttttctgtccctaggatttgccttttctgaatattttatataaacggaatcatataatatatggctctttgtgtttggttactttcacttaatgtttctgaggttcatccaggttctagtgtgtatcagtccttcatgcccattttatgattcaataatatttcattgtatggttataccacaactagtttattcattcatccattgatagacatttgagttgtttctaccttttggttattgtgaatggtgctgctatgaagattttaatgtttgagtgtttctcttggacttttgtaaagtactttgctaagacttatctcaagtgtttctcataataagctttggagctct

SEQ ID NO: 480111 - DNA, 521 bp, Homo sapiens
tcgcctcggaagcccccctacatcatggacgctgagcttcagataactctcacagtggaagatacctctactccctccttggcgaccgatcatgcaccccttaccatcccattaaaacctcatcacccttaccccgctcaatgccaatatcccatcccacagcatgctttgaaaggattaaagcctgttatcactcgcctgctacagcatggccttttaaagcctataaactctccttacaattcccccattttacctgtcctaaaaccagacaagccttacaagttagttcaggatctgcgccttatcaaccaaattgttttgcctatccaccccgtgctgccaaacccatatactctcctatcctcaatacctgcctctacaacccattattctgttctagatctcaaacgtgctttctttactattcctttgcacccttaatcccagcctctcttcgctttcactttgactgaccctgacacccatcaagctcagcaaattacctgggctgtactgcc

SEQ ID NO: 480112 - DNA, 659 bp, Homo sapiens
gctataccctgcaaagtcacaggggcagagctgcctgaggccatgagagcccaccttttgcatcaaaataacctggattatgggttaatttacttgatattttgggctcttttgctgggagcgacactccctggctctagacagtacttacacctgagtttctcgtccctgaatgttttgttgatatctaaggtttattttgtccctgaaactcaggtgaagatgaattttcctgcttctatgatgatggatggcaactcttttttgaagtttcagctcacttccaacaggaatggagagtttgaatttttcctgcttctaagattgtatagagcagtcttcagccagggcttcattcttaggtcgatgacatctgagacgagtcaaggtaacagaggcagctgtttgaatagatttactggggagtctaaggcagctctctggaccaaactgcaaacaagccagatcaagcttattctgggaacactttgtccacaaggaatttccttgtgggcaaatttaccaagtgagcaaaaaatctagcaaaggctttttcatgcgcgtccgtgtgaagagaccaccaaacaggctttgtgtgagcaacaaggctgtttatttcacctgggtgcaggcgggctgagtccgaaaagagagtcagc

SEQ ID NO: 480113 - DNA, 514 bp, Homo sapiens
ggggatgcgatggcttggcttgggctcagaggcctgacactgagaaagacggctgaggcagtcattatggggagtgggatcaaacatggctcattatatcctccttccttttggaattctggaaaagccaaccagcattcacttaaacacggatgtcgcaaaacctccaaagtagggaagccgatagacagtgcagccttcagtctgtggccaaaggcccgagagcccctggcaaaccactggtatacgtgctgcaaatgcgtccacagttctcttcgaagatattggtcaaggacattatctgttctcccagaagtcctccatcctgactcaggttacggcagacaactaaaacacactgagaagagtcaagatcaaactgtgctggtcttatccaaagccttggatggtcccagaactctgaaaggatgccagtggttcagcagctcctggtttcttcatatgtcatttatctttcaatttgttcagtacacagactagaagcagcaacagc

SEQ ID NO: 480114 - DNA, 984 bp, Homo sapiens
tgtggcacctgacatgcttactgcagcccaaggaggagtacacactaagtgctgtgtatatatcccagacaattcccgccatgtcacccttcttgcgaaaggtatgtgggcgcgagtacaacgtctagaatctagccgtcaggaccccatcgtggactggctttccaactggcattggcgttggccatggtggtctgtgcgggacaggcagccgactctggagcccaggctgttgcttcccggtctggtgaagcttcctccatggtctgaagaattagatatgagagaagaaaaatggactgatgatgcaaaaatgtacgcattagaagagaaaaccaagacatactatgaagtttttaaaaattatattgcaataactaattttatactgataaatatgaaaatagatgaaatggatacttggaaagtagtgaaattactcaagaagaaacagaaaccttcaatagacccacaatcaggagagaagcttatgggatctgcaggagggaaatcctaagaaaatacctgcttaaggaggctgtacactgaatccatgcttttctgtcccttttccgccattgctagagtgcttaagtgttatttttatgttcattttaaagattagcctctccaaagtttatttctaaatgttgtagaattggattttaaaacaaaatttgtttgtaatgatcgtgtaaaggacatgatcagaatttcattaataaactatttggagtagcagataattcttggtgttgaaggaaggttacttattgtgctaatttgctgagagcttttaccatgaacgtcggtagatgtttgtcaaatactttctcttttacatctgagatgagcatacattttctcttcaattaataaggtatatgagatgtaaatttattcagtgaaagatgtgaatgctcagtgatttaactaattcacattttattatatctgtataaaatatttaactgctaccaagaa

SEQ ID NO: 480115 - DNA, 1045 bp, Homo sapiens
tgactaaaacaatttctcagcttcttacccatctcctcggcagccggaaatctctggatcgtcatgcaagacattgtgagggatgatgatgatagtgttgatgatagcaatgatgatagtgatggtgatggtgatgatgataacgatggtgatgtaagtggggatgatggcgatggtgatgatgatagtgatggggatgatgctgatgatgctgataattattgggatgatgatgatgatggtgataatggtgatgatgatggtgatgataatagtgatgtgatggtggtgatgattatgataatgatggcaaagatgatgatgatgatagtggtgatgatggtaatgatgatgattgtattgatggtggtgatgataataataatgatggtggtgatgaggatgatggtgatggatgatggtggatggctaaacagtcgaaagaagagctttattggtgataattggtttgcgaactgggaagagatagtttctggggtggactgaagatactctctttttgaagaggggaagggcaggttgggttttatgcctcacagggtccatattacacaatagagtcgcacatattcagcagccttgggaggaaagctatccatatttatgagaggagccaagctcatgcagattgggtagacatatatgtaacatacatcccatgttcactttggtgtgaagttttagcatttaaaatggtggtggtggtgatgatgatgatgacaatgatgatggggatgttgataatgatgatgacggttatgatggcgataaggtagaattaagctctttatgtcaaaaagtggacaataggacacaaagacaatttgtgtacagcctctgtaagctgctgaaactgatgatacctgatttggtagaaatgattgtttcttttttttacctagtttcagaaatcataatcaattgacataatattacattttttatttaaatttttttaaaaatccttttggaaattacaaaattctatgttctaatcactcactttatctcatttaaaaggtat

SEQ ID NO: 480116 - DNA, 618 bp, Homo sapiens
gcaagggggtcacgggaactctcctgtctcagtggggttttttgatgaaacatgtcacttttcatccgattatggtctcctaacgtgtccggaattggtggattcttggtctcgctgacttcaagaatgaagctacggaccgtcacggtgagtgtgttacagttcttaaagatggtgtgtccggagtttgttccttctgatgttcggacatgtccggagtttcttccttctggtgggttcgtggtctcgctgactgcaggagtgacgctgcagaccttcgaggtgagtggtacagttcataaagatggcgcgtctggagttgttcgttcctccccgtgggttcgtggtcttgctgacttcaggagtggagctgcagacctccacgtgttacagctcataaaggcagcgcggacccaaagagtaagcagcagcaagttttattgtgaagaggaaagaacaaaacccccatagagtggaaggggacctgagcacattgctgctgctagctcgggtggcctgcttttattcccttatttggccccacccacattctgctgattggtccattttacagagagctgattggtctgttttacagagagctgattggtccatttt

SEQ ID NO: 480117 - DNA, 703 bp, Homo sapiens
agtgttagtggagaaacaagcactatggtggaagcatcaacaagtttggccactgctgccacctcatgcaagtacggaagcatgctaggtagggccttttggctttgcttctgccgccgtatgcacttctgccagcaggttttatgttgggtgtgtggtatgacctacaagccagtagatggcgccatgggtaagagctggctgttgccagtgctgctggctgtgtacttcatccttgtttattgggaggagctctctgttgccccaggcaatgggctgaaatcccgagtacacattaatctgagctccctcagccctaggggtagggggattgggggcacaagatgggtgcagccagatagggaagattcccccagtgttgtcctgctcccagtccaggtttgggaaaatgctggcagcgtttccctgtgtctttcccccacaaagtctccaagtctcttctcaaatgagctccaaggcttgggaaaaacaatctcttcctctgcccgggttgcatggatctccagtggaaagggaggattactatgagtaatagacaagttatctgtgctctatttgggacacaaagtttctgtgttactgttttctttccttttacaatcaaaacagagaagttcacatctcagattttaagatgtgtactagatgctggaaaaacaggtgtttattcaccttcattttt

SEQ ID NO: 480118 - DNA, 948 bp, Homo sapiens
agccctagttcttaattcctatagcccttggtttatcaccagtttcttgataaaataatccatccacattctctagacttccggtactatgttggacaacagtggtaaaagtggaaatcctcattgtgtcctagatcgcagagaaaagcttttcatttgttcaccattcagtacggtattgactgtgggatggcaagttctcctagcctccaggtggatccaaaggtgctgtctgggaatcagggctagatcaaaaagtgtaaaagtctacctagtgttttattgtgctatggctgtcgctcaaaccacaagatgcagtccctcccactctttccaccactgtccaaaggcagaggagcatcaatccatggccaactcaaacacaggccatggggggctactgccagactaccaccaatgttctcataaggcccaaaggctcttaagtcagtttgtagtgaacgctcctgttattttaaaatgcttttttttttttttggcggggggaggggggggatggagtcttgccctgtgaattagtctttgaagtacttttttaaaaacttgcagctcaaattcaaatattattaattcaaaaggcaacaattatattgcataaatctatatcatggtatgaaatcttaatcttatgtagagaagagtctacgtaaattatttccagaattaaggagtaattccagatgtataagatatatttaatatatagtgttttctgtgtctcacatactcaaatgcaaaggatgatacaattgaatgcacaattttcttaatcttgctgctgcaaaaagaagtaaaaataaaattaatcagatttcctctaacatatattgtaaatttaaccaaaaaacaaagggccttataaatataattttgaaagaaaattattcagaagttgtataacaaaatgcttcttactaatagctaaaa

SEQ ID NO: 480119 - DNA, 730 bp, Homo sapiens
ggggcgagcacccaggccattttcacgagcagcaaaacaaaaacaaaacttcagcttgtttccaatcactcaccatgcttcttgctgtacaactagggcaggaggcttttgcaactattctgctgccaaatggcgccgatccaaatattatggatttctttggaaggactgctctacactatgctgtgtataatgaagatacatccatgatagaaaaacttcttttacatggtacaaatattgaagaatgcagcaaggcccagattgccttcctacagggagaaaggaagggccaagaaaatttgaagaaggatcttgtgaggaggatcaaaatgttggagtatgctcttaaacagaaaagagtgcgctatcatgttgtaagacggcctatgaatgagccacctggcaagaaaccctggggaccactaggagctgatggaaaccctcagctgacagccagaacaaggcagggacctccatcctatggcttcagaacataccccccaaaaaaacctcttgcagatgaggactgggaagcaagtacagaaatgatcgaaacagtacaaatcaggggagaatgcgcccaagacatggagaactgataatacattgtggtttatccttgcaatggaacactatatggcagtgaaaatgattgaaatagagctatacacatcatcacagacaaatttcagaaacaacgctgagtgaaaaagtctctggaacatat

SEQ ID NO: 480120 - DNA, 856 bp, Homo sapiens
ggcctgtgccagtagtgttgcagcgtgcttacttatattaccctgtctctgttattaatctttgaggaattgccacactgtcttcgacaatggttggactaatttacgcttccactgacggcatcatgcactggtacctgaatgagtgtttagaatcatcaacgtctttaaagtggttagcatatccagaacaaacagtgtgtccagaaggctttctggatcctggggtttcctgccttggtgtagctgaagaattggctcacacgtgggcttggagagtaagtgcaggtttcattgagtggaagctgtcagcagatggatggggagccagaagggagacggagcgggaaggtggttttcccttgaaatggggcaggattcgggtcactacatggaaaatggaaacacagagagcatgtcctgcaggcatggaatcactgtggaaacataccctgctgagaaggaaggcgacacaaactggcttctctcatctttttgttctctaatctctgcagtgtcatcccttgactgagctgaaacaggaagtaatttttatgagagcctaggaaccctgcctcccaggggccaggcctctctattacagaatagtgccagggagagaatcttttgggagaaatataatctaatctagccctgtaaacaattgaattaatcaatgaaatcattatgactgtagtctcacaatttcattgtccttctctttttggtgtatacatatctctttaaaattcaaaagcccctagaaagcatgtgataaataataatgactgaaacagttgaaaaataaaaaccgagcagcagatgtgtttcaaggtttcctttatgagaatgctac

SEQ ID NO: 480121 - DNA, 532 bp, Homo sapiens
ctgccacagctgggcatggcggatttcaatgccagagaacttgatcctggttgtagaaggtgtacctctccttcaggtcacattatgctgacaccctccttaacccagatggactccttgtcctcactacatggtgttggctggaagtgttactcctggtgccccagccgctgtttcaagttgcagagactgaccagcagacccctgagtccttgtcctcctgtccaagtcatatccatagaaatagtcctggcctacactgatcttttgatcactgactttttgatggctctggcagaaagacttcctgatccaaattcaccccttatcatcatcacagtatatacatgttcagggattacggggaaagagcatctaatcctactgctttcctgcgttggttcccatacacaagcaaatgtcctgtgttagtgactatcaaatattcatttatttgatcaaggaaatttgtgtttccaaactgtaaaacaaaaatattactatcagttgtatttttcttatttatttactt

SEQ ID NO: 480122 - DNA, 896 bp, Homo sapiens
acaggttatcctcaggcattacattcaggccacagacagcacaatggtagaagcagattgtcatggcaagcttttcattggtggcctcaatagagaagccaatgaaaaggtgcttaaagaagtatttgcaaaacatggtccccttttggaaggtcgaaccagtaagtccagagattttgtggtcattatttttgagaatgctgcagatgctaagaatgctgccagagatatgaatggaaaggaagcagccatgcgcaaatctggggaaaatattttgggcccagaaataacagcagaagtttcaaggggagccattccaattaaaagaggtccatcttcacgaagtggaggtcctcctcctaaaacatctgctccttctgctatggcaagaagcaatagttggatgggaggccaagacagaggatgtcactacattgtcaaaactgacataaaagccagcggctcaagcagtccagctgtctctgccttccacactgactcgcactgtgagctgctgagcctgaccatccagcttctgagacctcaataatgtttatgtgcaaggcattcttactgcttctatgaagattcaaaagaactacaagagcatttagcagaaaaggagtcactgggcttacctattatttaaaaataaaatcaagtcttgaaaggtagacatgaaggagtccaatattcttaaattaagtggatatcatagaagtgcagagatgtgaaatataaggtcatgtaaatcaataattaagattttaccgggatgtttaaacattaacacaagatccttagcgtaagactggaaattatttgaggagagaatttagaactaagcaacctgagatgcagatgctggcaccacagatcttttacagcctgcagaa

SEQ ID NO: 480123 - DNA, 1072 bp, Homo sapiens
gggctcagaggaggaaatgtgaagagactgcaaaatggctgactcctctggaagatcaacccaggtcctagaggtcccttgggacctaaatagggcatggcatgctcaaaggttacaatctcagcttgggcaggatcctggaggtcaataagccccactcggaccacagccagggcttctgcatttttttgggggaaaaaaaaatcaaggaaaaaatcttattatttccacatttcagtgtgaaaaaaccctggagttcacgtgaatcacatgaagtccagatcttcagttgctacaggccatctggatgtacacgtgcaggtcacaagggatatgatggcttagcttgggctcagaggcctgacaccagcttcagtgtggggccaaggagagagtggctgactttcaggatgaacctagggtctaattgtatcacactgagtcttctgtatccaggtaattcctactggaggcctgcagcatgcagccacagtataattgtgtcagatactgcctgtgtggaggtatttactgatggacattcaacctgggtccaaggtacgactgtggaaagtataggctgtgtccgtggaattactgctggagatacagcctgggcccatggtgtgactgtggaagttccagcctctgtgaacggatttactgttggagactcagcttgtgtccacaggataatggtatcagattcaggataaatgcaactttgattttatgatgagatttatatttagtgttgaggacttgtttgattaacgagactggtgagtctattaggaaaaataaccaagaccctcagggagaactacaagcctgaagatctagatcagcataattagggaatccaaatgagcctcaagccctaagtgggaatccaaatgagcctcaagccctaagttagacgatattgctcccagacttttatcactgccttcatattcatctctggactagtcattttcaatgcatggaaaaaaaatgggtgcatgtatttttaaattattgaggacagtatcctacttaagcacaatactgtattcatgcatttaagtgt

SEQ ID NO: 480124 - DNA, 504 bp, Homo sapiens
ctggatttacagcagtatttttggcctacatcatgactttgtctgtaggagccatctgctttctgcctggatcccaactgctgctgacagatgcacagattattttggatgttggggatgtcatcaacaggagtcctgtgacccaaggagcaccactgggagaacttcagcctggaggggagatcagccattttgtgacctcgtgcccctaccaagcagtgcaatggtacctaatgggttataggacgattccaggaacagctcacttcagaaaccacagtaaggttataaccggtaatccaacccagaggtgctgcaggccgcaagagtggttcaccaattcagaagaaacttacacctcaaccaacacagcatgtgacagtggctcactaaatcagctcagaaggaaactggaggtggtgaaagtgactcgccaccccaaccaggaacatgagaactggtagaaggatgatgtgtgagtggtgaggcctaactaggctaatc

SEQ ID NO: 480125 - DNA, 943 bp, Homo sapiens
ccggcagccatttgtcacagacctgggaaagggactgaaacaagaatggaaatgtcaccagctgaggagatagtgaaggcaaatgccaagcaaggaagctacagccatagtcagaccccagaaaatggggaatgcctggtgcagatgaccacaggtttctcgcaggcagagactgaattcacagagagccttgacagggctgtttcagtattccaggcagatgatgaggaagacccctcttgcagccacaggacagagagtgtgaatgcaggaattcagcaacctagacgagagggtgatatagaggcttggcagctccctgttaggatacatgccccaggtcaacagggaaatattatcactacttttgagccttttccttttaaattactcaaagaatttaaaccagctattaatcaatatggaccaggttcttctttggtaatggtactgttaaagaatgttgctgtccccagtcagatgattcctactgaatgggatgctcttacagggaaagcacatttaattgactatatcaaggcctgtgatggtatcagaggtaatctgcataaagctactttggtggtgcaagccatgacaggactgaaagtgggtaaaggaaatactccatttcctggagcttgttttaactgtgggaagcatggtcacactggaaaagaatgtgaaaaaaatcagtgagtcaggccacaagttgagggataaaaggaaaactgctgagcctggaatatgtccaaaatgcaaaaagaaaattactcggataatcagtgtcactctaagtttgataaagatggaaacctgattttgggaaatgccaggaggggccgtcccagtccgctttctaaaccagggcatttccagctcaggaaatgccctatatttcatctcaaaaggtggagtttgcagctgtaattgaggtatggac

SEQ ID NO: 480126 - DNA, 502 bp, Homo sapiens
aagttcatgtccttttcagagacatgaatgaagtggaaaccgtcattctcagcaagctaacacaggaacagaaaagcaaacactacctattctcatgcataagtgggaatggaacaatgaggacacaatggggcctgtcagggagtaggggatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacaaaacagtatttctacaattgaaaacacagttagtgatgaactcgatgatcgttcaaagatgagaaacaaaattgtgagaggtgcaataattttgacttactgagattaacatccctggttatcatttcaactatcacgctttctttttcggtataggtttggcaaagatcagatggttgtagatatgtc

SEQ ID NO: 480127 - DNA, 549 bp, Homo sapiens
tgttgaaggattggggtgtacagggtacactcaagtatcagatggaagttaagagtctgcaaatgggtctggctaaccatcagtttcacttggaagctgaggaaagaaacatttttctagaacacactggccttcttgtctatgggtcaggatcctcggctgcaggtctgttggagtttgctggaggtccactccattccctgtttgcctgcgtatcagcagcagaggctgtagaacagcgaatgctgctgaatagcaaatgttgctgcctgatcattcctctgtttttaacttctttgcgatgggttcaagcttcctgctttaactcagagaagtttgatcatctgaagccttcttctttcatcttatcaaagtcattctgcgtccagctttgttccattgctgatgaggagctgcattcctttggagtgggagaggcactcgatttttcaaattttcagcttctctgctctgttttttccccatctttttggtttttatctacctttggcctttgctgatggtgacatactaatggggttttggtgt

SEQ ID NO: 480128 - DNA, 715 bp, Homo sapiens
tttatgacactccccagtgagatgaacccgctgatagataggagctgatcatggggaaagataagctggcaaagcttggatctgggagtatgtttatgacaaagagggtgcagaaaagcaaagattgctgcctattccttcctctgaaagtttcctcccacaggggcacctgccaggtgccagccagagcactcctgtatgaagtgtctgtggatccctgcagggaggagtctcccagtcaagaggcatgggcttcatggacccacttgaggaaggtaaactgccattgcccacagcttactgggatgcaagggagcctctgcccccaacaccggtcccggatttcagcacccaatccagatgaccaagatgtcttagatgggcataagacctgtccaacagaagatgctccattatttcctcattcaacaggctctatgtatcaacaggtgggaattgaacaatgagatcacatggacacaggaaggggaatatcacactctggggactgtggtggggtggggggagggggcagggatagcattaggagatatacctaatgctaaatgacgagttagtgggtgcagcgcaccagcatggcacatgtatacatatgtaactaacctgcacaatgtgcacatgtaccccaaaacttaaagtataataaaaaaaaaaagaaaagaaaaaaaaagaaaatgaaaaaaaaaaaaaaaaa

SEQ ID NO: 480129 - DNA, 733 bp, Homo sapiens
tgttgaaggattggggtgtacagggtacactcaagtatcagatatctggagagactggcatgtggaagaataaagatggtccaggagtgcagaactacaggatgagatttcaagtggagactggaaatcaaaggcagtgtgctgccattggatggagccatggaaatgagcaagaggtacatgtgcacaatgtgcaggttgagttaatgtctccattcccaaggactgctgagagtgtgttcctgttactatccccgggaactctgccatcctttgtgggtaacctgcataagtcactctctattaaaaagatcttagatgattttgactgtggggcccatcttctttctgcctggatcccagtggctgctgccagatgcacagattatattagatcttgggtctgtcatcaaaagcaaatcatttgtcatgttttaaaaatggtttatcagttccagcaaatacagttgggccatgctaactcattgttgtaattttcagtcccttatagatatatgagtttgagcatcttattgtttgcttgccatctgtgtattttcattggtgagttcagctctttacaccttattaattgggtaatcaatcttatttttaagtttcaagatttgtgtattttcagtgcaaattctcgcttagatctgtattttgcagatttttttttcagtctgttgcttatctttctatttcctgaacaagatcttgctcagagtat

SEQ ID NO: 480130 - DNA, 1016 bp, Homo sapiens
aatttaggtgatgagttgatgggggcagagttaagttaagggtaaaatggttaggattagtgtgctcttagcatggggttctggtccctccacagtccagaactgtctcggccagtacagccacatactaagcacgtactccagtcacactgtccaccagctccttgacttgttactagtagaagaaaagctgagaaataaaacatccagcttctggctgtttcctggagagcatgcccaatgtctggggaacccttggaccctggaggaaagtagtgacagtgtgataatcagttactatcggatgaaacgaatgggggtgaattcagaaatgaagacaaagaccaaaaagatctgttctaaaacatggctgtgcattgctactaaggaccccacaacaaatgttattaatatacctaaggagactttcacagaaattatcatgcctaaggctctacaagcacaatgcataagctgagtaagaaaaaggtttacaaaatgtaaaccagaggtggccacccaaatctcagacagatttacaggaatccataatcttggattgtgacctagcattattaagggggatatgctgtatgtttgtattgtgctatgattaacggaatgatacagttgacaggaatcataagtcaattgggcatcatttacctggacttttttttttttttctgctagaaaaacaaaagttttaaaaacacaaattgtaaattggtaatattttctaccaaagtaacattaaaactgtgttgagcacaattcctaaaattaaatagtgttctgacacaaatgctgccattcataaagggagtgctgccttccctattgactcctgaattggacttctctttccttgataatgccattgaggcaaagatgggctcaagcctcttccatgccaagcaagctatgctgcagattgggattgaattccagtgcaatgtagtgaagagttgctaaagtttcttcaccagtgtcatcgaagttctcacaacgaggtc

SEQ ID NO: 480131 - DNA, 767 bp, Homo sapiens
ataccatctcatacctgtaaggtttatgtttacgtttggtgttggtgttcatgtaggggcagagttaagttaagggtaaaatggttaggattagtgaaaagctgagaaataaaacatccagcttctggctgtttcctggagagcatgcccaatgtctggggaacccttggaccctggaggaaagtagtgacagtgtgataatcagttactatcggatgaaacgaatgggggtgaattcagaaatgaagacaaagaccaaaaagatctgttctaaaacatggtgcttgtcaaagtttcttatgtcaagtcatcaacactgcccaagaagtctgtgcaaggacttcttcaaggtcctcagtgctgatgttttatcacaggaggtcaaatttctcatcagtcatttcagctggccatctcattcctgccttttcaatcagaaaccaattaggtgttgttacgggaatgagggtgggaaacattttcctgtttgggatttctggcaccataaaggttgctggcttttagattttcacaccccacaaacaagtgactggaccaccttcagattagaccagtggtggattcaaaatagctaccctgcagacctctttgctgacatcttctatcatcccataacttttcctgtgcccttaagaagggaactaggcagagaaacctagccccgtactgctttactccatctggaatcttattctattcccctgtggctactctcctaccttaggaaagatccaagtggccccttt

SEQ ID NO: 480132 - DNA, 1446 bp, Homo sapiens
gctaagctgagtagcctttatgaatattgacttttgcaactaataggctttgatgctaaagagagctgcagcccatttgaaagcctgtccttgcctgaacccagcgactttctaccaggggaaacttgagaagatgaacatgattgtgaacagctcttttgtgctggttattcctatttctcatggatttatctacctgggatattttatgccgatggtctttggattgggtttttgtatgagcgccctttttgttgatgttgatcagtcaggcatctcttctgcaggtctgctggagtttgcaagaggtctacttcagatgctgctttactggggaatctcctggtctgtgggttgcaaaaaccctgtgaaaagtgcaggatacgggcttgatgacacagccccagatggctttccttggctgtgggaggaagtttctagccccttgcgcttcctgggtgaggcaacaatcaccctgcttctgcttgccttctgtgggcctcactcaatgtctaaccagtcccaatgagatgaactgggtacctcaggtggaaacacagaaatcacttgtcttttgtgttgatctcactggaagctgcagaccagagctgctctttttcaaccatcttgctagatgccaactgtcttttattcttatttaaaatgtgcactgttgaagtttccagcaatttcacatgtaatgtgtaaaagcaacaatgaaaaggacagtgaaaaatattttaataaattagtctctgtcttcaaatatcaatcaaaggaagtgccatgttttgaaaggtgaagaaaaactaacagaccaaatacatgtgattttacactttgtctcatttttgaaaaagcagattcaagaaggtaaacctccagagttctaatctgtatcatgtattaagcaatgaatatatgtactgaaattgaaatcaatggctttttcaattcccagagaaactagtttgtactccagaaattcttattgcagctttgacatctgtgtgggttcagtcaggatggtggggaaaattatcagatgcaaaccttcttggaaggctttggggattggcataagctccagtaataaacttggctaaaggcagccttttccatttagttaaataagttagagtagaaacaaaggaatatggggtgtttatcttaatagcttgtttgttcatgtggtcctaagactaatctttgacttaccacagtgattaattgctttctaattgggaagtccacactgtcatttaccctttagtggtgttgacttaaagccttggtcaattaatctttacttaataaatgcgagtctcactagctggtacgggtcacagtcaaaactgtttacaacactctgcctggggtctgtaatcagcccaatgctcagctggactggcaaggcagaatatttgtgtgtcagtgtactttatt

SEQ ID NO: 480133 - DNA, 607 bp, Homo sapiens
atctgagcacatagtttgagagggaatgctgtgtggaatgctatgttggtggatgaggtatttagcgtgtccacagatggtagtcttggcagaagcattggatgcagaataggcaaacgcatatccagtgtaagcaccctgagaaacggtgccatatggacggatcagtgttggactctgttgcttgcaaatggggcatgcagcagtggccatagccaggttagctttgtgtggaacacaaaaataagaggacagctgtggcccttcagggtgcacagacttaggggctctcgatgccatgactgtgacaccctcttaggggctttgcattttctggcatctccaagcttctgggccccactacgtttcacagtatcagctgtggatgctgcctgcagtatgcctggcccagctgctgcttctcaaaatgagaatataaaatatacaatatagttatttgttttttacttagtgacacacctgtcaatacatgaagatctgtttatttctgttctgtgctacataacttggcattcaatgtactctaatttatgcagtccacatctaagatggattgatgtatttttttacgcagtcaatagctggc

SEQ ID NO: 480134 - DNA, 964 bp, Homo sapiens
ctgcctcttcaagtgggtccctgaaccccacatagcctaactgggaggcaccccccagtagctgcagactgacacctcacatggctgggtactcctctgaggcaaaacttccagaggaacaatcagccagcaacatttgctgttcaccaatatctgctgttctgcaggctccgccgctgatacccagggaaacagggtctggagtggacctccagcaaactccaacagacctgcagctgagggtcctgactgttagaaggaaaactaacaaacagaaaggacatccacaccaaaaccccatctgtatgtcaccgtcatcaaagaccaaagaagacttagatcactatgagatgaaagaagagcctactagtgagaagaagttggaagatgaaggaactgaaaaagaaaattgggcaatattagagaaaattaggaagactgaaaggcaaggccatttaaatgtgtgtataaatatctggactttttggtaagtaaactattacccctggatattcatctttctatgtaactggttgagaaatgggagtaagagtaaagaaactgttttcgaataaatctggtgacagtagaagagaatatgagacacattgtgctcacagagcctagaagagtgtgacggtagaatacttctcaagataattttgtatgtttccttttttctttttaaggtatgtattgggtggaggagcattatgtatggaacctctcacaaaattggtgattattttattattatactcaattttcaccctcaattgagtgttttgattattaaggttggacattctgatctacttggtgttttattatagaactgctagtgtgcttgagtcttacattgtgaagatacttttttaaaacttgagatgtaagaggatgtaaatggttttgtaggcgatcaggctggatgagaacggacacttgtaaacatactttttagact

SEQ ID NO: 480135 - DNA, 581 bp, Homo sapiens
tgctagaggcgaggcaatcggccatgtgtagagaatacagcaaaagtaacatcacttctgaggtgaggctacaaagagactacgatgcctgccttggtcacccttctcctgctctttccattgctccctctgatggaagccagttgccatgtgatgaggtgccctatggagaggcccacatgacaaggtcctttgtttctcctccattctgctggttttatactaatttcaaggcctgtgaggatgaagttgtctgtgacagctaccacaaaggttactataagcagacaaatttccagcaagtttatcaccactaccatccccaccataaaacggtctcaagcaagggcaacacaattgaaggaagtcaatttacaggcttccatcaagcccttagagacctttttgtactatccatgacaagttcttgatgttatgtctgcacttttgacaaattcttagcagttaacttacaaggcagttaagattttttttcaagcacaatataggtagaataggctcatacatccaataaaacaaatatttactaagcatttattgagtggaagataaaaagcaca

SEQ ID NO: 480136 - DNA, 811 bp, Homo sapiens
cttctctggtgaccatgtcttccaacccactggcccagggccacctcttgcttggagagccctatccaacagccaccagacctgatagagaaggaacactgcctgaaccaaaatggtggagctataagggatggctggctggagtggtcgccagaggcccctctgggccatcagaaaacccagggtcctctgagggaccctggggaaggcatggagggcagccaatcctgtttaaggagaaactaacaatgaaaatggactcgttggtggaggagaagttggaatgcagcctctggtgctgtttgagcgatccctcttccctggtcgctgctgtgttctggaaaggcgcattgtaccctggatgcggcagattatataaccttcctaagcacctggatgttgccatgccagatcaaccactacccatgggtcagtcaggaccctcagctgcaggtctgttggagtttactggaggtccacttcagaccctgtttgcctgggtgtcagcagcgttggctgcagaaaagcagatattggtgaactgcaaatgctgctgcctgattgttcctctggaagttttgtctcagaggagtacctggcagtatgaggtgtcagtctgcccctactgggggggtgcctcctagttaggctaatctgagaacaataaaacaatttgaaacaaaaatgtctccagatctcttaaaaggaagctagggcagctttctgtagtgcacttcccaaaaatgggctgatttacctcaagaggtcatggcccccaacccagccacagatcccctctgatgacaagacc

SEQ ID NO: 480137 - DNA, 535 bp, Homo sapiens
atccgacaaatgacacatactaaccaacttaaaagcattaatgccccacagggcggttttctcctatctcaaaataaaacgaatgtacaatcgggttttacacggagacactccattcccagaggcatacaagagatggaggccttcctcttactaatcctcctcaatacagaccctttatgggtgtcggactggaagacggtcaggtctttcctttcccataaggccatatctcagaccatctcagtggggaaaaaccttggacaatacctagactttcttgggcagaggtccctgaagctttccgcagtgtattgtgcccctgacaccaggcttcccttcccctggagcagccagaccttctgtggtatcttgagcaagcccctggtcctgtctgggcctctgcagactcaaggggctcttcctacttgttcagcacttcttctttctgccacctcgtgaagtttccttgcttccccttcaccttccgttgtgattgtacctatggattaaatcacatactggcatatttaaa

SEQ ID NO: 480138 - DNA, 591 bp, Homo sapiens
aagttgtatcagaatgtcattaaccctgacgctccaaggatacaccctctctctctggaccacagctgataaagagaaacatctggattctccaggttcactggtctgggaggaggagagggtggagatctgggctgagagtgaagacacctggattctgtcttctgaccctgaactcagtgcttttaccatcaatacaacagaaccaggaagtccattcaaatctacatccccatataagcaggaagaactctgtgaatacttcttggtcaatgatctcgtgattcatcagcccaattttcttgacaatatcatttttatagccatgaggaaaatgatgagagagattaagtggcttacccaaagtcacccagagtcaggatatgaaactgtgccatctggttccagagatcatatggttgataatggaaggaacaaccagtaccaagatgagaagatgagagtgatattataaattttattccgttaatgtgttttaaagtctaagatttcttctagcttgtattccatgttcattgttgttattttatcactaactaattagttacagccagagactttaactcagtc

SEQ ID NO: 480139 - DNA, 859 bp, Homo sapiens
ctgagctaatggtgaaccactcaaatatgctggaatgcctattccctggggtataggatgctgcatgatttccatcaccatggacccaaccacattgctgcatccagctgacatcatgacactgaggcctctgggtggacaagagggcatgtcagcaaggacccaagacacggagatgcaggggatattggacccctgggcaaaaggctctctgatgcaagatagtagccagccccatgatatgcagatacaggctgtaaaatttgtgatgcatgatgtatgcagaagctacttccagggaggttctacagacattgatttctcaccagagcaagccagggagaaggtagtgcagactgcctgctttctccttctgcattgccaaagtcgcacaagcttcttccaggaagaacctgcaaggcagatttcttgctgtggcaaggcagagaagaaagcaagaaggcctgagaggggttcactgtcacatttatacttcaccaaaaatctgtccagggagaatagcaggagggatttattgctagaacaagcctgtgaagcaagcttgctatgtctggtgacagaaggggagtgctacctcttccattcaggatttcagagatctaactgcctgattttctctggcgagtgatggcagaaatctgctattagagcaagccagggaagttataatttttcttatgtttattccctgactccctggggttgcaagtctctcttgccttgctctctaatctgactggaaattgtttcctgatttccaagtctgcaactctttttttgtcagctttgcttcatgtttgagattattcctgtatgttctgtgttgtgtacccttctt

SEQ ID NO: 480140 - DNA, 1109 bp, Homo sapiens
aggttatgcgactttcctctcctgactgcacgctgattaaagcaaagagtgtggcatttctaagcacgcatccaaatgatatgaccctttttcctgggccattacaacagaaggcattatgatatatctctgcacccatcatctaggtgatatgactctcctctcctgcccggacactcttcacaacatgcccacaaaaattattgtgacatatttctgtgtccacctcataggtgatgtaactttcctctctggaatgggccctgctcaaagaaaagcccatcattttggtgatatgactctcctcacctgcctggacattgtccacaagaggcattatgcgatagagctgggactggcaccaaagttttctgacttttcgatcacagaagaaattgtgccatatgtcgaacaagcatctgagcaatatgtaacacatcccttggctctttctatgaagggcactattacatatcactgggaccattacccagatgatgcgaattatctgcctgaaaactgcctaccaagagaattgtgtcttatatgtgatgtaactctcttctttggaatgggccctgcccgaaggaaggatagtgacatattgcaatgccagtcacacagtaaacataaaatagttcatactggagagaaaccccacatccatgaagaatgtggcaaagcctttacccgctcctcaacccttattaaccacaagagaattcgtatggaagagagaccttacaaatacaaagaatgtggcaaaacctttaagtgcttctcagaccttactagtcataagacaattcacactggtgagaaaccccacaaatgtgaagaatgtggcaaagcattgagctcattctcacacctcattagacataagataactcatatagagagaagctccacaagtgttcaaaatgtggaaaagccttcaataagtcatcaatccctcggtgcagtcagccctggatggaaaatatgtgctttcagccaagttaggggctcactgtctggtgaggagcactggggagtttgtgagccccatggaggatggtctaacctcctctccttgggcataatgcagctcgtttgaggtgtgaata

SEQ ID NO: 480141 - DNA, 613 bp, Homo sapiens
agcaagcgagggctgccagcacgctctcccaagcacgtcccatctgaatactggaaactatgtgtaaatcttaaacagcagggtgtggaggagaatccgttcaaattagagtcgaatgttatgaagacatcccaggatcctcctggggaaggagatctgaaccatcaggcacctgaagaactgcttggtggcgaggtagtgtcgaggcatttcagtgtggttagtgctacacatagcctctatgcagatggcatccctccttttagacagcagatacctcccagtgtagctccaatgggagaaagcccttggggtgaaaatagtgaggaaatcaggacccgcgcatcaccttggtgtgcagtgggtgtctggctcctctcatgcctgggtcttgtccaggccctcagagttagaaaacatactgccagcaggcccaaggctcatcctgtatggtcaaatacagtcaagcagagagagaaaaatcttctggattcaatgcaaatgcaacaacttcctgttgcattaggagtagcaagactggctggctttctaaaagcttagagatattatttttgaagctatctgtgtatactttattccctttcatacatac

SEQ ID NO: 480142 - DNA, 788 bp, Homo sapiens
taatttaaaaggcagaggacatttttctccttgtttttacctatgctgatcccctacctggtgttggagcagcttcactgtgcacagaagaagaagaaaagctacagttgtgtggagcatggatggctaaactcctggttaactcgatggggtcaaaaggacaaatgtggggcagagttcagatcttttgacagggtcaacggatctggcatcagtccctggctgctctcttctaagttttcagtcgtgctcttctccattcctcaccagacccctggcctctttggagctgcctggacaggagctctcctggcctctggcaaactcctggctgggttgcggatggaaattcctgaagaaaagaaaaaagaagaagaagaagaggaagaaggggaagaagaagagaaggaagcggaagaggaagaagaagaaggagaagaggaagaagaagaagaagcagaagaagaagaagaggaggaagaagaagaagaagagagaaaagcatgtttttcaggttactctcaagaagttggtgtctagtagaggcagccaagaaagacctctgccaggaccctcctgatccggggacctctgcatggacgtatctgggctgggaatgcaggtatgtgtaagaacataagtgcggggggacgtgagtctttgatacaactcccctaggggactgtgtgctctggttctggttgtgcaccgaggccggtggggaggacccatggaacaaacttgtgttgagtatttttatgatctatttttatctcctttatagactt

SEQ ID NO: 480143 - DNA, 2504 bp, Homo sapiens
tgcatttctgtgagtttggtaaatgcccagcgttcattgagcgccatcacagatgtggctctgaatacgctgaccaaacactgagtcacaaacacgcgtgttacatgctgtgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagattccactgcactggcctgttggggcgcaaaggagttatgttgttcctccggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggtttttatgtgcttaagcaatggcaggtctacataatgatagactatataatcaaagaaagggagtattcacgtgactttagaattagcatgtgtctgcacagaatatgcctctggctttaccagcagtagaaaatttatagaagagaaacagaaatgctttgctgttaatgacgcctaaataagaataggagtaaaggagagtattacctccaactcaccggagctgctttcccccttataagcagttcctaaagtgaatgaaagcagctctccttatgtgtctgcctactttattcttcggtttttatgtgcttaagcaatggcaggtctacataatgatagactatataatcaaagaaagggagtattcacgtgactttagaattagcatgtgtctgcacagaatatgcctctggctttaccagcagtagaaaatttatagaagagaaacagaaatgctttgctgttaatgacgcctaaataagaataggagtaaaggagagtattacctccaactcaccggagctgctttcccccttataagcagttcctaaagtgaatgaaagcagctctccttatgtgtctgcctactttattcttcggtattattgaggcctttaacttgtttatagaaatttcctgaatagttggtcatttttaactagtgaagtgtccctaaaatttaaggaaagacttagtgtagaatgaagacctctgtcttatttagaagtaatgaagtaatatttttacaggaatatccttggcaataacatttgtgtagaagagatttctgagatttggtgtccccttcttcatttgtggatatagttttcatctttgctgtcaaatagctgaatgaaacatccaaactgactttcatgaatttttttagggagatagagtgaaataaaattatgatccacttttcagagcacagaattccaattatattttcattttagctggctgtttgacggtagtcattctcaggatctcttctcatagatacaagtatatctatgacccataactatatctatggtaataaactgaaagagctagtatttttgaggtttccacattgccaactcccaaaaatttggagaaaggtgaagattcaaatttaaagtaacaagaatgtcatggacaagaaacataaagtacttaagttttcctttctgttacttttattataataaaaaaggagacagcggaataagtacttcaatactgtgtttctcatgtgtgtttgaaaatatgtaggaatagtttaatagttttggtttcctttttttttttttttttttaaagatgccaccttaggggcctgttggggagcaaagggattatgttgtccttgacgttaagggaattagccaaacatagacttcctgttcattcttgattttttttccatgtcatatatgcctataaatatttttaagtgactctctatattaatgtttgttgttgttgttgttactttcttgttaacccgagtataaactcccatggcagcaacagtgccttttttgccctcagggttttatgtgcttaagcaatggcagctccacataatgatagactatataatcaaagaaaggtaatattcacgtgactttagaattagcatgtagctgcatagaatctgcctctggctttaccagcagtagtaaatttatagaagagaaacagaaatgctttgctgttaattatgcttaaataagaatagaagtaaaggagagtattacctgcaaatcaccagagcagctttcccccgtataagcagttcctaaagtgaatgaaagcagctctccttatgtgtctgcctactttattcttccgtaagtttagcaattcatctagctatcctttatttgaaatgatttccagatgcctcctcatataaattgctgacttctggatatattctggttctggaatgggtagatttctgatgtgatttagtatatatatataaacc

SEQ ID NO: 480144 - DNA, 769 bp, Homo sapiens
taagaaagaatttctgggtgggcttaggtagtgcctgtgaggaccgtagggcacctctgccatggtgaggtctgtggatgtccaaggtgttgatcggggtgcacagaagaagaagaaaagctacagttgtgtggagcatggatggctaaactcctggttaactcgatggggtcaaaaggacaaatgtggggcagagttcagatcttttgacagggtcaacggatctggcatcagtccctggctgctctcttctaagttttcagtcgtgctcttctccattcctcaccagacccctggcctctttggagctgcctggacaggagctctcctggcctctggcaaactcctggctgggttgcggatggaaattcctgaagaaaagaaaaaagaagaagaagaagaggaagaaggggaagaagaagagaaggaagcggaagaggaagaagaagaaggagaagaggaagaagaagaagaagcagaagaagaagaagaggaggaagaagaagaagaagagagaaaagcatgtttttcaggttactctcaagaagttggtgtctagtagaggcagccaagaaagacctctgccaggaccctcctgatccggggacctctgcatggacgtatctgggctgggaatgcagtcatgcctgtctaactacgtgtaactagttagctcagcttactgttataatttttctcactgatagaatttttgcaaagacactttcaatactaccaaaataaatagtaatcaaccacttggaaagca

SEQ ID NO: 480145 - DNA, 539 bp, Homo sapiens
gctctgtaaaacagaccaatcggctctctctaaaatggaccaatcagcaggatgtggctctattccttcccctgggtgagttcttgcaatattaaattggtaggatctgaattcatacctgttttggataaatctatcaaatttaagaaggaacctaggaaagaacaacttgagagggattttccattgtgtggggctttgggaggtgagaacacagctggggaagaagactctaccacttgggctcaactttccctgaagactctgaatcctgtaaacacggggcaagcagtggccttggtacatctcggactgaggagaagctcagatcagatatcctccaattacccttcttttcattcaggagagccaaaaatcggcttttatttgccactggagtggggaggcccaggtgcgcccacaaaagaggctgttgttgggctttcctcacatgagttttgtgcctacgctcacaaggataagggatcttcttcctcaaggcatgccaggaaggcttatgggagccagtgaagaaaaaa

SEQ ID NO: 480146 - DNA, 690 bp, Homo sapiens
ccctgcctatagatgtcgactatcaaacgtggtttagagcaatatgcaagattggtacctgtgcacaacgtgcaggtttgttacatatgtatacatgtgccatgtttgtgtgctgcacccattaactcgtcatttagcattagcaaaacctgtcaacctaataaataaggcaaagcttttgagttgtgctcaaacttcactgaacataaaaaaagttttggtggagacaagtgctgaaaatgtgaagaatgtggcaaagaccttccatcccagggagatgcagtgctgctaccaatggttggctggaattctaagccagtacatcttaccctgtgaggcactgagaaaatgcgtcctacagaccatcaatgctaagcgccctgaattctgcctttttcctatggatatgttcaagattgtaacctcctgctttgctggagttccagcgaatttttctgggaaggctggaaaaaattatgaaagtgactttgataaaatgtaacgctattcggaaaataatttttacatattgaggataagatgaaaaataatttatgtaaataacataaactaagtttactgaaattatttacttatttaagaaacttgattaaattttaaataaattgctgtcacctatcagcatttgtgcagcattttttttaagatttggtgtctaaaacaggtaac

SEQ ID NO: 480147 - DNA, 727 bp, Homo sapiens
ataagggtttgaaagatgtctgatttcagaagccttttcctgtaaacaccaggcagcatctcgtactatgcctcactgctgtcattctatcatttacttgactaagatacaagggtttgtgggtaaaattggtcccaatggcttaggatgcattgcaagagtgggtctgttaatgcctgagtgtttcccatccgaaagagaaaacggcccactctttttgtttgtttgtttctccacctgcccaagaacccacaatggatcctggaccctgctgatcagaatagttgtgctcactgatgcagcagcagaaacactggttttcctcctggaccacaacaaaacctgcagccttgcctgtccacccagaccacaaagaggactgagaaaaatcggatttaggagtctgtcgcattcctcactcttcctctacagctttcctcatgagggtggttctcacacttccttcacagactgcctcacacaatgggctccaactgcagacctggcgatgggtgaataaactacctgacacacagatatcctgctttgccagcagcagaggaaatttttcatgtatattagatttcagttttcttagtcttccattgcaaaatagataaatctgtccatctaatatggaagaacctctcataactctggtggagcaacaattgtccatgttctttcccatatattttagatatgaagacatagcaacaaatgtaag

SEQ ID NO: 480148 - DNA, 851 bp, Homo sapiens
ccggttggagaccagggggtagatagaagaatggatgatgagaggtttgaaggaggatatgtcaaagaattcaaggaagacatgaaaactggggatggcagcagtatagagagggaccaaagcagccagctggaattggctcaaaaccaaaaggaattctccactgtgggagaaagaaagactgcatttgcaatcctagatgcagagaatccccttggccctgtgaggacagatcctaagcctaataacagagacctgcctgacgtccacacaactacactgtcccagagagggaactcatgcaagacccggtgcccacagaggcccaccctgctggtgcatggcccagtattgagggtgatattgagcaaaaggctgtctagaacctacatcagagagccttttgcccaggggtccaatatcccctgcatctccgtgtcttgggtccttgctgacatgccctcttgtccacccagaggcctcagtgtcatgatgtcagctggatgcagcaatgtggttgggtccatggtgatggaaatcatgcagcatcctataccccagggaataggcattccagcatatttgagtggctgcgtcaaaacatagggaacaaaaatgtgtgatccatagaacgtgggaaatacctgcctgaggatgctgccactgaggcaccaacttctcccagcccctcagcagcaagacaaccacacacctgtattcatgtcctcatctcctcttctaaaaaggatgccagtcatattgaaataaggccccatcctaatgcctcacttaaccttaattacctctttgaagactgtgtctccaaatatagtcgcattatgaaataataa

SEQ ID NO: 480149 - DNA, 523 bp, Homo sapiens
cggagagcaatgcctcctggacagaggctcttccccacagggcaaattgcttggtctcaaattgataaaaaagaaaaaaataaaatagccatcaccccattgaccctgaaaggaatggctctgttaagtatccattacgtaccagccactgctgtcggcaccttatgtgttttaagtcatgacatacatcatcatagtaaccccaacgaggcagctgctgtcattgtttctactttgcatgtgaagaggcgtctggtgttccatgtttctgctcctgtggcctccacggtgcaacaagctagcggtttacttggacttctgcctcatctttcttctttggcgcttcagcctgagcgttcgcttcttcctccacttggctctcatggcgcagaggtttccaagaaaatggcgctaagatcacaaacagcagtggaagagtatcctggtctgggctaaaagctttgtaaaatagtttctgagcaaattatttcacttctgctaagccttgggttatttatctatt

SEQ ID NO: 480150 - DNA, 491 bp, Homo sapiens
gtgggagagtgacgatttttgaaaagtcattgtgtcaggactctttttgttatgaggaaaatgatgagagagattaagtggcttacccaaagtcacccagagtcaggatatgaaactgtgccatctggttccagagatcatatggttgataatggaaggaacaaccagtaccaagatgagaagaatccatcaaaaccacagctcagttttgcagcttggagaattcagatggacaaatgccttcacaggaaaggtggctttgatgttccacttacttctctggaggtcacctatgtggacacactctgtggcctcagagatctcatggggcctgtggcccagagggttggctccatgaacttcacagtatggtcacctgccaatccccatggcattctgtcttggggctgtgaggacacagtgggatatcagggcccagtctgtgcatctctcattccagggaggccggggccctgaatccactgtccctt

SEQ ID NO: 480151 - DNA, 536 bp, Homo sapiens
tctccctgacaaaaaactaaaaaaaaaagacactgaaaggcatacaagagatggaggccttcctcttactaatcctcctcaatacagaccctttatgggtgtcggactggaagacggtcaggtctttcctttcccataaggccatatctcagaccatctcagtggggaaaaaccttggacaatacctagactttcttgggcagaggtccctgaagctttccgcagtgtattgtgcccctgacaccaggcttcccttcccctggagcagccagaccttctgtggtatcttgagcaagcccctggtcctgtctgggcctctgcagactcaaggtctggtgcctgacttacaccctgttatcatatcctgccatctggccccatatggagtcctacaggggactctcagacccaggcgtgaccactggctcaggcccctctcagaggtctggcggcccagcatctgcccacgggcctcctctccccctccttttctccaggctcctgtctctgccacagttccctggaggtgacctcta

SEQ ID NO: 480152 - DNA, 582 bp, Homo sapiens
cagctgcagcctgagggcaggtgaccccagcaccctccagtgcagtcctatgactgtttctgcttccggccctctgacttttagaggattaaatgagataatacgtggaaacattaggcatgtagcacacttagcagatggtggttggctccccctgcttttccatcagtctttggtctacagtttaaatgctgggaaaaaggatggctggagcaagggtccacggcctgggcaggccacagagccccacggtgcccttgctaccctattaatgggccaggaatctggaagccagccaccacatgccctcatgcccagggtcttccggcaggtgaagctgaagagccaagaggctccaagtctgcggcagcagcaagaccagtacctgtgtaccgctctaggagccctgatcccacaggagcttggtgagctcttcattagctcaatatgtggtctgccctcaagtgcacggtctattactttgtaatatgccactggagtaaagaatcaaaacacctatttaaagactgcaaaatatgataattatttttaaagtaattgattaaacctggtaggttttcc

SEQ ID NO: 480153 - DNA, 516 bp, Homo sapiens
agattagtagctacaccggtaatggtaatagagctaaggcctaatagctgtaactcagcttcagcctccttagacaaaccagcaactgggttgtctcctaagcccattgctcctaatgaagaatttccatggaggtacagtaaggaaataatctttgagatctgctacgatgggaggtacacagaatgtgcctaccaggaatctgctttatatccattgaaagcaagaaataatacagtaaaactttgcctggctagagtatttgaaagaatggcatattctgctttaattctattactttggaagtatgaaggtgaaaaaaattcaaaacttaaatttcctgttgaatgcaatttgaaaatatggccaatgattgcacttttcttctctagtaaggttggacattctgatctacttggtgttttattatagaactgctagtgtgcttgagtcttacattgtgaagatacttttttaaaacttgagatgtaagaggatgtaaatggttttgtaggc

SEQ ID NO: 480154 - DNA, 658 bp, Homo sapiens
cagcaaataacttgcggtttttggacctgtggtgtttatcagtcactggctctgtcgtctattaaaatcatgtacacatttttcacagttcatgaggtgctgctctggttcccaagtgtcatcctgtttgtcataacctttccaccgaaccaaatactgtgtattcccatttttatcctgtcttttgtcaacaatagcttcaacctcaaactcctgggaagccatgaggaaagacacgggattggaacagttgctgtgccacctttgtttcagttgcgtctccacatagacacttctttctgcctccagctcttcaccaggttctgtgtatggatgaacctcttctattttgtcaccactggtgtagtgaaaattgtgcgaaatagcagctatgccatgtgcctgaacctctccatacttactgcctggtgggacagcttgggctttgtctcatggtgcatgacaacttgctcagtagcctcagggagttaggctttatagattagttaaatttaaacctgattttgatgggtgcattttacaatgattgcagaacaactatttactaaatatttctgaaagtctaaattgtcattttctaagaagacataatacacctttgtttttaaagaaatgaagagtatttactaattagtaa

SEQ ID NO: 480155 - DNA, 780 bp, Homo sapiens
ggtcctcatccatgcctcagaaccacgaagagaggaggctcacatgcttgatagaaaacctatttgggactgtgagattgagagtgttaagcacccttgctcctcacctgggacagaggcatgtctctgaggccagggattccccctcatcttggccttgcagcctggactgggcagtcaactcggcccatagcggggccagtgaggcggcttgggaggcagctagtgactggaggaagctggcgcctgatgactcaggaatacacaactgcccctcatcggggacaagtagaaatgaagtattgttgatagtccttaatacccctttccctgctaggccactcagggtgtccccagagaccagtgatcttttttcctcaggatcctcggctgcaggtctgttggagtttgctggaggtccactccattccctgtttgcctgcgtatcagcagcagaggctgtagaacagcgaatgctgctgaatagcaaatgttgctgcctgatcattcctctgtatcaacttgaattaatggatgactacatcattagaactaactgactgattgaagagcaaaggaagaataaaggtgaggtttgggtgggggagaggggtgggtcaaagttaatgtgatgattaattacagggttagaaaaggcactgggcagctgggtactgtattatgtcatcactgtggtttgcagaagggaggactgaacattgcacccagaacttattggatctgagatcagggacatcttaattgctcattgtacagcct

SEQ ID NO: 480156 - DNA, 1575 bp, Homo sapiens
cagcagaagcagcaggctttccgcaagcagtgtttggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagaagtgaagcaattttggaatgctcttgatcaaaaggaggggtccattcagatggctgtggttggcggggggacaggagaaaacagtatttctacaattgaaaacacagttagtgatgaactcgatgatcgttcaaagatgagaaacaaaattgtgagatctgatagatcacaccacgcaggcattaaaaccttggtagcatttcttttagtagaatgtccatatgggacgttcgctaacacttggttaatagtcactaataaacaacaacaacaacaaaaagtaaaatttagttccttgtactagtaatgtttatgcctgagattatgtataataatcacctcagaaatccatattactcatcatcaaataagcatttttattatcaaataaaccttttaatcactgacaaaaaagtactgcttcctagtcctgcaagataaaatatatatgatatacttttatataaatatataatctataacttcatgtaatatacacataatttttgcaagcctgaatgtaatctcatagattttgagcctcttacaaaagtgaccaataacacttggcctaaccagctaattttatttctttgcaatttgactaggatatataatggtaaaatgtctttgaagatattatatattaaatgacaggtatgtttttttatatatgtatatatttgtatattttttgtatatgtattttttatatttgtatatgttttatatttgtatatttttgtttgtatatttttgtatatttatttgtatatgtttgttatattttacatttttgtaaaaaatttatttatatatttatatttatatatattgtaaaaaatatttatatatttatatattatattattcatatattatatatttgtataatgtgtatatattatttacatatttgtatattttatttttttatatttgtatatttttatatttgtatattttttgtatatttatttgcatatttttctaaatatattgtatatatttttatatatatttgtatattttattatactttaagttctaggttacatgtgcacaacgttcaggtacaccaatcagacgtagatttggtcttttcacatagtcccatatttcttggaggctttgttcatttctttttattcattttttctctaaacttctcttctcacttcatttcattcattttatcttcaatctctgataccctttcttccagttgattggattagttaatgaagcttgtg

SEQ ID NO: 480157 - DNA, 598 bp, Homo sapiens
taatggtttgctgaccatctgcctcagtgtctagaaattcaggatgacacgagcttggtttgattcactgttgtatgatcagccccaaggaaactgcccagcagagacaggctctagatcaggtcttacagagtggtttccaaaacgcatttattctggaataagcaaaatcaaacttctcaaaatcccttgcctctttaagatgaaatactttggtcccaaaagaaaagagcctggctgtttgctcatccctgaaacaaaggacaaagctcccactcttgtgggaattaagggacaggagagaccaatgggtggaacaggaggattttattgggcttttgaaacaaataaaagccacctacctatgagattaacaaggcttaaacttgtgcaaattacaagcaatcagtgcccatgtgtagttgtttatttttcaaatcgatggtataaaaattgaaagatttactcagaaatatagagcaaccagttctaacaattactctctagagttgcagagctaaatatgttactcagagtattattatataatgtttttcaactccttatttgtcaatataattctgaatttggattgtcc

SEQ ID NO: 480158 - DNA, 663 bp, Homo sapiens
ttggcttcagggtgggtgcagggttgaatttcagaatctttacaattggaggctaagattgtatcatgggatttctagctggaaattcagcctggttccaagtgataacgggtgtatattttgcttgggtccatagtttgactgtgccaggcagaggttacaaccagaaactgattgctggtgattttgtctgtgtccatattatgactgtatcagctagagcctctctcctgggaattattactagagatacagccatgtactgcagtgtgactataccaggtacagccactgttaagggatttattgctggcaacagatcctgggcccatgatgtatttactgatggacattcaacctgggtccaaggtacgactgtggaaagtataggctgtgtccgtggaattactgctggagatacagcctgggcccatggtgtgactgtggaagttccagcctctatttttggaaaaaataaaagatttggaagcaacctaaatgtccatcagcagataaagcgataaagaaaatgggggagggatagcattgggagatatacctaatgctagatgacgagttagtgggtgcagcgcaccagcatggcacatgtatacatatgtaactaatgtgcacaatgtgcacatgtaccctaaaacttaaagt

SEQ ID NO: 480159 - DNA, 1145 bp, Homo sapiens
tcctcaggcattacattcaggccacagacagcacaatggtagaagcagattgtcatggcaagcttttcattggtggcctcaatagagaagccaatgaaaaggtgcttaaagaagtatttgcaaaacatggtccccttttggaagttcttttgataaaaggtcgaaccagtaagtccagagattttgtggtcattatttttgagaatgctgcagatgctaagaatgctgccagagatatgaatggaaagtctttggatggaaaagaaataaaagtagaacaagcaaagaaaccatcttttccaagtggtggtaggcggagaccaccaccttcttcaagaaacagaagcccttcaggaagtctgagatctgcaagaggaagtagtggaggaacaagaccgtggctgccctcacatgaaggacacttggatgatggtggatacgctcttgatctcaacacgagttcttctaggggagccattccaattaaaagaggtccatcttcacgaagtggaggtcctcctcctaaaacatctgctccttctgctatggcaagaagcaatagttggatgggaggccaagacagaggatgtcactacattgtcaaaactgacataaaagccagcggctcaagcagtccagctgtctctgccttccacactgactcgcactgtgagctgctgagcctgaccatccagcttctgagacctcaataatgtttatgtgcaaggcattcttactgcttctatgaagattcaaaagaactacaagagcatttagcagaaaaggagtcactgggcttacctattatttaaaaataaaatcaagtcttgaaagtgattgtgatggctgtggtgaggtgatgttagagatcattctgaacgtccaagtggaagttcttatagagatgcatttcagagatagggtaagggtccgggatggatttgtaaattatagaattgtgtttaatagaccagatcgttattttaatgaaattctaaggaaaattacgagggacaaatataacatgtctaaatattgagtattcttaacagaagaaagcatagggaatgatatgaaggagtctaaagtgcttttcaaaattatgtaaaacttaatggcttaaaacaataattataatttactaa

SEQ ID NO: 480160 - DNA, 1685 bp, Homo sapiens
cacgtctggataggtatatccttaaaatatacgtgaggccatgcacttctgttttcttgcccaaattggtgaggacatgcgcttctgtttttttgcccaagtgttgcattttccaagagcaccctggcctgccatacccccatcctgtgctatcagaaaccccgagaccctagcgggcagagacacagtagctgacgtcgagaagaaccatcagcagaagaagacacaagcaattggacctggagaagacaccggaggaaggagagcgcaaggacagaggcggcaggccatccaccgcagaagaacacagagttgcgtggggctgtggaaggagagcgctcacctgccccatttcaagggaaaaccaccttcccgctccgtctcccttctggctccccatccatctgctgacagcttccactcaatgaaacctgcacttactctccaagcccacgtgtgagccaattcttcagctacaccaaggcaggaaaccccaggatccagaaagccttctgtctttgcagaaaggcagagtgtctaattgagctgacacaagccgtctacagattgataaactaaaattatgggttgaaaagtgtctataaacgcatggtgtaatcataaagccttgtattctgtgattgggaccacagtctaaaagtgatatccagaaatccagaatatagaaggctgaggaaaaaaaccagctgctacttcaaaaggtaatacttagttacattaagaaaactatgcctgaagatgacattttcacagatttaatatgtgaatttggaaaaattgaacatataattctgagatgattggctttttattgacatcaaattactgttttttaaaaacaatcgtgtacatttttaattctaatttttctgcacttaagaaatatgcatcagtaattgttagtatattagctccattagctacagaagaaattccaaaataattgaataatgccatctagatgtttcaaacagaaaattggattaaaaaatggtttgatttttaatcaatcattggaaccaaaataaagctgttgaaatattattgtgtcaggaaaaaaaacattgaacaatatgatactttttttaaaaaagttcacttgaaaagctaaacattgtggataacttttattggtgacaagaaaaagcaactttggaaaagtttttgcaagtaactttatttaaaaatcaatataaaattaaaacaaatgcattttcctaaaaaaactacaggtaattattaagaaacagattaatacatataaatatgttctagaataattattcttcctcttatttgtaatacttcaataataaatacaaagaagttatttttctattttgcctcaagatatgtaattgtgaatttaaatttctgaagggatttcattttcagaagtaattggaagatattcatttcctccaatgaaaactgtaaaagagcacgtttttcaaagcaactttatttcaatgtccactgaacaattttaacttaaggtaacttcatacttctttgtaacattaaagagtctttggattcaactttaaatcttgaaatacagtggatttaactatttagagtaagaacagatatatttaaggtaataatattggttgaaatgtctaatttatgacagaagatatgctgtctacactcatcatttc

SEQ ID NO: 480161 - DNA, 793 bp, Homo sapiens
gtaggcttgtgtttacaccccctcaagtcctctttggattccagcacgaggcatcaaaccataacatggcatggctagggtccaatctagtaccggaattgaaagagttaacccagctcaactacactatagcctttattcatactcacactgatcagtgcctggtttgcactacccatccatatgttttccttacaggaactaacatttccattacacctggaaatgccacatttgtgacccgggtgcagggacaggcttggtttgcctcatgtatcactggtcatgatatgtctagtttaaaaacttccagtgtcgtggtattaaggagacaatctgaggcacttctaccagccaatttgacatgcaattggcaagattcttctgcccttgccaccttagaaagtgccctgtcccaggtcagacacaaaagattcacatttacacttatggtctttacaggctcagccatagtcattatggcaactgttagcattgctgttgtatctattactgaatcagtacaaacaactgcttttgtagataatctggccaaaaatatatgtgatgaacttctcctacagtaaggaaagagtatgcgggagagccacaagatgcactagcattctgtcaacagtgaaaatgtgaatggcaacataaacatacctgtgtcacttctctaccatggaaccaattaatgtatagctagggtgaggtgaaacaacacctctggggaaccttttataacagtttaactgcagacatgaagcaagttaaaactaaaattttaaaa

SEQ ID NO: 480162 - DNA, 777 bp, Homo sapiens
ctactttcctcaccctttctgcctcatctccctgctgcctgtggtagtgattgctgggcactgggtgcttgatgcatgtgcatcctgaccctccttcccacactaggatagcggaggaggtgtgtggtttgaaggtggccaaatggccattaactgggtgctgcgtccagcagtatcactcaattccacatgtagaaaaagttagccaagggataagagctaaaacacctacagaatgggacgaagatatgtcaaaataccctctgtggctctggcacaggcaggacagtagcatcatcaggctgctgggcccaccagtatgcaataattccctctttattcagtgtcgtagcagaagtgtaacatcctctgtgtgcaaatcgtcaaaatttttctttgtgggcacggttcagataaaaacaggagagtcacatgacctaaatgctgtgctcagcaatatgtcacaattccaccatttgaaaggcccaggcagggaaagagagtcatgtcagttaggttatggcctcagagatatgtcccagtgtccccattaggcaggactcaggcagaaaaggagagtcttatcacctaggttcttctttagaacagtgcacaattgaaaatgtatgaattgtttattgatggaagttttcatttaatattttcagaccacagttcaccatgggctactgaaaccacaaaaagcaaaaccacagataaggggagcaactgtaataacttggattctgtaatgtttgctgatggttgatagcatat

SEQ ID NO: 480163 - DNA, 551 bp, Homo sapiens
tgaatacgtacacagtataagcaatggcaggtccacttaatgatagaccatatcatcaaagaaaggcatttcctgcttatccaaattcagcagttcaggtcaccactggatatcagttccatgtatacaattaccaggcccatctagcattcagtgtcacgggccggttttgctgctttcagaagccccctgcaagcctcagtgttgctaggccaagacctgactgcctcttcattagtgtcccaatggatcccacaaacataatccaaggtcctgactgttcttctcctttcccagaacaggatcatacacactttactccaccaggacattatgacatgctgaacaagaccctgaaattgtggttcactgtgaccaggctgaggctgcgctttaaaaggcagaactgccagcttggtgccttattttccttgtcattctaatgcatcttttgataaggagaccagaaaagagtattttagtacggagaccagaaaagggtctgaatatgtgacagccctcctcatagagttggtactatttattcatga

SEQ ID NO: 480164 - DNA, 481 bp, Homo sapiens
ggtccctggggtgaaggagtcaccagggctgcaaaggtcatccatgtggccatttgatctggtcatctgggaagtaactggacaagagaaaatgactttgtctgtaggagccatctgctttctgcctggatcccaactgctgctgacagatgcacagattattttggatgttggggatgtcatcaacagaatgccccagcagtcacccactgagtcaaggcacagcctctccaaccctccagaccaaaagtttcggagtcctgtgacccaaggagcaccactgggagaacttcagcctggaggggagatcagccattttgtgacctcgtgcccctaccaagcagtgcaatggtacctaatgggttataggacgattccaggaacagctcacttcagaaaccacagtaaggtattgggacccaaggcaggacacatcccacaaggaccaaaagggagcctaatcacctcctaggttataacc

SEQ ID NO: 480165 - DNA, 943 bp, Homo sapiens
ccggcagccatttgtcacagacctgggaaagggactgaaacaagaatggaaatgtcaccagctgaggagatagtgaaggcaaatgccaagcaaggaagctacagccatagtcagaccccagaaaatggggaatgcctggtgcagatgaccacaggtttctcgcaggcagagactgaattcacagagagccttgacagggctgtttcagtattccaggcagatgatgaggaagacccctcttgcagccacaggacagagagtgtgaatgcaggaattcagcaacctagacgagagggtgatatagaggcttggcagctccctgttaggatacatgccccaggtcaacagggaaatattatcactacttttgagccttttccttttaaattactcaaagaatttaaaccagctattaatcaatatggaccaggttcttctttggtaatggtaccgttaaagaatgttgctgtccccagtcagatgattcctactgaatgggatgctcttacagggaaagcacatttaattgactatatcaaggcctgtgatggtatcagaggtaatctgcataaagctactttggtggtgcaagccatgacaggactgaaagtgggtaaaggaaatactccatttcctggagcttgttttaactgtgggaagcatggtcacactggaaaagaatgtgaaaaaaatcagtgagtcaggccacaagttgagggataaaaggaaaactgctgagcctggaatatgtccaaaatgcaaaaagaaaattactcggataatcagtgtcactctaagtttgataaagatggaaacctgattttgggaaatgccaggaggggccgtcccagtccgctttctaaaccagggcatttccagctcaggaaatgccctatatttcatctcaaaaggtggagtttgcagctgtaattgaggtatggac

SEQ ID NO: 480166 - DNA, 582 bp, Homo sapiens
ccaccacagctctgatggtgccctccacgccagacagagacagaggacctggaagggaaggtgccctgccccacactctccgtgctcttgcaaagttgcagggtgtttccttgcacgcccacccaatcatccggcggctccttgaccagaggcagattgtgcggcacaccgagatgttggccgggatcacaaatgatgatgaagtcctgctaagctacgtacgtgatggatttgcaggtaaggggaggaaagcaactcttccgggtaccggcagcaggatgaagttttccttttatcacagtctctacttccacaatgaagtgatcattcaggagtactgccttggcatcctcgcctccagctgcaggccgtacagctcctacctgaccttcttcagctggttggctgaccatgactgcccaggttctggcaggattgctgaggagcccccgaccagtacatcacgcagtctaacaccctgataacactatgcagaagggacatccaatggagagactcaaagaaacagaacaagatgtctgagcatctcagcagtccagcccctgctatttgagtcacgct

SEQ ID NO: 480167 - DNA, 575 bp, Homo sapiens
ccaccacagctctgatggtgccctccacgccagacagagacagaggacctggaagggaaggtgccctgccccacactctccgtgctcttgcaaagttgcagggtgtttccttgcacgcccacccaatcatccggcggctccttgaccagaggcagattgtgcggcacaccgagatgttggccgggatcacaaatgatgatgaagtcctgctaagctacgtacgtgatggatttgcaggtaaggggaggaaagcaactcttccgggtaccggcagcaggatgaagttttccttttatcacagtctctacttccacaatgaagtgatcattcaggagtactgccttggcatcctcgctgcaggccgtacagctcctacctgaccttcttcagctggttggctgaccatgactgcccaggttctggcaggattgctgaggagcccccgaccagtacatcacgcagtctaacaccctgataacactatgcagaagggacatccaatggagagactcaaagaaacagaacaagatgtctgagcatctcagcagtccagcccctgctatttgagtcacgct

SEQ ID NO: 480168 - DNA, 1337 bp, Homo sapiens
gtgactgaagaggataacggtaatgaaaactttttttttcacctaaatcagaagtgaaccagctaagtttctcagggagaatgccaccctccctggagactcaggccctgccggacccacatgctgtcctctctcatgggccggagactctggtgcacagggattcccgaatagcgaatcccaaagccctgcaggtttcactgattcttacctgaatgccccagccgaacacacaggtagcttgtgccagccacccttttcctcctccctctgccatttgtgagaaccatgaggactctttgcttctccctagcatgcagacttcacgggtcctgaagttggattgccaaacccagcggcaccctgcttgccagcttaagagctgagtttgaggcacacctgtgggcaggagtgtcggccctcccaaaaccaagtccagggatggcctgggatttctcactgcaggctcctccctgagccttgagttctccatgtgtgtcacagctgcaggacccacaggcctttgagcccccagctgtgggctgcttacctggcctcctctctgttccctctctgaggacctaatccttaggtagtgctgcaggggattgagacggaagccctgactgatgatctggaggagtggggaaagtggtctgtgaaaggtcaggtcatagttcaaagccagttcccaagatgccaaggaaagaccagcaaggtcctttcccatgacgccccacagcggcccctgcctcagcagtcctggctgaccctgagtggtcacagtcagccaactagctgaggaagctcaggactttctcatggaaacatgcccttcaagtttctgctggcacccccaagcaagctgccctcctatctgcaggaccctggcctcagctcccttcgctatcccccatcccctgcctcctggttgtccccgtgtgccccttgcttggctcccctgctccccaccccaagaagccagatgcccaccccctgctgccagtcattccgaatgggcagctgcaaagatgtgcctctggcccagaagctggagatgccctggctgatggcccctgctccatgtcaggcttctcctcaaccaccacctggaccatgccatgatgttgtccaccaccagcaccttctcctcccccaagagtgccttcgaactctgcgccctggctgccctctcctgcagagcctccaatttgaatggggtgcctcctttggaggtcccactgaccatgacctgcactgtccactcactgtccactccacgtccagataagtatatccttatagtatacttaaaaaaaaaaaaccttaaaagcatt

SEQ ID NO: 480169 - DNA, 1772 bp, Homo sapiens
ggagagcccagacaagagttgcatcacctcggtgatcagtgcagagatatgtctcaattagtcctgtcggcaaagcccagagaagagttacatcatgtcggtgatcagtgcagagatatgtcaaaatgcccctgtgagcagagcctagacaaaatttacatcacctgggtgatcagtgcagagacatgttacaatgtccataaaggaatggaatgcaatggagtgaaatggaatggaatggagtggagtggagtggagtggaatgcaatggaatggagtggagtggaatggaatggagtggaatggaatggtatggaatggagtggagtggaatggaatggagaggaatggagtggagtggagtggaatgcaatcgaatggaatgtaatggaagggaatggaatggaagggaatggaatggagtggaatggaatgaaatggaatggagtggagtggagaggagtggaatggaatggaatagagtggaatggagtggaaaagagtggaatggaatgtggtggaatgaaatggagtggagtggactggagtagagtggaatggaatgcagtggaatggaatggagtcctgggtgacacagtgatatcctgtcgaaagaaaggaatggaatgcaatggagtgaagtggaatggaatgaaagggagtggagtggagtggagtggagcagaatggagtggaatgcaatggaatggaatggagtggagtggaatggaatggcatggaatggagtggagtggaatggaatggaatggagaggaatggagtggagtggagtggaatgcaatggaatgtaataatggaacggtctcgaatggaatggaatcgaatggaatgcaatcgagtggaatggaatggactcgaatggaaaggaatggaatcaaaaggaatggaaacggaatggactcaaatggaatggactggaatggaaggcaatcgaatggaatggaatcgaatggaatggaatcaaatgtaatggactggaatggaatggattcaaatggaatggacagtaatggaatgaatttaatggaatggaatggaatggattggaatggaaaggaattgaatcgaatcaaatgttatggaatcaaatggaaggaaacggaatggaatggaatggattcgaagggaatggaatggaatggaatgacatggaatggaatggaatggaatggaatgacatggaatggaatggaatggattcgaaaggaatggaatggaatggactcaaaaggaatggactggaatggcatggaatcgaatggaattgaatgcaatggaatgcaatggaatggactcgaatggaatggaatggaaaggaatggaatggactggaatgaaatggaattgaatggaatggaatggacaggaatggaatggactcaaatggaatggaatcgaaaggaatggaattgaatggaatggaatagaatggaatggaatagactcgaaggtaatggactggaatggaatggacttgaatggaatggactcgaatggaatggaaacgaatggaatggaatctaattgaatggaatcgaatggaatgcaaacgaatggaatggaatcaaatgaaagggaatcaattggaatggactcgaatggaatggactcgaatgtaatggactggactggaatggtatggaatggaattcaaagcaatggaatgaaatggaatggatccgaatggaatggactggactggaatggactggaatggaaaggaatggaagggaagggaatgcattggactc

SEQ ID NO: 480170 - DNA, 1086 bp, Homo sapiens
cgagtgcaatggaatcgaatggaatggaatcaaatggaatgtactggaatggaatggactgcaatgtaatggaaggaaaaaatggaatcgaacagattggaaccgaacggaacggaatggaatggaagggacaaaaatggaatggagtcgaatggaatggaatcaaatggaatggattggaattgagtggaaacgaaaggaatagaatggaatggagtgtaacggaaatatatcgaatggaatggaatggagtggaatcgaatgtaatggaattgaatggattggaggaatcagatggaacggaatggaatgggaacagaacggaatttaatggaatggaatgtattggaatagacctgaatggattgttgtcgactgtaatggaaccaaatggaatggaatcaaatggaatggaagtgaatggaatcgaaaggaatagaatggaatggaataatggaatagtctcaaatggaatgaactggaatggaatggactcaaatggcatggacaggagtggtatggactcgaatggaatggaaatgaatggaatggaatggaatggaatggaatggaatggaatggaatggaatggaatgcaatggaatggaaaggattaccatggaatggaatcggatgaaaagaaactgaacggaatggagttgaatggaatggcatcaaatggaatggaatggaatgactcgaatggaatggactcgaatggagtagaattctgtggaatacaatcgcgtggaatggaagggaatggaatggtatggacccaaatggaatggaatcgaatagaatggactcaaatacaatgcactcgaaaggaaaggtctcaaatggaatttattcgaaacgaatggaatcaaatggaatgcaatagtatggaatggaatcgaaaggaattgacaaggatggaatggactagaacagaacgtacacgaatgtaatggattgcaatataatagaaatagaaaggaaccgtatggaaggtaatcaaatgaaatggaatggaatgcaatggaatggaatacaatggaatgcaatggaatggaacaaagtggaattgagtggaaggaaatc

SEQ ID NO: 480171 - DNA, 3282 bp, Homo sapiens
ggaacggaacggaacggaatggaatggaatggaatggaatggaatggaatggaatggaatggaatcgacccaaaaaatggaatgcaatggaatggaacggagtgaaatcgagtggaacagaattgaatggaatagaatcgaatggattggaattgattggaatagacaggaatgcaatggacttgaatggaatttactggaacaaaatggaatcaaacggattggaactgaacgaaacagaatggaatcaaatatatcgaatccaatggaatggaatggaatggactcgaatggaatggaatggaatggactcgaatggaatggaatggaatggacttgaatggaatggactggagtggaatggactcgaatggaatggaaaagaatggaatggaatggaatggaatggaatggaatggaatggaatggaatggaatggaatggaaatgaatggaatggaatggaataggatggaactaaatggaatggaatggaaatggaatggcatcaaatggaatggaacagaagggagtgtaaaggcaagatatcgaatggaatggaatggaatggaatggaatggaatggaatggaatggaattgactcgaatggaatggactggaatggaatggactataatggaatggcccggagtggaatggactcgagtggaattgactggaatggaattgacttgaatggaacagaatggagtggaatggagtcgaaagaaatagaattgaatggaatgcaatcgaatggaatggaatgcaatggactcgaatggaatggactcgcatggaatagaattgaatggaatggcatggaatggaatggaatagaatggaatgcaataaatgcaaaggagtggaatcaagtggaatggaatggaatggaatggaatggaatggaatggaatggaatggaagggaatggacccaaatggaatggattcgagtggaatgtaaccgacgaatggaatggaattgaatgcaatcgaaacgaatagatagaatggaaaattgtgaaaattatgtaataaaagtccttatgtgaagacagcattaagaatcctgccaaactgacttgtactgaatatgtagcatgagtaataaatgaatcctgataacagtaagacattgagttgtacatgtatacaccctataacacagcagtttcatgcatacatcagaaagattctttcacatgttcattaaggaaacatgcacaagtattttagttaataatattatttgcagcaataaatggcaatcagctcaaatgctcaccaattgtaggttgaaataaataaataacttttatatacatgaactgaacaacatacagcaatgaaaatgaatggattataaacacaaatatcaatatggataatttttaaaacatcatattaagcagttatagaaaaactacacacgtttgattgaaattttataattcagtctgaattaatggacatattgcataaggatataaaaatctatagtaataacagtggaaaacaccagggaacaaaattcagctaattactacctctggtggatatgaagtataatgcaattgaagaatgcacacagagagctcctacagtatgataattcattttctaacattgtttgcaggcacatgatatttgttttattattggtcttcaaaccccacatatatgcttttatgtactttttgcaatctatacttcacaactgttaaaaataaagcaaatcttaggtaaaatatgttttatatatatataaatatatattatatatatttttatatataaatatatattatatatatttttatatataatatatattatatatatttttatatataattatataatatatatttaagtataaatatataataaatataaatatatttttatataatatattttatgtatttatatataatatattctatataatatatattttatattatattctatataatatatattttatattatattctatataatatatattttatattatattatatactatatattttatattatattatataagatatattttatattatataatataatatatatttaatattatattatataagatatattttatattatattatatataatatatattttatattatgttatatgtaatatatattttataatatattatatgtaagatatattttatattatatattatatatatttttatattatattatatatattatattatatatattttatatattatatataaattttatatataatatataaagcacattatagaatgcccttgtagaagttgatctatagaagttaatttatacaagttaacttctagcaatgttaattcgtggttaagaaagtaattccaaggctattttttctgtaaaatgaagtataaattttttgcataagtaattattttctcacatctaactctctgcatctcttagctttattaaagcagggctggcctttcactttttaaatttttgtccctttccctttatgggattaaagaggaaaaatagaaaatcacaaatatatgaaggcctcttttgggaaagggggattttcttcccatgctagtgaagcagctactcgatcagtatatttccattttgtatctttatatgtttttactattttaatggtttttccttaaaatgtttaccataaatacttccttgtagcaagataaaaattaatatctaaccaccttccacaatgttttagaactttttaactctcatatctttcttgttgaattttaattatcatatcctcccctgctcgttttaagaatattggttcattccatttttaaactctataaattatattaacaatactagtataaatttacttacaggtgggaattgaacaatgagatcacatggacacaggaaggggaatatcacactctggggactgtggtggggtcgggggaggggggagggatagcattgggagatatacctaatgctagatgacacgttagtggttgcagtgcaccagcatggcacatgtatacatatgtaactaacctgcacaatgtgcacatgtaccctaaaacttagagtataataaaaaataaataaataaataaataaaaaataaaatgtaaaagaaaaaaaaaaagaaatcttgaatgtggaatgaaaggcaacgggaaaaaaggcaaaaattcaaaatatctggaaaaacttggcatggctggaagaatggctgcaaaatggaaagaaatggtgtc

SEQ ID NO: 480172 - DNA, 893 bp, Homo sapiens
cagaatactatagaccagacagcttatatgcgacagaaatgtgtttcacacagttctagagatagcgaagtccaaggtcaagtggtctgtcctggggttactgtgtcagcagcctatgggtggagccacaacccagtgttgctggaagtgggcactgcatttgcctttggaaagaacaagatgcagaaggtggggcttggtcgtcagacagatgcagttcctagccctgcgcagaagatgtggcctgtagagctaaccacatgctggtcctggactcccagaagcacatcttcttctgacacggggtggctattgctggctggaccatgtggagcagaaaaacgagatggtccacctcccacaagcggtttggctttcctggaatggggtccccagatctatgctggttatgcctggtcctttgctgtcagtgaagagggtgacgtgtttttctgggaggccaccaacacttcccatgagtctatcatgtacctgaaagcagtgctgaacatccaggggactcacaagcccacatctcccactgcggtccaagacatgaagacgctgcatggtgtcttctcagagcaggctgccatgggttactcccgctccttggtgatggcagcattgagccccagaatccaggctttccaggcacatgactgcctcaccttacctggggaaattgagctttcggagtcaaatgacaacacatttgatgaagaggcagtgcacactgcctcttcgccctcacatccatggttcagaaacggggcttaccggtaatctgcagggttttccttttatctgtctggggaatgtgtagcacattgctggcctgtagcagacttttaaattataatacttgttgtgttgaattaaatgaatacaaa

SEQ ID NO: 480173 - DNA, 538 bp, Homo sapiens
gagccaagggagatgggcttccctggctgtgttgtgctacgcatactcctacagcaaaccctctgggctctatttcagctattatgctgctcctaccacctctctaagcagctctccctgccaactcaggtgtctgtggtggtcaaggggtctcctcctgccaggattccagaggcctatggtataaggttgacaatgggagaagcagagattctgatttattctgtagataccctaacctccaaagctcttgcaaaggctcaggaatcaccaagatcagatgcctctggaaatgaggtcgaggtgaaggttgaagcattggttgatggaggtgcacagtcagagaacaaaagccacaccctcattcttcacagcagcacgtcaatagataatgccaaaaactgactagtcatgatttattcagagatacagaggagcacaatccgttccagtacaatggaatctcctcattgtaatggctgttcaaaattaacggtttacttacaaaattttctgaacttatgccattgaattattg

SEQ ID NO: 480174 - DNA, 496 bp, Homo sapiens
agaaggaaccagcaactccagacatgctgcctttaagagctgtaacactcactgcgaaggtctgcagcttcactcctgaggccagcgagactacaaacccacaagaaggaaattactctgaacacgtccgaacatcagaaggaacaaactttagacacaccatcttaagaaaagtaacactcactgggaggttctgcggcttcgttcttaaagtcagagagaccaagaacccaccaattttggacacagtatcacaaaataccatggacggggtggattataaacaacagacattattctctcacagtgctggaggctggaagtctggtataaagctggcactcattccattcaggaggcttttcttaaaccttcagagtaagaatttcaacattgaattttaggaggacacaagcatttagacgatatcataagtccacgagttgtattaaattagggtctggcctaatgacctcagcaacttaattacctcgtg

SEQ ID NO: 480175 - DNA, 813 bp, Homo sapiens
ggtatcgtgtacttgtacaaccaatcttgtctgctgagatgcccctgagatgcccctgaagcagtgtacaccacaacactctccacacagtgtctgagcatggctcatgggcctggagtcagtgctgacccaaactcctgggaactcgcacctccaatcccagatgctatgtccagcaaaggatccatggttctggcccacagtggtggcctggacacctcctgcatgcttgtgtggctgaaggaacaaggacatgttgtcattgcctacctggccaacattggccagaaggaagacttcgagaaagacaggaagaaggcatgcaagcttggggccaaaaaggtgttcattgaggaagtcagcagggagtttgtggaggagttcatctggccggccatccagtccagcgccctgtatgaggactactacctcctgggcacctctctggctaggctctgcatcgcccacaaacaagtggaaattacccagcaggagggggccaagatgcccgagttctactactggctcaatggctgcaatgatctgatggaatacacaaagcaacatcggattcccatcccagtcactctcaagaacccgtggatcatggacgagaacctcatgtgtatcagctatgaggctggaatcctggagaaacacaagtaccataagcacctccagattgagttcaaaaaagaggtccccgtgaaggtgaccaacgtcaaggatggcgccacccaccagacctcctaggagctctgcgtgtacctgaacgaagctgcgagcaagcatggcctgggccatattgacatc

SEQ ID NO: 480176 - DNA, 5110 bp, Homo sapiens
ggccggaaaggtggagaaaattccagaggatttcatatccaggagaccaagaggataatgaattctgaagtgtaaaaaggacaaagcttatgaaggcggtcagttgtgtgcaatgtgcttcagtccaaagaagttgtacaaacatgagattcacaagctgaaggacctgacttgtctgaagccttccatagagtctcctctgagacagaacaggagcaggagtattgaggaggagcaaaaacaagaagagaatggtgacagccagctcatcctggagaaaatccaacttccccagtggagcatctctttgaatatgactgatgagcacgggaacctggtgaacttggtgtgtgacatcaagaaaccaatggatgtgtacaaaattcacttgaaccaaacagatcctccagatattgacataaatgcaatggttgccttggactttgagtatccaatgacccaggaaaactatgaaaatctatggaaattgatagcatactacagtgaagttcccatgaagctacacagagagctcatgctcagcaaacaccccagagtcagctaccagtacaggcaagatgccgatgaagaagctctttactacacaggtgtgagagcccagattcttgcagaaccagaatggatcatgcagccatccatagatatccagctgaaccgacctcagagtacggccaagaaggtgctactttcctactacaaccagtattctcaaacaatagccaccaaagatacaaggcaggctcggggcagaagctgggtaatgattgagcctagtagagctgtgcaaaaagatcagactgtcctggaagggggtcgatgccagttgagctgcaatgtgaaagcttctgagagtccatctatcttctgggtgcttccagatggctccatcctgaaagtgcctgtggatgacccagacagcaagttctccattctcagcagtggctggctgaggatcaagtccatggagccatctgactcgggcttgtaccagtgcattgctcaagtgagggatgaaatggaccgcatggtatatagggtacttgtgcagtctccctccactcagccagccgagaaagacacagtgacaattggcaagaacccaggggagccagtgatgttgccttgcaatgctttagctatacccgaagcccaccttagctggattcttccaaacagaaggataattaatgatttggctaacacatcacatgtatacatgctgccaaatggaactctttccatcccaaaggtccaagtcagtgacagtggttaccacagatgtgtggctgtcaaccagcatggggcagaccatatcacgatgagagaagacatcgtggaggatgaaggggtctcaggcacgggagatgaagagaacacttcaaggagacttctacatccaaagcaccaagaggcgttcctcaaaacaaaggatgatgccatcaatggagataagaaagccaagaaagggagaagaaagctgaaactctggaagcattcagaaaaagaaccagagaccagtgttgcagaagatctcagagtgtttgaatcaagacgaaggataaacgtggcaaacaaacagattaatccggagcactgggctgatattttagccaaagtctttgggaaaaatctccctacaggcacagaagtatccccaattattaaaaccacaagttctccattcttgagcctagtagtcacaccacctttgcctgctgtttctccccccttggcatctccaatacagacagcaacaagtgctgaagaatcctcagcagatgtacctctactcagcgaaggaaagcacattttgagtaccatttcctcagccagcatgggactagaacaccacaacaatggagttattcttgttgaacctgaagtaacaagcacacctctggaagaagttgttgatgagtattccaagaagactgaggagatgacttccactgaaggcgacctgaaggggactgcagcctctacacttatatctgagccttatgaacaatctcctactctacacaccttagacacagtctatgaagagcccacccatgaagagacggaaacagagggttggtctgcagcagatgttggatcctcaccagatcccacatccagtgagtatgagcttccattggttgttgtctccttggctgagtctaagcctgtgcaatactttgacccagatttggagactaattcacaaccacatgaggataacataaaagaatacagttttgcacaccttactccaaccgccatcatctggtttaatgactctagtacatcactgtcatttgaggattctactgtaggggaacaaggtgtcccaggcaaatcacatctacaaggaccgacagagaacatccagcttgtgaaaagtagttttagcactcaagacaccttattgattaaaaaaggtatgaaagagatgtctcagacactacagggaggaaatatgctagagggagaccctacacactccagaagttctgagaatgagggccaagagagcaaatccatcactttacctgactccacactgggtataacgagcagtacgtctccagttaagaagcctgcggaaaccacagttgtcaccctgctacacaaagacaccacaacagaaacaactccaaggcaaaaagtggcttcatcatccaccatgagcactcacccttctcgaaggagacccaatgggagaaaattacaccctcacaaattccaccaccggcacaagcaaaccccacccacaacttttgctccattagagactttttctactcaaccaactcaagcaactgacattaagatttcaaatcaaatggagagttctctggttcctacatcttgggagattaacacagttaatacccccaaacagctggaaatggagaagaatgtagagctcatatcaaagggaactccacggagaaaacacgggaagaggccaaacaaacatcgatataccccttctacagtgagttcaagagcatctgcatccaagcccagcccttctccagaaaataaacatagaaacattgttactcccagttcagaaactacacttttgcctagaaatgtttctctgaaaactgagggcgtttatgattccttagattacacgacaaccaccagaaaaatacattcatctcaccataaagtccaagacacacttccagtcatgtataaacccacatcagatggaaaagaaattcaggatgatgttgccacaaatgttgacaaacataaaagtgacattttagtccctggtgagtcaattacaaatgtcacacaaacttctcgctccttggtctccactatgggagaatttaaggaagaatcctctcctgtgggctttccaggaattccaacctggaatccctcaaggaaagctcagcctgggaggctacagacagacatacatgttaccacttctggggaaacccctacagaccctccccttgttaacgagcttgaggatgtggattttacttctgagtttttgtcctctgtgacagtctccacaccatttcaccaggaagaagctggtttttccacaattctctcaagcataaaagtggagatggcttcaagtcaggtagaaactaccacccttggtcaagatcatcatgaaaccactgtggctattctccactctgaaactagaccacagaatcacatccttactgctgcctggatgaaggagccagcatctttgtcccctcccatgattctcctgtctttgggacaaaccaccaccactaagccagaacttctcagtccaagaacatctcaaatatgtaaagattccaaggaaaatgttttcttgaattacatggggaatccagaaacagaagcaaccccagtgaaaaatgaaggaacacagcgtatgtcagggccaaatgaattatcaacaccatcttctgaccacgatgcatttaacttgtctacaaagctagaattggaaaagcaagtatttgatagtaggagtctaacacgtggcccagatagccaccaccaggatggaagagttcatgcttctcatcaactaaccagaatccctgccaaacccatcctaccaacaggaacagtgaggctgcctgaaatgtccacacaaagcacttccagatactttgtaactttccagccacctcatcacgggaccaacaaaccagaaataactacatatccttctagggctttgccagagagcaaacagtttacaactccaagagtagcaagtacaactcctctcctatcacacatgtccaaacccagcatttctagtaagtttgctgacctaagaactgaccaatccaatggctcctacaaagtgtttggaaatagcaacatccctgaggcaagaaactcagttggaaagcctctcagtccaagaatttatcattattccaatggaagactccctttctttaccaacaggactctttctttttcacagttgggagtcacccggagaccccagataccctcttctcctgtcccagtaatgagagagagaaaagttaatccaggttcctacaataggatatattcccatagcaccttccatctggactttggccttccagcacctccactgttgcacactccatggaccatggtatcacccccaactaacttacagaatatccctatggtctcatccacccagagttctgtctcctttataacatcttctgtccagtcctcaggaagcatccaccaaagcggctcaaagttctttgcaggaggaccgcctgcatccaaattctggcctcttggggaaaagccccaaatcctcaccaagtccccacagactgtgtctgtcactgctgaaacggacgctgtgttcccgtgtgaggcaataggaaaaccaaagcctttcgttacttggacaaaagtttccacatgtaagatttttaagcatctactcttttttgggtcaatttttattttattggctagcaatattacaatacactaaaagagcatgaggtacaaaacataaacacgttaggagaaatatttacaacaaatttggggaatttttttttacttgaagaagtgtttatttttataattt

SEQ ID NO: 480177 - DNA, 937 bp, Homo sapiens
agttaattaattaagttgagacagggtgttgctctgtcacccagactgcagtgcagtggtgtgcaccatgaggcacgactcttcttcttcttcttcctcttctccttcttcttcttcctcttcttcttcttttcttctttcttcttcttcttcctcttcttcttcctctccttcttctccttcttcttcttcctttcttcttcctcttcttcttcttttctttctttctttttctttcttcttctttcttcttcttcctcttctttcttcttcttttcttctttcttcttcttctccttcttcttcttcttcttcttcttcttcttcttcttcttcttcttcttcttcttctttcttctctcttcctcttcctattcttcttcttctttcttcctcttcctcctcttcctcttcctcttcttcttctttcttcaatttatgtagagatgggatctgctatgttgccaagtatgatcttgaacacttaacctcaagcagtcctcctgccctgacctaccaaagtgctgagatgacaggcttgagccaccgcgcctgaccctgtgtgtgatttttatgcaatgacattttgtatctctaaacttggatctacaacgaatgcttaacttcctcttaacaaatacttaacttcctcctctcttgtcccattcaaaaaaaaaaaaaaaggaaaaaaataaatcaagaaactgttgttttaatgattatatgtttaactataatgttagggcaaacaattcagcttgcttctatttccattgtagatttcaacaatatacatagatgtgttaggctttattttaatatggcattattggtacaatcaaagtgtacacattgttttaaaagcatcattaccacaccaacatagtgcacttgaaatgatacaaatgtacttgggctatgaagaaagccaccttct

SEQ ID NO: 480178 - DNA, 572 bp, Homo sapiens
agagtcatacttttaggctttatgcctggctttggggaaaaaggtgtcttgtttcttggatccaccttgggaaggagggattctagtttttacggtgccttggatgagaatgggactgagatactcaagatggtagtagagggtgtttatgcagactccagtagcttccaaggaggaacaggattcagcagatcaaagtttcccagcatctgtgatagtctgaagccagcaggagggaagacagggtctcactctgtcacccagactggacaatcacagctcactgaagcttcaaccttctgggctcaagtgatcctcctatctcagcctcccaaagaggatgagtgttcacaaattgtaaaaacttccatgaaacatgaacaggaaaagaataaggaaatcatttttttctgggaagagtgaagtttctgtgagtgttttgtggggttagagactgaataaatcaggaaggggacagatgtttggtgtgattagcaggtttgattgaatggaaccagctttgaagtctaattgaagacatttgacattaaaatgctaagattatgtttttc

SEQ ID NO: 480179 - DNA, 1151 bp, Homo sapiens
ttgattgatggatatttgggctggttccacatttttccaactgtgaattttgctgctataaacaatgtatgtgcaagtgtcttcattttttgtgtttttgttgtttgagatggagccttggtccatcactcaagctgaaatacagagccccttggtcttcatgtctttggtgtgtgcactcttgaacacttgccaggcacacagggtgcatgacaacaagcctaatattatcctgatcatggttgataacctgggtattggagatctgggctgctatggcaatgacaccatcagtgaggtttggatacgcacaatgtatagtgatcagatcagggtaatcagtgcatccagtgtctctaccattaacgaggatggtcaaagtaaaagcgtggctgtccggacccaagtcctagctctgtatttactacctctgaagtcttggagaaagaaggctttatatccctgagtttatatgtgtaaagaacttagaatagtacctaacacacaactatcctctattatgcagtctattatgaagcatgatgattgtatatacatgtgcatatacagatataaacatataaatattatataaatatgtgatatatttcatttatgaatatattctataatatataaaatatatatcatacatttattgtattatatatcatatattatgaatatatgaacatatattcaatatataaacatatatgagtatatattacaaatatataaatgttattcatatatacatgaatatatacatatttatatgtctatgaatatatattcatttttatataaatgtataaataaaatttatatacatttatatataaatatatttaaataaatatataaacatctatatactttagaaaagtataaataaatatatgtaaacatatttatttattttatataaatatttatataaaatgaatatatattcataacataaaattatatattataaacatatttatatattcatatttataatatataaatatgttcatataaatatattcataaatatgtataaattaataagtatatatttatatattcaagcatatatattcataaatatataaatgtgaatatgtacattcagcagaattcattctgtttcctaatttggc

SEQ ID NO: 480180 - DNA, 578 bp, Homo sapiens
aaaatttgaagcatgtgtgactgcagactacaaaagacaaagagaagatctacagatggaaacagggcaaatcccccagggcaaaagagaaacccctccttcactgacccttccagtaactgtgcagacagttacaggatgcggttcacatgtgtgttaacctcgcataacaaagccggcaagaaacatctccagggtgaggtcaagacagctgcacccctgactcagatccccaaccccgacccagttctcctgcacccccgactcagctccggcaccccaacctggttctggccctataaaaccctacagtctctcctcctagccaaacttctccttccagaatctgctagagacccgaggatttcatacagcttttccattgctagcaataacatccaacaccggggccgtgtcaggcctgagtaaaggagacttttgtcttcagtctggaacccttgtccgctctttccttcccgaaagacccagcgctgggccaagggttcccccctcccagcctctaggccctcggtatctctctttcagggacgcctgaacggggggatatccacttatcc

SEQ ID NO: 480181 - DNA, 1313 bp, Homo sapiens
tcgggggaggccggggccccatggggcgcaggcagccacgctgtcgcccccaggcctggaaatccacgcggcttcccaaagacggcgcctctgttctgcgggttcgtgacgaggatttatttccacccactgcgcctgggcgcaggtctgcgggtccgcgcccactgcgtgcggcgccacggaccatgtcggggtctcactctgtcacccaggctggagtagagtggtacaatcacagctcactgcagcctcaaactcccaggctcaagtatcctcctacctcagcctcccaagtagctgtaactacagtgactgatcaggcttttgtcacactggccacagatgacatctactgccagggcgccctggtcctggggcagtcactgaggagacacaggctgacgaggaagctggtggtgttgatcactcctcaggtgtccagcctgctcagggtctcactcgtcgcccaggcttgagtgcagtgataccatctcggctcactgcaacctctccctcactggcccaagtgatcttccctcctcagccttctaagcagctgggaccacaagtatgtgcccgcatgcttggctatttttatttttattttttgtatttttggtagagacagggtttcgtcacattgcctaggctgatcttgaactcctggactcactcagtccacccaggttggcctcccaaagtgctgggattacaggcatgagccacggcgccctgccaaggagtctttttaaaaataatttccttttacaattccctttgtctttaattctcaaataaagcaaatacataaataaatgcatctaatgaataaagcataaggcttctcttaaatgtcatacattatgtaagcaataatctttttctttcatcaaccatggaccacttagaaaaagtgattttatatgaatgggacgaggaggcatttaatatgtagatgtagcaggaattgaatgtcatattctttgacaacgaaataataaatccagacattaatagctaaactaaaaagagaacaaataaaaaaccaaccagtgtgtcctcagacattttaaactagaagtgctctcctaaataacttgatctgggtataaatgaaagcttgaattacgtactatttcagaaaatgattccaatctgttgcaaaacctggcatcgtatcaattggagacttgttgctgtggtttaaatgcctttttcttggtattattggtgcagtcccttttcagcaactctcaggactgtttattttgcaaggctttgcaatatgtcaaggttcagaggaaagtgggggt

SEQ ID NO: 480182 - DNA, 655 bp, Homo sapiens
ttaagaaccatttttggagaatcagtgtgtttgtaggaaagcagcctcaagggcatgcagtcaagtaagaatcttttgatctatatttgctgtaagagaagtttattagacacatttctggacatattatctacaaaagcagctgtttgtgctgatttaggaatagatgccacagtaacactagcagttgccagaatgactgtggctgagactaaaaaggccctaagtccgcagccagtggctgctgccggctgggcagaccttcccacgtacacctcctgcccctccctaggagaccagttccagcccactgagcctagctgtccgatgccaccactgccacgaaggctgagttcccaggagtatttgctggctccaggtccgcttccacactgtcttctgctcttcgcaataaatcttgctgctgctcactttttggctacactctacttttatgagctgatgatattttttaatacttatagcttattctagactaatttggcactttctgctttcaggggtgcagactgagaaaatttttatgtaatagctttctcagatgctggttgtagtagaagtgtactgagtgtgagagcaagttcactgttacctataagtttgaaatgacagaggtctctttaagctcaccttg

SEQ ID NO: 480183 - DNA, 1373 bp, Homo sapiens
catgtacagaacgggcagatgtgtccagagtttcttccatctggcaggttcatggccttgcttacttcaagaatgaagctgcagacctttactgttcatggtcttgctcacttcaagaaagaagctgaagacctttacgatgtgttcagagtttcttccttctggcaggttcatggtcttgctcacttcaagaatgaagctgcagacctttacgatgtgtccggactttcttccttctggcaggttcatggtctttctcacttcaagaatgaagctgcagaccttagtgatgtgtccggagtttcttccgtctggcaggttcatggtcttgctcacttcaagaatgaagctgcagaccttagtaatgtgtccagatattcttccttctggcaggttcatggtcttgctcacttcaagaatgaagctgcagaccttagtgatgtgtccagagtttcctccttctggcaggttcatggtcttgctgacttcaagaataaagctgcagacctgtacgatgtgtccagagtcaattccttctggcaggctcatggtcctgctcacttgaagaatgaagctgcagacctcactgatgtgaccggagtttctttcttctggcaggttcatggtcttgctcacctcaagaatgaagctgcagaccttagtgatgtgtccggagtttcttccgtctggcaggttcatggtcttgctcacttcaagaacgaagctgcagaccttagtgatgtgtccagatattcttccttctggcaggttcatggtcttactcacttcaagaatgaagctgcagaccttagtgatgtgtccagagtttcctccttctggcaggttcatggtcttgctgacttcaagaataaagctgcagacctgtacgatgtgtccggagtttcttccgtctggcagattcatggtcttgctcacttcaagaatgaagctgcagaccttagtgatgtgtccagatattcttccttctggcaggttcatggtcttgctcacttcaagaatgaagccgcagaccttagtggtgagtctcacagcactgaaaaggtgttatgtccagagtttgttcattcagatgtgtccggagtttcttccttctggcaggtttatggtcttgttctcttcaagaatgaagctgcagaaattagtgatgtgtccagagtttcctccttctggcaggttcatggtcttgctgacttcaagaataaagctgcagacctgtacgatgtgtccagagttaattccttctggcaggctcatggtcctgctcacttgaagaatgaagctgcagacctcactggtgagtgttaccgcacttaaagttgttatgtcctgagtttgttcatgcagatgtgacc

SEQ ID NO: 480184 - DNA, 2843 bp, Homo sapiens
tcatggtcttgctcacttcaagaaagaatgaagatgcagaccgttacggtgagtgttacagcatataaaggtgttgtggacggagtttggtccttcagatgtatccagagtttcttcttcgagcaggttcatggtcttgctcaattcaagaataaagctgcagaccttggtgatatttccagagtttcttccatctggcaggttcatggtcttggtcacttcaagaatgaaactgcagaccttagtgatgtgtccagagtttcttccttctggcaggttcatggtcttgctcacttcaagaatgaagctgcagacatttacgatgtgtccagagtttcttccttctggcaggttcatggtcttgctcacttcaagaatgaagctgcagacctaggtgatgtgtccggagtttcttccatctggcaggttcaaggtcttgctcacttcaagagtgaagctgcagaatttagtgatgtgtccagagtttccttcttctctcaggttcatggccttgttcaattcaagattgaatctccagacctttacgatatttccagagtttcttccatctcgcacgttcatggtcttggtcacttcaagaatgaagctgcagaccttagtgatgtgtccagagtttcttccttctggcaggttcatggtcttgcacacttcaagaatgaagctgcagaactttacgatgtgttcagagtttcttccttctggcaggttcatggtcttgctcacttcaagaatgaagctgcagaccttagtgatgtgtccagagtttcttccttctggcaggttcgtggtcttgctcacttcaagaatgaagctgcagaccttagttataagtccagagattcttccttctggcaggttcatggtcttgctcacttcaagaatgaaactgcagacccttacgatgtgtccagagtttcttccttctggcaggttcttggtcttgctcacttcaagaatgaagctgcagaccttagcgaggctcttgattcagatgtgttcggagtttcttccgtctggcaggttcatggtcttgctcacttcaagaatgaagctgcagaccttagtaatgtgtccagagtttcttccttctggcaggttcatggtcttgctcacttcaagaatgaaactgcagaccttgacgatgtgtccagaatttcttccttctggcaggttcatggtcttccttacttcaagaatgaagctgcagacctttatgatgtgtccagagtttcttccttctggcaggttcatggtcttgctcacttcaagaatgaagctgcagaatttgatgatgtgtccagagtttcttccttctggcaggttcatggtcttgctcacttcaagaatcaagctgcagaccttagtgatgtgtatagagtttcttccttctggcaggttcatggtcttgctcacttccagaatgaagctgcagacctttacgatgtgtccagagtttcttccttctggcaggttcatggtcttgctcagttcaagaatgaagctgcagacctttacgatgtgtccagagtttcttccttctggctggttcatgatcttcctcacttcaacaatgaagctgcagaccttagtgatgtgtccagagtttcttccttctggcagattcatggtcttgctcacttcaagaatgaaactgcagacccttacggtgagtgttacagcactgaaacatgtcatgtccagagtttgttccttcagatatgtccagagtttcttccttctggcaggttcatggtcttgctcacttcaagaatgaagctgcacacctttatggttcatggtcttactgccttcaagaatgaagctgcagacctaggtgatgtgtccagagtttcttcattctggcaggttcatggtcttgttctcttcaagaatgaagccgcagaccttagtgatgtgtccggaatttcttctttcgggcaggttcatggtcatgctcacttcaacaatgaagctgaagaccttggtggtgagtgttacagcagttacagttgttatgttcatggtcttgctcacttcaagaatgaagctgcagaccttagtggtgagtgtcacagcactttaaggtgttatgtccagagtttgttcattcagatgtgtccagaatttcttccttctggcaggttcattgtcttgctcacttcaagaaagaagctgcagacatttagggttcatggtcttgctcacttcaagaatgaagctgcagaccttagtgatatgtccagagtttcttcattctggcaggttcatggtcttgttctcttcaagaatgaagctgcagaccttagcgagtttgttccatcagatgtgtctagagtttcttccttctggcaggttcatggtcttgctcacttcaaggatgatgctgcagaccttagtgatgtgtccagggtttctgtcttctggcaggttcatggtcttgctcacttcaagaatgaagctgcagaccttagtggaatgaagctgcagaccttagcgatatgtccagaatttcttccttcgggctggttcatggtcttcctcacttcaagaatgaagctgcagaccttggtggttcatggtctttctcacttcaagtatgaagctgcagaccttggtgatgtgtccagattttctttcttcttgcagtttcatggtcttgctcacttcaagaatgaagctccagaccatgaacctgccagaaggaagaaactacggacacatctgaatgaacaatctctggacataacacctttaagtgctgcaacactaaccactaacgtctgcagcttcattctttaagtgagcaagaccatgaacctgcc

SEQ ID NO: 480185 - DNA, 12830 bp, Homo sapiens
ttaagtgctgtaaaactcaccatgtgtccagagtttcttccttctggcaggttcatggtcttgctcaattcaggaatgaagctgcagaccttagtgatgtgtccagatttttttccttctggcatgttcatggtcttgcttacttcaagaaataaggaagatgcagaactctacgatgtgtacagagtttcttccttccggcacgttcatgatcttgctcacttcaagaatgaagctgcagaagttagttatgtgtccggagtttcttccgtctggcagattcatcgtcttgctcacttcaagaatggagctgcagaccgtagtgatgtgaccggagtttctttcttctggcagcttcatggtcttgctcacctcaagaatgaagctgcagaccttagtgatgtgtgcagagtttcttccttctggcaggttcatggtcgtgctcacttcaagaatgaagctgcagacctttacgatgtgtccagagtttcttccttctggcaggttcatggtcttgctcacttcaagaatgaagctgcagacctttacgatgtgtccagagtttcttccttctggcaggttcatggtcttgctcacttcaagaatgaagctgcagaccttagtggtgtgtccagagtttcttccttctccaggttcatggtcttgctcacttcaagaatgaagctgcagaccttagtgaagtgtccagagtttcttccttctgacaagttcatggtcttgctcacttcaagaatgaagctgcagacctttacggtgagtgttacagcattaatggtgttatgtacagagtttgttccttcagatgtttccagagtttcttccttctggcaggttcattgtcttgctcacttcaagaatgaagctgcagaccttagtgatgtgtccagagtttcttccttctggcaggttcatcgtgttgctcacttcaagaatgaagctgcagaccttagtgatgtgtccagagtttcttccttctggcaggttcatggtcttgctcacttcaagaatgacgcggcagacctttacgatgtgtccagagtttcctccttctggcaggttcatggtcttgctcacttcaagaatgaagctgcagaccttagtgataagtccagagattcttccttctggcaggtccatggtcttgctcacttcaagaatgaaactgcagacccttacgatgtgtccagagtttcttccttctggcaggttcatggtcttgctcacttcaagaatgaagctgcagaccttagtgatgtgtccagagtttcttccttctggcaggttcatggtcttgctcacttcaagaatgaagatgcagacctttacgataagtccagagtttcttccttctggcaggttcatggtcttgctcacttcaagaatgaagctgcggaccttagtgataagtccagagattcttccttccggcaggtccatggtcttgctcacttcaagaatgaaactgcagacccttacggaatgaagctgcagaccttagcggtgagcgttacagcacttaaaggttttatgtccagagttgttccatcagatgtgtctagagtttcttccttctggcaggttcatggtcttgctctcttcaaggatgaagctgcagacttcagtgatgtgtccaaagtttcttcaatctggcaggttcatcgtcatgctcacttcaagagtgaagctgcagaatttagtgcaagttcatggtcttgctcagttcaagaaagaatgaagctgcagaccttagtggttcatggtcttgctcacttcaagaatgaacctgcagaccttggtcgtgagtgttacagcacttacaggtgttatgttccgagtttgttccatcagatgtgtccagagtttcttccttttggcaggtacatggtcttgctcatttcaagaatgacgctgcagatcttagtgatgtgtgcagagtttcttccttctggcaggttcatggtattgctcacttcaagaatgaagctgcagaccttagtggttcatggtcttgctcacttcaagaatgaacctgcagaccttggtcgtgagtgttacagcacttacaggtgttatgttccgagtttgttccatcagatgtgtccagagtttcttccttttggcaggtacatggtcttgctcatttcaagaatgacgctgcagatcttagtgatgtgtctagagtttcttccttctggcaggttcatggtcttgctcaattcaggaatgaagctgcagaccttagtgatgtgtccaaagtttcttcaatctggcaggttcatggtcttgctcacttcaagaatgaagctgcagacctttagggttcatggtcttgctcacttcaagaatgaagctgcagacctttacgatgtgtccagagtttcttccttctggcaggttcatggtcttgctcacttcaagaatgaagctgcagaccttagtgatgtgtccagagtttcttccttctggcaggttcatggtcttgctcaattcaagattgaagctgcagaccttagtgatgtgtccagagtttcttccttctggcagattcatggtcctggtcacttcaagaatgaaactgcagaccattaccatgtgtccagagtttcgtccttctggcaagttcaaggtcttgctaacttcaagaatgaagctgcagacatttacgctgagtgttacaatgtgtccagaatttcttccttctggcagtttcatggtcttgctcccttcaagaatgaagctgcagacattagtgatgtggccagagtttcttccttctggcaggttcatggtcttgctcacttcaagaatgaagctgccgacctttgcgatgtgtccagagtttcttccttctggcaggttcatgttcttgctcacttcaagaatgaggctgcagacctaggtgatgtgtccagagtttcttccttctggcaggttcatggtcttgctcacttcaaaaatgaaactggagaccattacgatatttccagagtttcttccatctggcaggatcatggtcttggtcacttcaagaatgaagctgcagaccttagtgatgtggccagagtttcttccttctgggaggttcacggtcttgctcacttcaagaatgaagctgcagacctaggtgagtttcttccctctggcaggttcatggtcttgctcacttcaagaatgaagctgcagaccttggtggtgattgttacagcagttaaaggtgtttgtcctgagtttgttccatcggatgtgtatagagtttcttccttctggcaggttgatggtcttgctcacttcaagaatgaagctgcagacctttacgatgtggccagagtttcttccttctggcaggttcatggtcttgctcacttcaagaatgaagctgcagacctaggtgatgtttccagagtttcttccatctggcaggttcatggtcttgctcacttcaagaatgaagctgcagaccttagtgatgtgtccagagtttcttccttctggcaggttcatggtcttgctcacttcaaaaatgaaactgcagacgattacgatatttccagagtttcttccatctggcaggatcatggtcttggtcacttcaagaatgaagctgcagaccttagtgatgtgtccagagtttcttccttctggcaggttcatggtcttgcacacttcaagaatgaagctgcagaactttacgatgtctccggagtttcttccatctggcaggttcatggtcttgctcacttcaagagtgaagctgcagaatttagtgggtcaaggtcttgctcacttcaagaaagaatgaagatgcagacctttacggtgagtgttacagcatataaagttgttatgtacggatttagtccttcagatttgtccagagtttcttccttcgggcatgttcatggtattgctcacttcaaaaataaagctgcagacattggtgttcatggacttgttcacttcaagaacgaagctgcagaccttagtgatgtgtccagatattcttccttctggcaggttcatggtgtagctcatttcaaaaaagaattaagatgcaaacctttacggttcatggtcttgctcacttcaagaaagaatgaagctgcacacctttactgtgagtgttacagcatagaaaggtgttatatcgagagtttggtccttcagatgtgtccagagtttctatcttcgggcaggttcatggtcttgctcaatacaagaatgaagctgcagaccttggtgttgagtgttacaacacttaaaggtgttatgtcccagagtttgttccatgcagatttgcatagagtttcttccttatggcaggttcatggtcttgctcacttcaagaatgaagctgcagaccttagtgagtttctcccttttggcaagttcgtggtcttgctcacctcaagaatgaagctgcaggccttggttcatcgtcttgctcacttcaagaatgaagctgcagaccttagtgatttgtccacagtttcttccttctggcaggttcatggtcttgctctcttcaagaatgaagctgcagaccttggtgatgagtgttgcagcacttacaggcgttatgtcgcgagtttgttccatcagatgtgtccagagtttcttccttttggcaggttcatggtcttgctcacttcaagaatgaagctgcagacctcagtgatgtgtccagaatttcttccttcgggccggttcatggtcttgctcacttcaagaatgaagctgcagaccttggtggttcatggtcttcctcacttcaagaatgaagctgcagaccttagtgatgtgtccagagtttcttcattctggcaggttcatggtcttgttctcttcaagaatgaagctgcagaccttagtgtgttacagcatataacggtgttaagtccagagtttggtccttcagatgtgtccagaattttttcctacgggctggttcaaggtcttgctcacttcaagaatgaagctgcagaccttggtgatgtgtccagagtttcttccttctggcaagttcattgtcttgctcacttcaagaatgaagctgcagatcttggtgactttgttccatctattgtgtatagagtttcttccttctggcagtttcatggcattgctcacttcaagaatgaagctgcagaccttagtgatatatctagagtttcttccttctggcaggttcatggtcttgctcaattcaagaatgaaactgcagaccttccggttcatggtcttgctcacttcaagaatgaagctgcagaccttggtgatgtgtccagagattctttcttctggctggttcatggacttgctcacttccagaatgaagttccagaccttattgatgtgtccagagtttcttccttctggcaggctcatggtcttgctcacttcaagaatgaagctgcagaccttagtgatgtgtccagagtttcttccatctggcaggttcatggtcttgctcatttcaagaatgaagctgcagaccttagtgatgtgtccagagtttcctccttctggcaggttcatggtcttgctcacttcaagaatgaagctgcagaccttagtgatattcttccttctggcaggttcatggtgttgctcacttcaacaatgaatgaagctgcagacctttacgaatttcttccttctggcaggttcatggtcttgctcacttcaagaatgaagctgcagacctttagggttcatcgtcttcctcacttcaagaatgaagctgtagacctttacgatgtgtccagagtttcttccttctggcaggttcatggtcttgctcccttcaagaatgaagctgcagaccttagtgatgtgtccagattttcttctatctggcaggttcatggtcttgctcacttcaagagtgaagctgcagaattcagcgaaagaatgaagctgcagacctttaagatgtgtccaaaatttctaccttctggcaggttcatggccttgctgacttcaaagaatgatgctgcagaccttagtggtgaggttcatggcattgctgacttcaagaatctcgctgcagacctgtccgatgtgtccagaatttcttcattctggctggttcatggtcttgttctcttcaagaatgaagctgcagaccttattgatatgtccagagtttcttccttctggcaggttcatggtcttgctcaattcaagaatgaagctgccgaccttagtggtgagtgttacagcactttaaggtgttatgtccagagtttgttccttcagatgtgtccagagtttcttcctactggcacgttcatggtcttgctcacttcaagaaagaagctgcagaccttagtgatgtgtgaagagtttcttccttctggaaggttcatggtcttgctcacttcaagaatgaagctgcagaccttagtggttcatggtcttgctcacttgaagaatgaagctgcagaccttggtgttgagtgttacagcattttaaggtgttatgtgcagagtttgttccatcagatgtgtatagagtttcttccttctggcaggttcatggtcttgctcacttcaagagtgaagctgcagaatttagtgatgtgtccagaagttcttccttcgggcagggtcatggtcttactcacttcaagaatgaacctgcagaccttgatgatgtgtccagtttcttccttctggcaggttcatggtcttactcacttcaagaaggaatctgtagacctttacgatgtgtccagagtttcttcctactggcaggttcatggacttgctcacttcaagaatgaagctgcagaccttagtgatgtgtccagagtttcttccttctggcagtttcatggtcttgctcaattcaagaatgaagctgcagactttagtgatgtgtccagaatttcttcattctggcaggttcatggtcttgttctcttcaagaatgaagctgcagacattagtgatgtgtccagagtttctttcttctggcaggttcaaggtctttctcacttcaataatgaagctccagtcctttacgatgtgtccagagtttcttccttctggcaggttcatggtcttcctcacttcaagaatgaagctgcagaacttagtgatgtgtccagagtttcttccttctggcaggttcatggtcttgctcactttaagaatgaagctgcagaccttagtgatgtgtccagagtttcttccctctggcaggttcatggtcttgctcacttcaagaatgaagatgcagacctttacggttcatggtttgctcacttcaagaatgaagctgcagaccttagtgataagtccagagtttcttccttctggcaggttcatggtcttgctcacttcaagaatgaagctgcggaccttagtgatgtgtccagagtttcctccttctggcaggttcatggtcttgctcacttcaagaatgaagctgcagaccttagtgatgtgtccagagtttcttccttctggcaggttcatggtcttgctcacttcaagaatgaagctgcagaccttagtgatgtgtccagagtttcttccttctggcaggttcatggtcttgctcacttcaagaatgaagatgcagacctttacgatgtgtccagagtttcttccttctccaggttcatggtcttgctcacttcacgaatgaagctgcagaccttagtggtgagcgttacagcagttaagtttttatgtccagagtttgttccttcagataagtccagagtttcttccttctggcgggttcatggtcttgctcacttcaagaatgaagctgcggaccttagtgataagtccagagattcttccttctggcaggttcatggtcttgctcacttcaagaatgaagctgcagacctttacgatgtgtccagagtttcttccctctggctggttcttggtcttgctcacttcaagaatgaagctgcagacctttacgatgtgtccagagtttcttccttctggcaggttcatggtcttgctcacttcaagaatgaagctgcagaccttagtgatgtgtccagagtttcttccttctggcaggttcatggtctagctcaattcaagaatgaaactgcagacctttacgatgtgtccagagtttcttccttctccaggttcatggtcttgctcacttcaagaatgaagctgcagaccttagtgataagtccagagtttcttccttgtggcaggttcatggtcttgctcacttcaagaatgaagctgcagaccttagtgatgtgtccagagtttcttccttctggcatgttcatggtcttggtcacttcaagaaagaatgaagctgcagaacattacgatatgtccagagtttcttccttctggcaggttcatggtcttgcgcacttcaagaatgaagctgcagacctaggtgctgcagacctttacgctgagtgtcacagcaatttaaggtgttatgtccagagtttgttcattcagatgtgtccagaatttcttccttctggcaggttcatggtcttgctcacttcaagaatgaagctgcagaccttggtgttgagtgttacagcagttaaaggtgtttgtcctgagtttgttccatcagatgtgtccaaagtttcttccttctggcaggttgatggtcttgcttacttcaagaatgaagctgcagacctttacgatgtgtccagagtttcttccttcaggcaggttcatggtcttgctcatttcaagaatgaagctgcagacctaggtgatgtgtccagagtttcttccaactggcaggttcatggtcttgctcacttcaagaatgatgttgcagacctttacggtcgtggtcttgctcacttccttaatgaagctgcagacctttacatgtgtccagagtttcttccttctgacaggtttgtcgtcttgctcacttcaagaatgaagctgcacaccttagtggtgagcgttacagcacttaagtttttaagtccagagtttgttccttcagatgtgtccagggtttcttccttctggcaggttcatggtcttgctgacctcaagaatgaagctgcagacctttacgatgtgtccagagtttcttcattctggcagtttcatggtcttgctcacttcaagaatgaagctgcagaacgtagtgatgtgtccagagtttcttccttctcgccggttcatgctcttgctcacttcaagaatgaagctgcagaccttagtgatgtgtccagagtttcttccttctggcaggttcatggtcttgctcacttccagaatgaagctgcagacctttacgatgtgtgcagagtttcttccttctggcaggttcatggtcttgctcacttcaagaatgaagctgcagaccttagtgatgtgtccagggtttctgtcttctggcaggttcatggtcttgctcacttcaagaatgaagctgcagaccttagtgatgtgtccagagtttcttccttctggcaggttcatggtcttgctcacttcaagaatgaagctgcagaccttagtgatattcttccttctggcaggttcatggtgttcctcacttcaacaatgaatgaaactgcagacctttacgatgtgtccagagtttctttcttctggcaggttcatggatttgctcacttcaagaatgaagctccagagctttatgatgtgtccagagtttcttccttctggcaggttcatggtcttgctcaattcaggaatgaagctgcagaccttagtgatgtgtccaaagtttcttcaatctggcaggttcatggtcttgctcacttcaagaatgaaactgcagaccttagtgatgtgtccagagtttcttccttctggcaggttcatggtcttgctcacttcaagaatgaagctgcagacctttacgatatgtacagagtttcttccttctggcaggttcattgtctttctcacttcaagaatgaagctgcagacctttacggtgagtgttacagccctgaaaggtgttatgtccagagtttgttccttcagatgtgtccagagtttattcggtctggcaggttcattgtcttgctcacttcaagaatgaagctgcagaacttaacgatgtgtccagagtttcttccttcgggctggttcatggtcttgctcacttcaagaatgaagctgcagaccttggtggttcatggtcttgctcacttcaagaatgaagctgcagaccttagtgatatgtccagagtttcttcattctggcaggttcatggtcttgttctcttcaagaatgaagctgcagaccttagcgatgtgtccagagtttcttccttctggcaggttcatggtcttgctcacttcaagaatgaagctgcagaccttagtgatgtgtccagagtttcttccttctggcaggttcatggtcttgctgaccacaagaatgaatctgcagacctttacggtgtgtccagaatttctaccttctggcaggtttatggtcttgctcacttcaagaatgaagctgcagaccatcacgagattgttccttcatatgtgtccagactttcttccttctggcagtttcacggtcttgcttacttcaagaatgaaactgcagaccattacggtgagcgttacagcactgaaagatgttatgtccagagtttgttccttcagatgtgtccagagtttcttcctactggcaggttcatggtcttgctcacttcaagaatgaagctgcagatattagtgatgggtccagagtttcttccttctagcaggttcatggtctttctaccttcaagagtgaagctgcagacctttaagatgtgtccagagtttcttccttctggcaagttcaaggtcttgctaacttcaagaatgaagctgcagacctttacggtgagtgttacagttcatggtcctgctcacttcaacaatgtagctgcagacctttacgatgtgtccagagtttcttccttctggcaggttcatggtcttgctcacttcaagaatgaagctgcagaccttagtgatgtgtctagagtttcttccttcaggcaggttcatggtcttgctcacttcaagaatgaagctgcagacctaggtgatgtgtccggagtttcttccatctggcaggttcatggtcttgctcacttcaagagtgaagctgcagaatttagtgatgtgtatagagtttcttgcgactggcaggttcatggtcttgctcacttcaagaatgaagctgcagacctaggtgatgtggccagagtttcttccttctgtcaggttcatggtcttactcccttcaagaatgaagctgcagacctaggtgatgtgtccaaagtttcttcaatctggcaggttcatggtctttctcacttcaagagtgaagctgcagaatttagtgatgtgtccagagtttctttcttctggcagtttcatggtcttgctcacttcaagaatgaagctccagacctttacgatgtgtccacagtttattccttctggcaggttcatggtcttgctcacttcaagaatgaaactgcagacctttacggaatgaagctgcagaccttagcgatgtgtccagatattcttccttctagcaagttcatggtcttgctcagttcaagaaagaatgaagctgcagaccttagtgatgtgtctagagtttcttccttctggcaggttcatggtcttgctcacttcaaggatgctgctgcagaccttagtgatgtgtccaaaatttcttcaatctggcgggttcatggtcttgctcacttcaagagtgaagctgcagaatttactggtgagtgttacagcactaaaaggtgtcatgtccagagttttttacttcagttgtgtccagatattcttccttctggcaggttcatggtcttgctcacttcaagaaagaatgaagctgcagacctttacgatgtgtccaaattttcttcaatctggcaggttcatggtcttgctcacttcaagagtgaagctgcagaatttagtgatgtgtccagagtttcttccttctggcaggttcatggtattgctcatttcaagaatgaagctgcagaccttagtgatgtgtccagagtttcttccttctggcaggttcttggtcttgctcacttcaagaatgaagctgcagacctttacgatgtgtccagagtgtcttctttctggcaggttcatggtcttgctcacttcaagaatgaagctgcagaccgtagtgatgtgtccagagtttcttccttctggcaggttcatggtcttgctcacctcaagaatgacgcggcagacctttacgtttcttccttctggcaggttcatggtcttgcccccttcaagaatgaatctgtagacctttacggtgagtgttacagcaatgaaagatgttatgtccagagtttgttccttcagatgtgtccagtgtttcttccttctggcaggttcatggtcttgctcacttcaagaatgaagctgcagacctttacgttacggcacttaaaggtgttatgtccagagtttgttcctacagatgtatccagagtttcttccttctggcaggttcttggtcttgctcacctcaagaatgaagctgcagacctttacgatgtgtccagagtttcttccttctggcaagttcattgtcttgctcacttcaagaatgaagctgcagatcttggtgatgtgtccaaagtttcttcaatctggcaggttcatggtcttgctcacttcaagaatgaagctgcagaccttagtgatgtgtctagagtttcttccttctggcatgttcatggtcctgctcacgtcaagtaagaatgaagctgcagaccttattg

SEQ ID NO: 480186 - DNA, 2942 bp, Homo sapiens
ttaagtccagagtttggtccttcagatgtgtccagaatttcttccttcgggccggttcatggtcttgctcacttcaagaatgaagctgcagaccttggtggttcatggtcttgttctcttcaagaatgaagctgcagaccttagtgatgtgtccagaattttttcctacgggctggttcaaggtcttgctcacttcaagaatgaagctgcagaccttggtgatgtgtccagagtttcttccttctggcaagttcattgtcttgctcacttcaagaatgaagctgcagatcttggtgatgtgtccagagtttcttccttctggcaggttcatggtcttgctcaattcaagaatgaagctgcagaccttagtgatgtgtccagaatttcttctttcgggcaggttcatggtcttgctcacttcaagaatgaagctgcagaccttggtgatgtgtccagaatttcttcattctggctggttcatggtcttgttctcttcaagaatgaagctgcagaccttattgatgtgtccaaagtttcttcaatctggcaggttcatggtcttgcacacttcaagagtgaaggtgcagaatttagtgatgtgtccagagtttcttccttcttgcatgttcgtggtcttgctcacttccttaatgaagctgcagaccttaccgatgtgtccagagtgtcttccttctggcaggttcgtggtcttgctcacttcactaatgaagctgcagaccttactgatgtgtccagcgtttcttccttctggcaggttcatggtcttcctcacttcaagaatgaagctgcagaccttactggtccagagtttgtttcttcagatgtgtccagggtttctgtcttctggcagtttcgtggtcttcctcacttcaagaatgaagctgcagaccttactgatgtgtccagagtgtcttccttctggcaggttcatggtcttgctcacttcactaatgaagctgcagaccttactgatgtgtccagcgtttcttccttctggcaggttcatggtcttcctcacttcaagaatgaagctgcagaccttactgatgtgtccagggtttctgtcttctggcagtttcgtggtcttcctcacttcaagaatgaagctgcagaccttactgatgtgtccagagtgtcttccttctggcaggttcatggtcttactcacttcaagaatgaagctgcagaccttactgatgtgtccagagtttcttccttctggcaggttcgtggtcttgctcacttccttaatgaagctgcagaccttactgatgtgtccagtgtttcttccttctggcaggttcatggtgttgctcacttcaagaatgaagctgcagaccttactgatgtgtccagagtttcttccttcttgcaggttcgtggtcttgctcacttccttaatgaagctgtagaccttaatgatgtgtccagagtttcttccttcttgcaggttcgtggtctggctcacttccttaatgaagctgcagaccttaccgatgtgtccagggtttctgtcttctggcaggttcatggtcttgctcacttcactaatgaagctgcagaccttactgatgtgtccagagttttttccttctggcaggttcgtggtcttgctcacttccttaatgaagctgcagaccttactgatgtgtccagagtttcttcattcttgcaggttcgtggtcttgctcacttccttaatgaagctgcagaccttaatgatgtgtccagagtttcttccttcttgcaggttcgtggtctggctcacttccttaatgaagctgcagaccttaatgatgtgtccagagtttcttccttcttgcaggttcgtggtcttgctcacttccttaatgaagctgcagaccttactgatgtgtccagagttacttccttctggcaggttcatggtgttgctcacttcaagaatcaagctgcagaccttactgatgtgtccagagtgtcttccttctggcaggttcatggtcttgctcacttcactaatgaagctgcagaccttacagatgtgtccagagtttcttccttctggcagtttcgtggtcttcctcacttcaagaatgaagctgcagaccttactgatgtgtccagagttgcttccttctggcaggttcgtggtcttgctcacttccttaatgaagctgcagaccttactgatgtttccagagtttcttccttcttgcaggttcgtggtcttgctcacttccttaatgaagctgcagaccttaatgatgtttccagagtttcttccttctggcaggttcgtggtcttgctcacatctttaatgaagctgcagaccttactgatgtgtccagagtttcttccttctggcagtttcgtggtcttcctcacttcaagaacgaagctgcagaccttactgatgtgtccagagtttcttccttctggcatgttcatggtcttgctcacttcaagaatgaagctgcagaccttactgatgtgtccagagtttcttccttctggcagtttcgtggtcttcctcacttcaagaatgaagctgcagaccttagtgatgtttccagagtttcttccttcttgcaggttcgtggtcttgctcacttccttaatgaagctgcagaccttaatgatgtgtccagtgtttcttccttctggcaggttcatggtcttgctcacttcaagaatgaagctgcagaccttactgatgtgtccagagtttcttccttctggcagtttcgtggtcttcctcacttcaagaacgaagctgcagaccttactgatgtgtccagcgtttcttcctactggcaggttcatggtcttgctcacttcaagaatgaagctgcagaccttactattcagtgttaaagcacttaaaggtgttatatccagagttagatccttcagatgtgtccagagtttcttccttctc

SEQ ID NO: 480187 - DNA, 12834 bp, Homo sapiens
gaagctgcagacctttacggttcattgtcttgctcacttcaagaatgaagctgcagaccttgctggtgagtgttacagcagttaaagtgttatgtccattgtttcttccatcagatgtgtatagagtttcttccttctggcaggttcatggtcttgctcacttccagaatgaagctgcagacctttacgatgtgtccagagtttcttccttctggcaggttcatggtcttgctcagttcaagaatgaagctgcagacctttacgatgtgtccagagtttcttccttctggcaggttcatggtcttgctcacttcaagaatgaagctgcagaacttagtgatgtgtccagagtttcttccttctggcaggttcgtggtcttgctcacttcaagaatgacgcggcagacctttacgatgtgtccagagtttcctccttctggcaggttcatggtcttgctcacttcaagaatgaagctgcagaccttagtgatgtgtccagagtttcttccttctggcaggttcatggtcttgctcacttcaagagtgaagctgcagaccttagtgatgtgtccagagtttcttccttctggcaggttcatggtcttgctcacttcaagaatgaagatgcagacctttacgatgtgtccagagtttcttccttctccaggttcatggtcttgctcacttcaagaatgaagctgcagaccttggtggttcatggtcttgctcacttcaagaatgaagctgcagaccttagtgataagtccagagtttcttccttctggcaggttcatggtcttgctcacttcaagaatgaagctgcagaccttagtgataagtccagactttcttccttctggcaggttcatggtcttgctcacttcaagaatgaagctgcagacctttacgatgtgtacagagtttcttccctctggctggttcttggtcttgctcacttcaagaatgaagctgcagacctttacgatgtgtccagagtttcttccttctggcaggttcatggtgttgctcacttcaagaatgaagctgcagaccttagtgataagtccagagtttcttccttgtggcaggttcatggtcttgctcacttcaagaatgaagctgcagaccttagtgatgtgtccagagtttcttccttctggcaggctcatggtcttgctcacttcaagaaagaagctgcagaacttagtgatgtgtccagagtttcttccttctggcaggttcatggtcttgctcacttcaagaatgaagctgcagaccttagtgatgtgtccagagtttcttccttctggcaggttcatggtcttgctcacttcaagaatgaagatgcagacctttacgatgtgtccagagtttcttccttctccaggttcatggtcttgctcacttcaagaatgaagctgcagaccttagtggtgagcgttacagcagttaagtttttatgtccagagtttgttccttcagataagtccagagtttcttccttctggcaggttcatggtcttgctcacttcaagaatgaagctgcggaccttagtgataagtccagactttcttccttctggcaggttcacggtcttgctcacttcaagaatgaagctgcagacctttacgataagtccagactttcttccttctggcaggttcatggtcttgctcacttcaagaatgaagctgcagacctttacgatgtgtacagactttcttccctctggctggttcttggtcttgctcacttcaagaatgaagctgcagacctttacgatgtgtccagagtttcttccttctggcaggttcatggtcttgctcacttcaagaatgaagctgcagaacttagtgataagtccagagattcttccttctggcaggttcatggtcttgctcacttcaagaatgaaactgcagacccttacgatgtgtccagagtttcttccttctggcaggttcatggtattgctcatttcaagaatgaagctgcagaccttagtgatgtgtccagagtttcttccttctggcaggttcttggtcttgctcacttcaagaatgaagctgcagacctttacgatgtgtccagagtgtcttctttctggcaggttcatggtcttgctcacttcaagaatgaagctgcagaccgtagtgatgtgtccagagtttcttccttctggcaggttcatggtcttgctcacctcaagaatgacgcggcagacctttacgtttcttccttctggcaggttcatggtcttgcccccttcaagaatgaatctgtagacctttacggtgagtgttacagcaatgaaagatgttatgtccagagtttgttccttcagatgtgtccagtgtttcttccttctggcaggttcatggtcttgctcacttcaagaatgaagctgcagacctttacgttacggcacttaaaggtgttatgtccagagtttgttcctacagatgtatccagagtttcttccttctggcaggttcttggtcttgctcacctcaagaatgaagctgcagacctttacgatatatctagagtttcttccttctggcaggttcatggtcttgctcaattcaagaatgaaactgcagacccttccgatgtgtgcagagtttcttccttctggcaggttcttggtcttgctcacttcaagaatgaagctacagacctttacggtcgtggtcttgctcacttccttaatgaagctgcagacctttacatgtgtccagagtttcttccttctgacaggtttgtcgtcttgctcacttcaagaatgaagctgcacaccttagtggtgagcgttacagcacttaagtttttaagtccagagtttgttccttcagatgtgtccagggtttcttccttctggcaggttcatggtcttgctgacctcaagaatgaagctgcagacctttacgatgtgtccagagtttcttcattctggcagtttcatggtcttgctcacttcaagaatgaagctgcagaacgtagtgatgtgtccagagtttcttccttctcgccggttcatgctcttgctcacttcaagaatgaagctgcagaccttagtgatgtgtccagagtttcttccttctggcaggttcatggtcttgctcacttccagaatgaagctgcagacctttacgatgtgtgcagagtttcttccttctggcaggttcatggtcttgctcacttcaagaatgaagctgcagaccttagtgatatgtttagagtttcttccttctggcaggttcatggtcctgctcacttcaaaaatgaagctgcagacctttacgatgtgtgcagagtttcttccttctggcagtaccatggtattgctcacctcaagaatgaagctgcagaacttagtgatgtgtccagagtttcttccttctggcaggttcatgggcttgctcacttcaagaatgaagctgcagacctttacgatgtgtccagagtttcttccttctggcagtttcatggtcttgctcacttcaagaatgacgcagcagacctttacgatgtgtgcagagtttcttccttccggcaggttcatggtattgctcacttcaagaatgaagctgcagaccttagtgatgtgtgcagagtttcttccttccggcaggctcatggtattgctcacttcaagaatgaagctgcagaccttagtgatgtgtgcagagttttttccttccggcaggttcatggtatttctcacttcaagaatgaagctgcggaccttagtgatgtgtcaagagtttcttctttctggcaggatcatggtcttgctcacttcaagaatgaagctgcagaccttagtgatgtgtccagagtttcttccttctggcaggttcatggtcttgctcacctcaagaatgaagctgcagacctttacgatgtgtccagagtttcttccttctggctggttcatggtcttgctcacctcaagaatgaagctgcagacatttacgatgtgtccagagtttctcccttctggcaagttcatggtcttgctcacttcaagagtgaagctgcagacatttacgatgtgtccagagcttcttccctctggcaggttcttggtcttgctcacttcaagagtgaagctgcagacctttacgatatgtttagagtttcttccttctggcaggttcatggtcgtgctcacttcaaaaatgaagctgcagacctttacgatgtgtgcagagtttcttccttctggcagtaccatggtattgctcacctcaagaatgaagctgcagaacttagtgatgtgtccagcatttcttccttctggcaggttcatggtcttgctcccctcaagaatgaaaatgcagacctttacgatgtgtccagagtttcttccttctggcaggttcatggtcttgctcacctcaagaatgaagctgcagacctttacgatgtgtccaaagtttcttccttctggctggttcatggtcttgctcacctcaagaatgaagctgcagacctttacgatgtgtccagagtttcttccttctggcaagttcatggtcttgctcacttcaagaatgaagctgcagacatttacgatgtgtccagagtttcttccctctggcaggttcttggtcttgctcacttcaagaatgaagctgcagacatttacgatatgtttagagtttcttccttctggcaggttcatggtcctgctcacttcaaaaatgaagctgcagacctttacgatgtgtccagagtttcttccttctggctggttcatggtcttgctcacctcaagaatgaagctgcagacatttacgatgtttccagagtttcttccctctggcaggttcttggtcttgctcacttcaagaatgaagctgcagacctttacgatgtgtgcagagtttcttccttctggcaggttcatggtgttgctcacttcaagaatgaagctgcagaccttagtgatgtgtccagagtttcttccttctggcaggttcttggtcttgctcacttcaagaatgaagctgcagacctttacgatctgtccagagattcttccttctggcaggttcattgtcttgctcacttcaagaatgaagctgcagaccttagtgatgtgtccagagtttcttctttctggcaggttcatcgtcttgctcacttcaagaatgaagctgcagaacttagtgatgtgtccagagtttcttccttctggcaggttcatggtcttgctcacttcaagaatgaagctgcagaccttagtgatgtgtccagagtttcttccttctggcagtttcatggtcttgctcacttcaagaatgaagctgcagacctttacgatgtttgcagagtttcttccttctggcaggttcttggtcttgctcacttcaagaatgaagctgcagacctttacgatgtgtccagactttcttccttctggcagtttcgtggtcttcctcacttcaagaatgaagctgcagaccttagtgatgtgtccagagtttcttccttctggcagtttcgtggtcttcctcacttcaagaatgaagctgcagaacttactgatgtgtccagggtttctgttttctggcaggttcatggtctccctcacttcaagaatgaagctgccgaccttagtgatgtgtccagcgtttcttccttctggcaggttcatggtcttcctcacttcaagaatgaagctgcagaccttactgatgtttccagagtttcttccttctggcaggttcgtggtcttgctcacttctttaatgcagctgcagaccttactgaggtgtccagagtttcttccttctggcagtttcgtggtcttcctcacttcaagaatgaagctgcagaccttactgatgtgtccagagttttttccttctggcaggttcgtggtcttgctcacttccttaatgaagctgcagaccttactgatgtgtccagagtttcttccttcttgcagatgtgtcctgagtgtcttccttctggcaggttcatggtcttgctcacttcactaatgaagctgcagaccttactggttcgtggtcttgctcacttccttaatgaagctgcagaccttactgagtttgatccttcagatatttccagagtttcttccttctggcaggttcgtgttcttgctcacttctttaatgaagctgcagaccttactgatgtgtccagagtttcttccttctggcagtttcgtggtcttcctcacttcaagaatgaagctgcagaccttagtgttgagtgttacagcacagtttcttccttctggcaggttcgtggtcttgctcacttctttaatgaagctgcagaccttactgatgtgtccagggtttctgtcttctggcaggttcatggtcttcctcacttcaagaatgaagctgccgaccttagtgatgtttccagagtttcttccttctggcaggttcgtggtcttgctcacatctttaatgaagctgcagaccttactgatgtgtccagagtttcttccttcttgcagtttcgtggtcttcctcacttcaagaatgaagctgcagaccttactggtgagtgttacagcactttaaggtgttatgtccagagtttgttccttcagttgtgtccagagtgtcttccttctggcaggttcatggtcttgctcacttcaagaatgaagctgcagaccttactgatgtgtccagagtttcttccttcttgcaggttcgtggtcttgctcacttccttaatgaagctgcagaccttactggttcgtggtcttgctcacttccttaatgaagctgcagaccttactgatgtgtccagagtttcttccttcttgcaggttcgtggtcttgctcacttccttaatgaagctgcagaccttaatgatgtgtccagagtttcttccttctggcatgttcatggtgttgctcacttcaagaatgaagctgcagactttagtgttgagtgttacagcacttataggtgttatgtccagtgtttgttccttcagatgtgcccagagtttcttccttcttgcaggttcgtgttcttgctcacttccttaatgaagctgcagaccttactggttcgtgttcttgctcacttctttaatgaagctgcagaacttactgatgtgtccagagtttcttccttctggcagtttcgtggtcttcctcacttcaagaatgaagctgcagaccttagtgatgtttccagagtttcttccttctggcaggttcgtggtcttgctcacttctttaatgaagctgcagaccttactgatgtttccagagtttcttccttctggcaggttcgtggtcttgctcacatctttaatgaagctgcagaccttactgatgtgtccagagtttcttccttctggcagtttcgtggtcttcctcacttcaagaatgaagccgcagaccttagtgttgagtgttacagcacagtgtcttccttctggcaggttcatggtcttgctcacttcaagaatgaagctgcagaccttactgatgtgtccagaatttcttccttccggcagtttcgtggtcttcctcacttcaagaatgaagctgcagaccttagtgttgagtgtgtgtccagggtttctgtcttctggcaggttcatcgtcttgctcacttcaagaatgaagctgccgacctttgtgatgtgtccagagtttcttccttcttggaggttcgtggtcttgttcacttccttaatgaagctgcagaccttaccgatgtgtccagagtgtcttccttctggcagcttcatggtcttgctcacttcactaatgaagctgcagaccttactgatgtgtccagggtttctgtcttctggcaggttcatgttatggctcacttcaagaatgaagctgcagaccttagtgatgtgtccagaggttcttccttctggcaggttcatggtgttgctcacttcaagaatgaagctgcagaccttagtgatgattccagagtttcttccttcttgcaggttcgtggtcttgctcacttccttaatgaagctgcagaccttactgatgtgtccagagtttcttctttctggcagtttcgtggtcttcctcacttcaagaatgaagctgcagaccttactgatgtgtccagggtttctatcttctggcaggttcatggtgttgctcacttcaagaatgaatctgccgaccttagtgatatgtccagcgtttcttccttctggcaggttcatggtcttgctcatttcaagaatgaagctgcagacttttacgatgtgtccagagtttctttcttctggcaggttcatggtgttgctcacttcaagaatgaagctgcagaccttactgatgtgtccagagattcttccttctggcagtttcctggtcttcctcacttcaagaatgaagctgccgaccttagtgatgtttccagagtttcttccttctggcaggttcgtggtcttgctcacatctttaatgaagctgcagaccttactgatgtgtccagagtttcttccttcttgcagtttcgtggtcttcctcacttcaagaatgaagctgcagaccttactgatgtttgcagagtttcttccttctggcaggttcttggtcttgctcacttcaagaatgaagctgcagacctttacgatctgtccagagattcttctttctggcaggttcattgtcttgctcacttcaagaatgaagctgcagaccttagtgatgtgtccagagtttcttccttctggctggttcatggtcttgctcacttcaagaatgaagctgcagacctttacgatacgtccagagtttcttccttctggcaggttcatggtcttgctcacttcaagaatgaagctgcagacctttacgatgtgtccagagtttcttccttctggcaggttcatggtcttgctcacttcaagaatgaagctgcataccttagtgatgtgtctagagttccttccttctgggaggttcatggatttgctcatttcaagaatgaagctgcagaccttagtggtgagttttacagcaacgtaaaggtgttatgtccagagtttgttccttcagatgtgtccagagtttcttccttctggcaggttcatggtcttggtcacttcaagaatgaagctgcagaacttagtgatgtgtccagagtttcttccttctggcaggttcattgtcttgctcacttcaagaatgaagctgcggaccttagtgatgtgtccagagtttcttccttctggcaggttcatggtcttgctcacttcaagaaagaagctgcagaacttagtgatgtgtctagagttccttacttctgggaggttcatggacttgttcatttcaagaatgaagctgcagaccgtagtgataagtccagagtttcttccttctggcaggttcatggtcttgctcacttcaagaatgaagctgcggaccttagtgatgtgtccagagtttcttccttctggcaggttcatcgtcttgctcacttcaagaatgaagctgcagacctttacgatgtgtccagagtttcttccttcttgcaggttcatggtcttgttcacttcaagaatgaagctgcagacctttacgatgtgtgcagagtttcttctttctggcaggatcatggtcttgctcacttcaagaatgaagctgcagaccttagtgatgtgtccagagtttcttccttctggcaggttcatggtcttgctcacttcaagaatgaagctgcagacctttacgtttcttccttctggaaggttcatggtcttgctcacttcaagaatgaaactatagacttttacggtgagtgttacagcactgaaagattttatgtccagagtttgttccttcagatgtgtccagagtttcttccttctggcaggttcatggtcttgctcacttcaagaatgaagctgcagaccttttcgatgtgtccagagtttcttcctgctggcaggttcatggtcttgctcacttcaagaatgaagctgcagaccttagtgttgagcgttacagcagttaagtttttatgtccagagtttgttcctgcagataagtccggagttacttccttctggcaggttcatggtcttgctcacttcaagaatgaagctgcagacctttacgatgtgtccagactttcttccttctggcaggttcatggtcttgctcacttccagaatgaagctgcagacgttagtgatatgtccagagtttcttccttctggcaggttcatggtattacacacttcaagaatgaagctgcagacctttacgatgtgtccagagattcctccttctggcatgttcatggtcttgctcacttccttaatgaagctgcagaccttactgatgtgtccagagtttcttccttcttgcagtttcgtggtcttgctcacttccttaatgaagctgcaggctttactgatgtgtccagagtttcttccttctggcaggttcatggacttcctcatttcaagaatgaagctgcagaccttactgagtttgttccttcagataagtccagagtctcttccttctggcagattcatggtcttgctcacttcaagaatgaagctgcggaccttagtgaagtgtccacagtttcttccttctggcaggttcatggtcttgctcacttcaagaatgacgcagcagacctttacgatgtttccagggtttcttccttctttcaggttcatggtcttgctcacttcaagaatgaagctgcagacctttacggtccagaagttgttccttcagatgtgtccagagtttcttacttctggcaggttcatggtcttgctcacttcaaaaatgaagctgcagacctcagtgatgtgtcccgagtttcttccttctggcagattcatggtcttggtagcttcaacaatgaagctgcagacctttacgatgtgtccagagtttcttccttctggcaggttcatggtcttcctcacttcaacaatgaagctgcagaccttagtgatgtctccagagtttcttccttctggcaggttcgtggtcttgttcacttcaagaatgatgctgcagaccttagtggtgagtgttacagcactaaaaggtgttatgtccagagtttgttcctgcagaaatatccagagtttcttccttctggcaggtttatggtcttgctcactttaagaatgaagctgcagaccttactggttcatggtcttgctcacttcaagaatgaagctgcagaccttagtgatgtctccagagtttcttccttctggcaggttcgtggtcttgctcacttcaagaatgaagctgcagaccttaccgagtttgttccttcagatatgtccagagtttcttccttctggcaggttcatggtcttgctcacttcaagaatgaagctgcagacctttgcgatgtgtccagagtttcttccttctggcaggttcatggtcttcctcacttcaacaatgaagctgcagaccttagtgatgtgtccagagtttctttcttctggcaggttcatggtcttgctcacttcaagaatgacgcagcagacctttacgatgtgtccagagtttcttccatctggcaggttcatgtccttgctcacttcaagaatgaagctgcagaacttagtgatgtgtccagagtttcttccttctggcaggttcatggtcttcctcacttcaacaatgaagctgcagaccttagtgatatctccagagtttcttccttctggcaggttcgtggtcttgttcatttcaagaatggtgctgcagaccttagtgatgtgtccagagtttcttccttctggcaggttcatggtcttgctcacttcaagaatgaagctgcagaccttagtgatgtctccagagtttcttccttctggcaggttcgtggtcttgctcacttcaagaatgaagctgcagaccttaccgatgtgtccagagtttcttccttctggcaggttcgtggtcttcctcacttccttaatgaagctgcagaccatactgatatgtccagagtttcttccttctggcaggttcatggtcttgctcacttcaagaatgaacctgcagacctttgcgatgtgtccagagtttcttccttctggcaggtacatggtcttgctcacttcaagaatgaagctgcagacctttacgatgtttccagagtttcttccttctggcaggttcatgatcttgctcacttcaagaatgaagctgcagaactttgtgatgtgtccagagtttcttccttctggcaggttcgtggtctttctcacttccttaatgaagctgcagaccatactgagtttgttacttcagatatgtccagagtttcttccttctggcaggttcatggtcttgctcacttcaagaacgaagctgcagacctttgcgatgtgtccagagtttcttccttcttgcagattcatggtgttgctcacttcaagaatgaagctgcagaccttagtgatgagtgttacagcacgttaaggtgttatgtccagagttttttccttcagatgtgtccagcgtttcttccttctggcaggttcatcgtcttgctcacttcaagaatgaagctgcagaccttactgttgagtgttaaagcacttaaagctgttcgtggtcttgctcaattccttaatgaagctgcagaccttcctgatgtctccagagtttcttccttctggcaggttcgtggtcttgttcacttcaagaatgatgctgcagaccttagtgatatgtcaagagtttcttccttctggcaggttcgtggtcttgctcacttctttaatgaagctgcagaccttactggtgagtgttatagcacttaaaggtgttatgtcc

SEQ ID NO: 480188 - DNA, 1612 bp, Homo sapiens
tccttcagatgtgtccagactttcttccttctggcaggttcatcgtgttgctcacttcaacaatgaagctgcagaccttagtgttgagtgttacagcacttaaagctgttatgtccagagtttgttccttcagaagtgtccagaatgtcttccttcttgcagatgtgtccagtgttccttccttctggcaggttcatggtcttgctcacttcaagaatgaagctgcagaccttaccgatgtgtccggcgtttcttccttctggcaggttcatcgtcttgctcacttcaagaatgaagctgcagaccttacctatgtctccagagtttcttccttctggaaggttcgtggtcttgttcacttcaagaatgatgctgcagaccttagtgaaatatccagagtttcttccttctggcaggtttatggtcttgctcactttaagaatgaagctgcagaccttactgatgtgtccagagtttcttccttctggcaggttcgtggtcttcctcacttccttaatgaagctgcagaccatactgatgtttccagagtttcttccttctggcaggttcgtggtcttgctcacatctttaatgaagctgcagaccttactgatgtgtccagagtttcttccttcttgcagtttcgtggtcttcctcacttcaagaatgaagctgcagaccttactgatgtgtccagagtttcttccttcttgcaggttcgtggtcttgctcacttccttaatgaagctgcagaccttactgatgtgtccagtgtttcttccttctggcaggttcatggtcttgctcacttcaagaatgaagctgcagaccttactgatgtgtccagagtttcttccttctggcagtttcgtggtcttcctcacttcaagaacgaagctgcagaccttactgatgtgtccagaatttcttcattcttggaggttcgtggtcttgctcacttccttaatgaagctgcagaccttaccgatgtgtccagagtgtcttccttctggcagcttcatggtcttgctcacttcactaatgaagctgcagaccttactgatgtgtccagagtgtcttccttctggcagattcatggtcttgttcacttcactaatgaagctgcagaccttactgatgtttccagagtttcttcattctggcactttcgtggtcttcctcacttcaagaatgaagctgcagaccttaccgatgtgtccagagtttcttccttctggcagtttcgtggtcttcctcacttcaagaacgaagctgcagaccttactgatgtgtccagagtttctttcttctggcaggttcatggtgttgctcacttcaagaatgaagctgcagaccttactgatgtgtccagagattcttccttctggcagtttcctggtcttcctcacttcaagaatgaagctgcagactttactgatgtgtccggcgtttcttccttctggcaggttcatggtcttgctcacttcaagaatgaagctgcagaccttactattcagtgttaaagcacttagaggtgttatatccagagtttgatccttcagatgtgtccagagtttcttccttcttgcaggttcatggtgttgctcacttc

SEQ ID NO: 480189 - DNA, 616 bp, Homo sapiens
tttgaaatggtaacatttacccaatgcctgtattaccattatattttagaaaggtatcacctgtgaagactgaaaaacaacaaagatgccaacatgccccttcttccaggagttttaccccagatgggtattggtttgttacccactcaaacttggctgtagaaagtggctggggattctacttggaaggtcttaccctattgggtggaatagaatcagggacctacttaaagaagcagttttgctgctttttggtagagcagccatgctgtattagggatccctttaccccacaattacttcaaagttcaagtctggactcatctttagctagctgcacatgtcatggaataaactgccttctggtgggtaccagtattaacgggaccactctcacgttgaagttgggtaataaaccatttgcagtctgtactccccttgactgcattctgaatccctgaaactcctttggacctaaaatcctgaaaataaaatcgcttatattctattgcccataaggcttataaaacaatattaccatattggaaatgaataaacttagccttctaaaggaagtcttgatttctatattatttaacaactagatattttctct

SEQ ID NO: 480190 - DNA, 508 bp, Homo sapiens
cctgcagcacctgtcacctggaagtcatatgtggaagctgactggtccatgcatggctgaagcatgaggaaactcatcatgggcctcattttccttaaaatttggacttgtacagtaaggacttcaactgatcttcctcggactgaggacttttcccagtgtatacatcaagttactgaggccacctggaaaaaagatgagaaggacactgttcaccttcaaaaaggaaagagtaactcttcctgtactagtgctcactgtaacccattagaactactaattgccaatcccctcgatctctgttggaaaacaggagagtatgtaactctaggaatcaatggaactggactggatccccaaggaaatattttagtccaagggtacgtccacaggtgctgtcccaaaccagtgtttcagaccttttatgatgagctgaatctgccagcaccagagcttctgaaaaagacaacttatttccccagttagcagaaaatgtagctcatttctt

SEQ ID NO: 480191 - DNA, 578 bp, Homo sapiens
ccatctttttatatcccaatttggctcctttttctttgtggccatgaataggaaggagtcatgctttgtgactacttccagctgcctggggactgcaggtctcttggatcttgctggaggtccactccagactctgtttgcctgggtatcaccagtgcaggctgcagaacagcaaatattgcagaacagcaaaaattgctgcctgatcctttctccggaagcttcatcccagagaggcacccagctgtatgaggtgtcagtcagccactactgggaggtgtcttccactatgctctgccctcaggggtggattcaatggaggcagcaggccttgccatactgcagtgagctccacccacttcgagcttcctcagacactttgtttacctactcaagcctcagcaatggtggacaacccaccacctgcccagctgctgctttgcaggttgatctcagactgctgcactagcaatatgctgttgcttcatgcagagagggagaagaccgccattttttggtatgtgtgaatgtgtgtcagctatgtgatatgagcttgttgggtttgcctgatgtcagac

SEQ ID NO: 480192 - DNA, 594 bp, Homo sapiens
ctcactgattgcatgtgctcctttctcttccccatttactgttgcctctccattctttggtggattttgctgggaaagggcatctggtgtcatggttgccacctttgccatggctgctgcctctgcggctgctgcactggcttgttgctgagagagcttctctccgaacttctgctgctgcgtctgcaccacgtcaggagtcacggcgtctgtcagggacagggactctatgggtcggctgtcgaacaccaccatccaggggaagcaacccaagggacagccatcaactctcgcggtgattctcaacaggggtgtgactgtgcctccttgggggatattatgcaatgtctggagacactattggttgtcgcaactaagagaggatgtgtggtcctggcatctgtctttcagtggctgtttccttgtggctccttggaaattgaaggcaattgtctgaggtcaatagtttcaaattgttatggagtgttttacccgaaattttggttcacagctttcattggattatctattggggcacagtaaaactgacttatggaggtaacacctgattgtctcagacaggacacagaagaa

SEQ ID NO: 480193 - DNA, 808 bp, Homo sapiens
gtgttgcagcgccgaagcattggatgctggataaactaactggtgtatttgaatagactcaagtatgcattgactggagatgaggtaaagaagatatgtatgcaacacttcctcaaaattgatggcaaggttcgagtggacatcacataccctgctggattcatagatgtcatcagcattgagaaaacaggtgagcatttccgcctggtctataataccaagggctgttttgctgttcatcgtatcacagtggaagaggcaaagtacaagttgtgcaaagtgaggaagattactgtggggacaaagggaattccacacctggtgactcatgatgctcgaaccattcgctacccagatcctctcatcaaggtgaacgatactgtgcagattgatttagggactgggaagataaccagctttatcaaatttgacacaggcaatgtatgtatggtgattgctggagctaacctcggtcgtgttggtgtgatcacaaacagggaaagacatcctggttcttgcgatgtggtacatgtgaaggatgccaacggcaacagctttgccacaaggatttccaacatttttgtcattggcaatagcagggcagttcttctcagcagtggcttggttttgccacaaaatcagtcatgttggatgatctgcgtcctgctgactggtccactggtcctgggcagccagcttcagttggctgtggcgaatccagggtatgatagctgcaacttcaacagcagtgggagtagacaagattacagtgtgggtcccatcccatgtgggccgtaaggtggttggg

SEQ ID NO: 480194 - DNA, 723 bp, Homo sapiens
tgcttaaggtgtacaccggcccagcagacatcatgatgcatcaaaccatggggttactaggacccaacccagaaataaagaaaatgaccctacaggacccacagctgcgcctgtacctgctacacctctattgggctcatctcttacacccatctttctttcgccttgtcacctgggcagacacccccttcccagcctctaataatgtaactgcttggctaggagggatagatttactcccactggggttcctcattaatggcacacattggactaaggtgcggggtaacactacatatcatcccactatcctcccactgtatgtaaattgtaaaagttctaccccttactgtgtacccgcccaaacacaagtatggctacatcatggcaaaggaaatgtcttaacaggcttacttgcatatagccttaaactaggcaatgcaatcaatgccactttctcaaacattcctcactgtgctaaagaacaaaagcaagaaagtaatggattccactttagctgagaggtctgtcatggggaataagctcgtagcctccagttaggcaattgtaacatcttaaactggagcccccatagctgtttgtagggtaatcatactgatgtccttgtctgtcgtgatatcaatgacagttttgtagccacgtcccattcccctataatttggttcaaaatggggatggcatgtctccatcctcaagtaaagt

SEQ ID NO: 480195 - DNA, 1427 bp, Homo sapiens
gtattttctcacctagattgtcatcaatactaaaggagtacagttggaggagccaagatggctgaataggaacagctctggtctacagctcccagcgtgagcgacgcagaagacaggtgatttctgcatttccatctgaggtaccgggttcatatcactagggagtgccagacagtgggcacaggtcagtgggtgcgtgcaccgtgtgcgagccgaagcagggcgaggcattgcctcacttgggaagctcaaggggtcaaggagttccctttccgagtcaaagaaaagggtgacggacgcacctggaaaatcgggtcactcccacccaaatactgtgcttttcggaccggcttaaaaaatggtgaaccacgagattatatcctgtacctggctcggagggtccttcgcccacggagtctcgcagattgctagcacagcagtctgagatcaaactgcaaggtggcagcgaggctgggggaggggcggccaccattgcccaggcttgcttacataaacaaagcagccaggaagctccaactggttggagcccaccacagctcaaggaggcctacctgcctctgtaggctccagctctgggggcagggcacagacaaacaaaaagacagcagtaacctctgcagacttaaatgtccctgtctgacagatttgaagagagcagtggttctcccagcaggcagctggagatctgagaatgggcggactgcctcctcaggtgggtccctgacccctgacccccgagcagcctaactgggaggcaccccaagcaggggcacactgacacctcacacggcagggtattccaacagacctgcagctgagggtcctgtctgttagaaggaaaacgaacaaacagaagggacatccacagcaaaaacccatctgtacatcaccatcatcaaagaccaaaagtagataaaaccacaaagatggggaaaaaacagaacagaaaaactggaaactctaaaacgcagagtgcctctcctcctccaaggaactcagttcctcaccagcaatggaacaaagctggatggagaatgactttgacgagctgcaaagaagttgaaaactttgaaaaaaatttagaagaatgtataactagaataaccaatccagagaagtgcttaaaggagctgatggagctgaaaaccaatgctcgagaactacgtgaagaattcagaagcctcaggaggcaatgcgatcaactggaagaaaggaaaccctacaagccagaagagagtgggggccaatattcaacattcttaaagaaaagaattttcaacccagaatttcatatccagccaaactaagcttcatatgtgaaggagaaataaaatactttacagacaagcaaatgctgagagattttgtcccaccaggcctgccctaaaagagctcttgaaggaagc

SEQ ID NO: 480196 - DNA, 1229 bp, Homo sapiens
aagttgatgtcatatctacactgttgcactgatttgaagatgggcagcatttgcggaacaattccctcgcagctgtcaatgggaaatgggtggaagcaccagccagcagaggaaggggcgctcctgccagattgccatggagggaggtgtccgcctgaggcctcctgtcccgcggggtatgaggatgcttggggagcatctctggcgccatggcaaatgcgcctctttcaacgggatttccggacgcgctgctttggatgtcggggtgtgcctgagcgcctgctgggactgccatcatcttctccggctccagctctgtgttactcgggcaggcgctctacagagcgccgggagtctgtctcctcctgcagaggccaatggcagtggaagagtttgctggaggtacgctccagaccctatttgcctgggtatcaccagtggaggatgcagaacaacaaagactgctgtctggtcttacatctggaagcttccttccagaggggcacctgccagatgccaaccagagctttcctgtataaggggtctgtcagctcctactggaaggcgtcgtccagtctggatacacagtgggtcatggacccacttgatgaggcagtctgtcccttattagagcttggatgctatgctgggagaaccactgctctcttcaaagctgtcaggcagggccctttaagtctgctgaagctgcgccacagccaccccttcccccagatgctctgtcccagggagctgtggtgggttctgtccagtccaaacactctggcggctttgtttacactgttgatgtcagctgtggtggtaatggcaggttgtgttagccagtgcttaaatcctgggaggagcaactgggctgaacaattaataggccttggatgtactgggatcaccagaatatgccagcagacttgttctcaggctccttggttgtacatacagttgctgactgtgactgaaagaaaagaatgttcttcagggcaccggcagagtgctcacctgtcagctgtgccagctatgctgcagggctgccactgggaagtctcatcaaagtcattctctatccagctttgttccattgctggtgaggagctgcatttctttggaggaggagaggcactctgatttttagagtttcctgtttttctgctctgtttttttcccatctttgtggttttatctacctttggtctttcatgatggtgacgtacagt

SEQ ID NO: 480197 - DNA, 818 bp, Homo sapiens
cttctaaaacctaaaaaatcaagattcagagaggaactatcaaaggagcagtgaggacttggggatgagagatgatacggtcagttgtttattgagaggaatgaagaaatatacaaaaaagccttttaactgtgaaaaagttaaggaagtttctcagcacaaatgtgagaatccagatttgtttcaagggcttttaattgagaaaatcagacagaaccctcagctgcaggtctgttggagtttgctagaggtccactctagaccctgtttgcctgggtatcagcagcagtggctgcagaacagtgattcctgtagaacagcggatcttggtgaatgcaaacgctgctgcctgatcgttcctctggaagttttgtctcagaggagtacccggctgtgtgaggtgtcagtctgcccctacgtgggggtgcctccccctgcatgctgggagagccactactctcttcaaagctctctgacagggacatttaagtctgcagaggttactgctgtctgtttgtttttctgtgccctgcccccagaggtggagcctacagaggcaggcagccctccttgagctgtgactgaataatgctaaacagttcatctgcaatttccctgattatggtttctgcctgtttatgcatcttattcaatccctctagttagaggatattgattccattatttaaaattatgtatatgtattcattggtattctgcatttattgaaaacttgttctcccagcttcccttagggctttgagaacatttaagtaaagtgaaataaaatatttgcctagaaagaaccatgaattact

SEQ ID NO: 480198 - DNA, 2358 bp, Homo sapiens
tttcttgttttggtcaggatgatattggctgtggtttgtcaaagtcattctccatccagctttgttccattgctggtggggatctgcgttcctttggaggaggagagaacagtagattttggtgaacagcaaatggtgctgtcagatcattcctctggaagttttgtgtcagaggactacccagcaatgtggggtgtcagtctgcccctccggggggatgcttcccacttaggctactcagtgttcagggacccacttgaggaggcagtctgtctgttctcagatctccagctgcgtgctgggagaaccactactctcttcaaagatgtcagacagggtcatttaagtctgcagaggattctgctgccttttgtttggctgtgccctgccaccagaggtgaagcctacagaggcaggcaggcctctttgagcagtggttagttacatatgtatacatgtgccatgctggtgcgctgcagccactaactcgtcatctagcattaggtatatctctcgatgctatccctcccccctccccccaccccacaacagtccccagagtgtgatattccctttcctgtgtccatgtgatctcattgttcagttcccacctatgaatagtatctttaggataggtttttaatcatagacttatgttgtcaatgacatagatttttgtaagcctcttggtatgtattttgaaagatttaatatccatccagtttcctaacaacagtgtataagagtgttcattttgctttcaacagcattatcactagaaaagtattctgtcatttgggaaaaaacaatgttatactattttaatgcatcattttactagtaaatttgaatatttgtcagtgtttattaatattttatatttcttctttttgtaaattatccatggctttcttcttttttggggggagaaatattgacatttatttttctgatgtgagatctttttttacatttgaagactagtaccctagttcttatttcttacatatatattttctagtttgttaatattttatttttagttatacagtttttcttactttacaaaggtaactacttaataaaaaccattatccacatttaaaaatgccattactattactttagagaaaaggttatgtgtttttgagttcccctaaatgtgataccaagtctcactgaaattaatctgttcatttcattcattcacgttagtaatcataccacaatataacacttactgttcactaaattttttatatgatgtgctgtttatctgcattcctggggcttttccttagctattctatactgcctcttttcccttactatcttagacccttgcctgtcttcacaatctactagataaaaccatgttatgacttagggtatatgaaaataactactttggtcttctggactgtctcccatcaaactattggcccccaggtgcacaccctcatatttattcaggtgagggacaaatgaaatatatcaaattgttttaaaagcctcttggtatgcatttcaaaagagttaatatcaatccaatttcctaccagcattgtataagagtgttcatttttctaaccctcaatagcattattattggaaaagaactctgacatttgaagaaaagcaatgttatgtcactttaaagtgtattttttattactaataaatttgagtatttattaattgttcatatttcttcttttgtaaattatcaatagccagcctttgtgttttatgtggggagggacactggtacttatcttgcttgataaatacaatctcatttggaaaatagatcaaagggtcattctaggcaaaatcaataaggaattcaggataagttattaaatgttctttaggttgagagatggcatctgggtataatatgtgaaatgttgtcaaaaatgtataattggggagaaatgtagagttacacagccatttctttcctaaaatgtaagcttccttttatacagatatgatgatgtcttacaggagtggctgctgtaaaatatagagaaccatgcagttctctgttttacagatgaagtaacagatttttaaagttaattaactgaaagttcttaattgttggaactcctggaccaacattcaaagcaggtatggctttcttttcttctgaaattctttaaccgttctacttaattttaataaagtgtgtttatttttaaaataaattaaaattattttgtgatgttctttgagataacattttttcaggatctgtcagaatgaggtctgtgaatgatttaaactattatatttatgtgattggtgtttatcatagataaacattccatttctaaattctaacttagtctt

SEQ ID NO: 480199 - DNA, 654 bp, Homo sapiens
cttgggaaccaccaccacatttccatcgtccagatgtgggtgcctgcagcagaaactgtgagattgtggttcacatgcatgaatccagtccatcgtccagtttgtgatttgtgtacttacagccgacatacaggaggtgttgactctcatacttcaaaccaggacatgtgtgggattttaaaaatcttatcattaaaccttcctgcaggttatgtgatgctccacttctgtctgcaccctgtccacagaaagattgtgacatatggcctgaccaagcaacaaggtgttgtgattgtgttccacctgcaggaaaaaattgtaacaccaaagcaatgttactcttttgcgttgcccctgcactcagaagatattgtgatatattatggagcacagaatccaggtgatgtagctcttgctgggccttatccaaagggggcattgggacatatggttggacccaccacccaggtccaaaggccagatgatgtatctgttctcttctgccaggaccttacacactgagggcatcatgacatgaccctgaacccatcacctaggtggagtaaatctcctgccttggccctcccctcaagagatattttacatgttgccaaaccaagcacctaggtgatgtgacttttcccttctgtgtgc

SEQ ID NO: 480200 - DNA, 2427 bp, Homo sapiens
agttcctctccccataagaggtactatggtaaaaacagggttgctactaccactgcagattcagttaacagcttcagcacaggaaagcaagcatgcagcgtcggggccaagatctagccaacctttgattaaacagaatattatttctgtaacactcataaatatgttatgtctatctagttattctcataacagtgttgaagaagactactggtttttaggtgcagataattattattcagctgtgaagtctagaaattttgacccatcgggagaatgtgatccaagcgtcctggctaataaatttggaataaagatgaataaccctcatgtagttctacaaagacctaccatggaaatttcctgggtgggaacaggaaattctttctatgtgaaaaagagagtattttatgatgattattccaaaagccttggaaaaacaccaagctatgaccaacccagacacccttacataaagcatggagagagttctatgatctccagacaacaagaaacttccaaattaaggtgcattggcaagaatgcaacatattttgatccattggcttggaaggagggaattcatcagaagggaacttacacaaataaagggggaactaggtaggttctctgatgaccctaataaacatagagaggttttccaaaatttgacccaaatgtttcatgttacatggagagatgctatgctacatttaagccaaaaccctaactgttacagaaaagcaggcagtcttgcaggcagcagaaacatttggagataaacagcctatatttgtttattagtccatagaaacttttttcatattactgttcttaaagggtctcacctgaaggccagtaatacaattgggaaattagcagaaaaaaaaatcttataattactgaatttcttcttcttgtctgcttggctgtatatgtgttatattccttctttgaaacaaagtgccatataaaccaatttaataggcagatgtaacaaataattattcttgctgcactgtatgcaaataactgtcaagtatagtaaagcaaaccagtcctattataatttgtcttttaataaaaatgggaaactggagagacaaaattatgtttcaaaaatgatagcacatggattgttgaattctagtgtttcctaatgtttttctatttttattattttccactgcttaaattaaactctaatttttctggatataagtttccatattaagctgtgatttcttaaagccctacaaactgaaaagtaagtgtttcatcaagtactgcctctaacacagggccaccacaggaataaatgtcttcactgctggtgctgacaactaataactgagggtgctgagaaaactttcccccaaagtctagtgagtccatgaaatgcagggtgattaagatgatatctgatacaggagtcaattcctaaatacatcactcaagtcaaagcctagaaatctaagaaagcaacccaaacagcccaaagaaacaccctaaatatcaatgtaaaaaaatagaaaatattaagctgaaaatcataaaagataggtgactaagtgaaaactactcattttattcagcctcacacacctcaccaaatacttttggtgtgtctacctctttttttaagccaaatattaaaacattttaatggaaattatttactttgccacccttgtgggaactgccttactcactgctatttgcagtagaacaatatgctatagcatcctcagggtggaatatcagacaaaaaaatctcaattattatagcattttccctaattattatccagatagcaggaataatagttactaaaagaaagtaacacatgagttcttccaaacacatgcttctgcctctcatcaggtaacaaatgtttctatagcaacgaatagggcttagtaaaaaacactgctaaaaacttaaagaaaaggctaaaaagctaagggaatatcaaaacaaccgaatagattcttggtttggattcaaaatcataggatgagtcatcccattcctgggacctcttctaataatatacctggaactaatgttcttaccttgcctaattaacttttttcaaagatttttaactgaaaatatcatggccattttacagacaactaccccaaaatatctacaaatgacattgctcctacaaaataaaagcacaacaaggttttcttaagatttcaatgtgctttttagaaaatcttgtgaagagttataaaagcttttccttctgtcaacaatatagagaatctttcaaaggaaaatatttcttctgtagatatttttataatttttattaggtacagttctttggttttggttacgggtggcaatcatagtccatataattaacttagctgtaattagcattaactttgtttgtactaattttattttta

SEQ ID NO: 480201 - DNA, 445 bp, Homo sapiens
tctgcagcttcattcttgaagccatgatggtgccctcatggaaaacatctcctaggacagtgtggaagggaaatgcagtttcagaacccacacacagaatccctactaaggcactgcctagtgtaactgtgagaaaagggtcaccgtcctccagactccataatggtagacccactgacagcttgcagcatgcacctggaaaagccacagacactcagccacaaccagtaaaatcagacaggtgggtggccataccctgcaaagccacagaggtggagctgcccaagaccatgggaacctatctcttgcaccagtgtgacctagatttgagacctggagtcaaaagagatcattttggaacttcgaaattgtacttccctactggatttcacacttccatgggccctgtaacccctttattttcaccaatttctcccatttaaaa

SEQ ID NO: 480202 - DNA, 563 bp, Homo sapiens
tagggacttggagaacttttatgtctagctggaggattgtgtatacaccaatcagcactctatccagcagtggcaacccactagagtccacttccggcagtggaagctttgttcttttgctctttgcagtaaatcttgctgctgctcactctttgggtctgcactgcctttatgagctgttaacactcaccacgaaggtctgcagcttcactcctgaggccagcaagaccacaaacccactgggaggagtgaacaactccagatgttccactttaagagctgtaacactcactgtgaaggtctgcaacttcactcctgaagccagtgagaccatgaacccaccagaaggaagaaactccgaacaatctgaacatcagaaggaacaaactctggacacaccatctttaagaactgttaacactcactgcgaggctccgtggcttcattcctcaagtcagtgagaccaagaacccaccaatttcggacacaatgggagcagacttctttatgttctcatgatatattaattgttgctttaaatctgaaaatatgcattgtttact

SEQ ID NO: 480203 - DNA, 511 bp, Homo sapiens
gcggttcgtcacctgttctgcagccggcttcctaacaggccgcggacagggatgatgctccaccacctaaagattatggataccatgactacggtcgttctagttggagtgaacaatcctctggaggatatagtttttcctgctgacattaacaaacgttttttaaatttaatgaccgtgatggctaccaagggggctgtggtagagatcattctgaacatccaagtggaagttcttacagagatgcatatcagagttatggatacgatagctcaagttatggagcacctacaggaagtggtgggggaagccgatgtgaaaaaggagactgaagcagatattaaaggagatattaaaaataatacttaccgtggtattcagcagggtagatggaagaatgatgagaggtttgagggaggatatgtcaaaggattcaaggaaggtaaagggaagattgaaggtagtgaaaggagaaacaagaaacatgagtaataagaaggaagatatcaaa

SEQ ID NO: 480204 - DNA, 851 bp, Homo sapiens
tgtagctttgcaggagttcctcatggtttctgagctacttgttgcactgacatctaaacacggctacacatctcaaaatctcttctcattaataaccgttacgttaatcactgttgtccagaactggaatctgactgtgaaatccccaggtggaaattgctataatggctcaaactatgggaatgactatttttcagcgcctgtgctcactgacctaggtgaggacggcacttctgttttcttgcccaaatgttgcatttcccaagaccaccctggcctgccacacctccatcctgccacacctccatcctgtgatataagaaacccccagatcctagcaggcagtgacacagcagctggacgtctagagggaccattagcagaaaaagacacagcaactggacctcgagaagacaccggaggaaggagagcacagagactgaggctgcagggcatccaccgcagaagaacactgagtttcgaggagctgtgggaagagagcgctgacctgtcccattccaagggaaaactaccttcccgctccatctgccttctgggtccccatctatctgctgacaacctctacttaatgaaaccttgcacttattctccaagcccacgtgtgagccaattcttcaggtacaccaaggccataaaccccgggattcagatagccttctgtctttgcaaggcaccattatcatgaacttgttattacctttgtattttttaaatttattaaaatatttatttgtaaataatactggtgctttgtaaatttttaatatttatgtgaatattataaggtgtgtattattttgcatattttttgttaacattcttggtggggg

SEQ ID NO: 480205 - DNA, 921 bp, Homo sapiens
ttttgtttgataaacttaaagttaagcatccaggttttcaaagggaaagcttccaggttctgccattcagtatgatattggctgtggcagtgaatctctggacacattctgtatgtgatgaagccaaattttggaaccaagaagaatttccagccttattgcctttgacagagcctatagctaagacagtcccacaatggatccaggatagatttccagcaatgaacccctgggcaaaaactatggctgaaactgtcataccattgacccttgatgaaatgacaccagttgaatttccagcaatacattcctggaaacagttggaaactgatataatcacactagggacccaagctgaatcactagtgatgaattcatggatacactctcctatatctgatatggtcacaatgtgtatccaggctgaatcattattattacatccttggacacagtctgaaactgatatactcacaacatggattctggctgaaactctaggagtaattccctgggaacaggatatattccaaccatggacccacgctgaacacccaccagtatcttggactcaatcattgattccgggtaaaacaccagcaatgaatccctggagagatgtcacagctgatatggtcctaccatggaatcaggctgaatttatagtaggaaatgcctggacacagtctgaaacttatacagtcacacaggggatcctgaatggtcctccagcacgatattcttggacacaacaaatagctgatgtagacaagctgtggaccaagcctgaatttcccacaataaatccctggacaaagtctgtaggtgatactactatacaatagtatagtagtgatagtactatacaatagattcaggatgagtctccagcaataaaaccatagacacagtatgtgtctt

SEQ ID NO: 480206 - DNA, 739 bp, Homo sapiens
tgaggaaaaggattaatcagcgaaggagaactcatgccacatatggctccccatgggtgtctcacacaggggagaccaattcatctggcattcctgaaactctctttcccacaaaaagtaaatgattggacacagcccataccagctacagttataccaccaaaccaagctgaatctgtaggagtaaatccctccacaaatcttgaaacagaaattgtcatactgtggacccaggcccattctaaaatcaacaatccctgcacatacactctatttgatagagtgacaccattggctaagaatgtttgtgtagcagatctgttgccaggaataaatccattaacagtggctgaaactggtatagtcacactgcagtacatggctgtatctctagtaatgattcccaggagagaggctttatctgatacagtcataatatggacacagacaaaacctccagcaatcactttctggttacaatctctacctgatgcaggcaaactacagacccaaatgaaatatccatcagtaaacacttggaacgaggctgaatttcaagctgtaaattccatgatggagtctaagtctccagttgtaaatatctggacagatcctgaatctccagccccaagtcctctgctataggtcgagactgatatagtcataccatggacccagactcaatctttagcagtaaatgcttggtcaaagcctgttgctgatacactcatactgtata

SEQ ID NO: 480207 - DNA, 874 bp, Homo sapiens
tggagctgactaacacaagccacctacagatggataaactaaaacaacaccgtgttaatgacctccagctgcatccatgttgctgcaaaggacatgattttgttctttttatggctgtggactattccagcgttcatatgtactgcattttctttatcccatccacgatggatgggctcctacgttgatgccatgggactcattccagttaaaagaggtccatcttcaagaagtggaggtcctcctccgaaaaaatctgctccttctgctgtggcaagaagcaatagttggatgggaagccaagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacggagtctaaagtgcttttcagaattatctaaaacttagtggcttaaaaccataattataatttactaactgtcagtctctgcaatcgccctcagtctctcagccaaatgaatgtggttcaggggcgctcaggaggatgcaatctagtgatggccaaagatggggacatt

SEQ ID NO: 480208 - DNA, 604 bp, Homo sapiens
tgcctcagagcctttggaattatagtcccttgtcagtcgccatggaacactcccctcctgcctgggaagaccaggaagcttttgaatgggggtcccaacaagagcaagccttttatgagttaaaagagaaactcatgtcagctccagccctggttctgcctgatctgacaaagccatttacaccatatgtgtcagggagagaaaaaatggcagttggggttttgacccagaatgtggggtcctggctgaggccagtggcctacctctctaaaaaactagacagggtttctaaaggttggtcctcttgtttgagggtattagcagcaactgccctgaaagcacaagaagcagataaactaactcttgggcaaaacatgaacataaaggccccacatgctgtggtgactttactgaataccaaaggatatcattggctaatgaatgctagactaagcaagtacaaagctttctctgtgaaaatccccacacaatcaatgaagtttgtaacaacctgaattttgccaccttgctccctgtataagaaagccctgttgagcataactgtgtagaggtgttgaactcagcttactttagcaagcctgac

SEQ ID NO: 480209 - DNA, 774 bp, Homo sapiens
atcatctgggaactgaattcgagatcatcagccagggcccgtggctcaatctcatgcagcactacccaagggagttaggccctcagagagggaacagagaagaggccagggaagcagcccagggctgggggatgagaggcctgtgggtcctggagccaggatacatagcgaagccaaggctcaaggaggagactgaggccctgggtatggatgagtctcttccactacatgaccactggcatagtaaaagttgtgggaagaagcagctatgctatgtgcctcaggctctccacatttactccatggtgggacagctcaggcttctgttcaaggtgccaagatggctggctaggactgccataatcagaagcagcaattggtgcccaagtcttcctgagatttggaggactgagttctttttgtttatcctggctcttgccagctgctccagaagtagtcgcaaggccacgtctgttttggggaaccaagagagaaaactcaatcagcggcttttaggatagaactaatcttgactacagctggaagacatacataatgcacatgcacacatgtgcactggcacactcctattcatccacattttgcatatttgtcataagacaaatattaaatgtgtcttattcatgaaagttgtaagatattacaataagcaagccaaatgaaaactaagatttcaaagattattgccagtgttggagaaatcttgcttttgctaaagttgttggcttaatactcaagtatcttctactgttt

SEQ ID NO: 480210 - DNA, 643 bp, Homo sapiens
atttttttgtgctgttcttgtgacatggaaaaggccagaaaggctgctcaggcttcccaggctgctaatcatcctacaatgcacagcaaaagcttctcccccacaaaattatatgagtacaaaatgccaaagtccagaaactgcaaagtcccaaagaaggtgtcacagccagcccttaggtctgaaaggtcaccgttctcctcttatctttgtcttccacaatgtgatgagcaaggggcaagttttatccctgtttgtgttgcaggtcattcagccctgacattcaacagatctaaaactgttgttctgcatcaagaaagaaagagcactaattcactggggcagagtaagtccagtcctgtgctcccagttgtggccgctctaaaagagaggactatggacttcccatttgaccaaggaaagctgctggcattgccccagttgggagtggtgcctggagctgacccctcatgaagcttctgactggtttcttatggggttgccatttttatccaatttagacctgcattgatctgcccaatgcttccccttcctactttggggacatatagaagttaccttgatctttacttgatcttagttaccttgatctttactataatgatattcccttgttatatgt

SEQ ID NO: 480211 - DNA, 682 bp, Homo sapiens
gaaaaccacaaaagcaggccatgggatgactcagcactgtggacagcctcctggggtggatttttcagtcttttacaagaagacctggaacgaggagtcccagaaaatccaggggggtcataagagaatgaaagagcctgtggtggagaccagtgaaagtaaaaatgaccccagtgacatttgtcaccaatcaaatgtgttttcccctgattgttcagcaggaataatgggtcccaggctctacagccattgtgatacagaggatccaagtaattctggaggggcagcagtgaagttggaagtttccttggtggcacaagaagaaaagctgatgaaatggctgttggagggcctgcataagggtggcagagctaaaataatagtgtggcctaggaccagccaaactcaaactgcttctgagaaacagacagccctacatgcaacaagagagattcagggacaactgcacgttgtctacagccagcgtaaaatacaaaaggactcaggaacagccacagcaaaaagagatgatgcaaaagaaagacaaagactagtgacccaattacaggcctataaaatccaagatatttgacattcacctgtaaactcctctcagtgaggcgaggcccatctcaccttttctcatgtttctgtctgctttacattcgctagaagctgattc

SEQ ID NO: 480212 - DNA, 536 bp, Homo sapiens
ttcagagtaaacatttctctcctccctgttggactgactcaccgtggtgttcctcatcctggaagacaatttttcgttaaatcatgacagtatctttcagcttcagaaatagaggatttttgaggccaaatgcaaatcctaaagcaaacaccgtaggaatgggcacccctttctggtttccttcggggacacaaagaagggcatcctctgctctcaaatcccaagtgattcttcaaacccaggagtgtggagccggcattgaaccaggaagccacagcagatctttcttctctcctatgtttggaataactggctgctgctcccatcagtgtcaccaccaccatggatatgatggaagacacaatttttgctaccatattgcctgcaggagtggagaaaaagcaagctcatctgagaaaaaaatatggctgcaggaaaactgcttaaatattagattggtccaaaagttattacggtttttgccattgaaagtaatgacaaaaactgcaataacttttgcaccaatctaataacat

SEQ ID NO: 480213 - DNA, 489 bp, Homo sapiens
gttactcaaggctgggtgcagtgtccgagcgtggggtttcctgcaggtgttggtctgtccagctcgttgggaatggcaacaagtcgtgtgaacacccacttcattcatatcagcagcaccatcgcccaagtgtcccgcgatgatgtcactggtgagcatttcatgttctttctttttcttatgaacaatggtgccaccagctttccgagctttcccccatgcccacgtggttgcgctgttgctgtttgtgcatggcaagcagaatcaattttagccaactcagtgggtacgaagtggtgcttcactgtggttgtgatttacatttgccttataccacattttgctttcaatatctgctatctggtacagttgttgcatctccttcatacaccctacagttctgtaaaacttcctcaaccatccctccataagcatcagttcaaggacattgcctcagttttcccagccaaagagtcactcacctgagtt

SEQ ID NO: 480214 - DNA, 680 bp, Homo sapiens
cccgaagccagccataaaacctaaaaacaggactctaactttccctctattctatctgtacaaagactggccatgaggaaattacctgacctcttcttgtttgggcatcctaagaaccccattccagagagggtcccgcctcacacccagaaggaaggagtgctgctcagagaggccaagaagaatctagacacacaggtctggctgggtttccccactcagaccattagcattggatcaggccctttttgtccaaccctatttctacacagctgtccagacttggttgaactaaagcataaaaatggaccatctccccttgtatctggggtcttcattctgaatgctcctgtcaaatcttcaggggccatgaccccacaaaatcaatataacaaacaacaattttgcaaagcagagtgctgttgttggaataataattacacaatgtcaaggtcaatgcccactgaacattacctgcctccaggcaatggttgccacatagcacagaagagcaatcagcccacacccaaacctccacttcccattgaattatttacctcaatctaaagaagaaaatcagctcccagcaggctctgagcagaaaataaaaaggaacatacagagactgtctaaatccctgacaccaattatagctattatcagcagaatttatacactgc

SEQ ID NO: 480215 - DNA, 543 bp, Homo sapiens
ttcctatagcccaataagaaatggactgataacacataaaaatgaaaaaagtgcagttcagatggtttctgtcgccaaagtcattctccatccagctttgttccattgctggcaaggagctgtgttccattgctggcaaggagctgtgttccattgctggcaaggagctgcgttcctttggagggggagaggtagagaagcctccagaggctctctttgcccacatggaacacaatgagcaggtccgctttctgtccatcccatccttggctttggcagcactggcacactgtgatattctgctcttctctcccttcccccatggcagaggcctctacagggctgacttcagcagctacagaggctcagaagctttgggctttggttctggctgccagctgagttcctcagtcttcttccatgttccctttgcaggtgccaaatatgcaaatgacttctttccctcctgtgtctgacgcgtgggccaggaggctggacaacagctggacctgcctggtatcactgtctgtgtagcatttctgt

SEQ ID NO: 480216 - DNA, 642 bp, Homo sapiens
atacaccactacaagctggatgcttccgtcaaactgcgaaggcaggcagaggaccccggcaagcacatagaagagcttccctctgcagtctgggccaaagaggaatagtccatgccgacgtggatgaaatttggattcagagttactgaagaagtgtctggaggtgggcctcattacacgatgcttcataagctcagagaagagatggttggatggatggatgagtggatgagtggatggatgggaagaagaatccagccctgtcgaaagctgcccttttgtttcccagctgccccatccctggtgcctacgcaagagctcccactagccagagaggctgccagaactaatagcacatgtcaggtctgcattccaccaggccagctgagcaaaccacatcaggccccttcataccacacagctcaccaccacctcacagatgtatttctgcctcaggctttctcacatgtggcatttgaagcatgtccttgggaacatgtttgtcctctcggaaagtttaaatttttgtgtgttcatttctgtgctagctcttagagtctaaatcaagatgtggtgaatggtgtgaatgaccatggctgtgtgtcagagagtctcattgaccacagtgctgacacagttttc

SEQ ID NO: 480217 - DNA, 991 bp, Homo sapiens
ccagaaaaccagccctaataatatgacaaaacaaggctctttaacacccaccaaaatcacactagttcaccagcaatggatccaaaccaagaagaaatccctgatttaccttaaaaagagtttggagggtgaaagtattggagtgtaccctgtcagcaaacattatttatccactttaagagtgacttcaggatggcggtttgaggtaaaaccaggagataccagttatgatggtttgaaggaaaagtgcaaactggcagtgcctggtggaactgccattgatgaaccaagtgtgatcaggatgaggaacaggaaagaaggaaatatggggaaattgaatgaatgtcaggtggatcagagagatacagtcatgggggtcaggtgtggtatctgcaataatgtgggaagccggattgaagtccaggccaggaacaatggtaactgtgggagactcagcaaaggagagccttgggccagagtttcaggggctctgggagtggctgctgggcgtgttggacagtccagtttccagtggggtcctgcacagatgggacgtggcttaggaggaatcctgggctgcaggcattccttggcccagtggccagatttctggcacttgaagcaagatcctgggggaggagttcctgaaggaatgcctgactgctgtggcttaggtgttttgaagttcttgtgtgctggagatgtggctggggtttctctcacagtggaggcaaggaattgcaagtcagaaatatgttgctacttcgctgcccctactcttctggtacaccttggaggtgaggttaattaggtcctgttatggggtcttggagctttatttaatgtcaggagcagattgggcaataaaatgtatattgagaataagaaagccttctgacctttcagggtctagggctgtaaagcatctcagggttgctgccaaacgagtcatgaactgggctgggtttttatatttgatgaaaaaaagcct

SEQ ID NO: 480218 - DNA, 642 bp, Homo sapiens
tattgccaagtagctgaggcatgctaacaattgtaaatccaccatctttgaggaataaaaacatcaatagcttttgggattacaggtctgcagcttcattcttgaagtcagcaagaccacaaatccaccggaaggaacaaactctggtcacatcttggcaactaagaagggactatcaccaagcggctttctgggaaagggctaacaacccccgactctttggaattgacattgttggttttcctggaaccagcttccacttttcctgtacttccgagctaagccaacggtcgacagagaggaaagcccatctgcagggtcccaacaaaaatttggttgaccctgtagccatgagcagaactctcagagccacaatgcccaagaggaaaactagcgtttttgctgctgcattggtgagtgcaattattccaatcagcagggtccagaaactgttgtgggttcttgggcaagagggggatcagctgctgcatcagtgagcacaactattctgatcagcagggtccagatgcaaaacactcaggcatcaacaggctcacccttgaaatgcatcctaagccattgggaccaaaccctgaaaaagaggtggctcatttttttctgtaccacagcctggccccaata

SEQ ID NO: 480219 - DNA, 560 bp, Homo sapiens
ctgatgcgctgaggaagttagacacaaaatggtacatactggccctgcaggggctgcactggcacatgcaaagagacgcagcaaaggggaaggggcaagaagaaggtgggtgctgatggaagaggagagtggccagggtggagtcccctttaccttccaccatgagtggaagcaaactgaggcctcaccagaagcagatgctggcactgtgcttcctgtacagcctgtagaacttaagaaaaactgtgggattaagccagttgattatgataaagtaagagaaatagctcaagaaaaagatgaaaatcccactctaattcagggctgtttgtatgaggcactgcggaaatatactaatatagaccctgaccccttggaagtggtgatgaggcaacatacatcctcagcttatgaagatgacgagattaagagagtaaagacaggcataggaaattatgactattgattggggaagtgataaatgtccatgaaatcttcacaatttatgttcttctgtcatggcttcagcaggtccctctgtttggggtccctgacttccc

SEQ ID NO: 480220 - DNA, 554 bp, Homo sapiens
aaagtttcagttaagcaaacactcgatgtggggtccccagcttccttcctatttagcctcagcatcttcatccacattcagggttcttgctcttaaaatctgttcaacttgtgctggtgtaatagaaattccagtggctctctgtgggtcagcacttcctggctgcatctggtttgtgagggcagaggagcacacaattcagttattggctgtctgctgcagaggaccctcagctgcaggtctgttggagtttactggaggtccactccagaccctgtttgcctgggtatcagcagtggtggctgcagaacagcggacattggtgaaccgcaaatgctgctgcctcatcgttcctctggaagttttgtctcagaggagtacccggccgtgtggcctgcaggtcacaagggaatgccccaactgtagaggtagtctgactatgtatttgtgcccagaaatcctatgaagtatgctttctacagtgtttcactgatgaacacactctctgatttgggttgcaagtttgcaaaattttaaagtaacaaaaagtgggg

SEQ ID NO: 480221 - DNA, 552 bp, Homo sapiens
gtgttactaccatttgcaccccttgatttctgggtccgtatcatggcacaagcatctacttctgctgagggcttcaggctgcttccactcatggcagaaggagcaagtgaaggtgccaggactccctactttctccttggctccaggggcagcaaggacaaatgcagcaatagctataattatgaaagtgttatcagtggcctcttggagttgagctctcagaggaagaccaagctgcagctgcagtgttcaggagttggactctcagagaaacacaaagccatagctgtagtatttaggcaggtacaagtcacttgtgctggaggcctgaaacaggcaagacacatttggggcagcaaggacaaatgcagcaatagctataattatgaaagtgttatcagtggcctcttggagttgagctctcagaggaagaccaagctgcagctgcagtgttcagaagcagatcctggggccatgcttatacagtctgtagaaccatgaggcaaataaaactgttttctttataagttacctagcctcagtctttatttc

SEQ ID NO: 480222 - DNA, 725 bp, Homo sapiens
tataaaacccgattgtatgttccatctactgagatagggaaaaatcgccttagggctggaggtgggacatgcgggcagcaatctgcttttctctcgtcccaccttacgagaaacacccacagcatgttcctggcccctcttctaacaatatgcttgggactaatgttcttaccctacctaatttacctttttcaaagatttttaactcacaggatcatggccttttcacaaacaactacccaaaaccatctacagacagcattgcttctgcagtcaacccaagaccagaaaaccgttcatccccttgtcagcaggaagtaaccagaatgaaaacaccatctctcctccttttttcaatgataaggtctggattgacagagcaggagcactgccatcttggacaagcccctaattctaaagttcactttaataaaaaccacctaaatccaaagggcatcagcttaatggctaaggttggcatgaccataaaccacaaataacatctccaacgagaaacatttcagactcctccttgtccagagacatgttagccccaagataagccttctccatccaggaagatgccagcctcgagataaccccttctgggctgatcataatttggtaatattttctcccatgctaaaagttgtctgcatattattcatttattattgctgtgcagaaactttttcatttaatttttgttttgccagagagaaagt

SEQ ID NO: 480223 - DNA, 1526 bp, Homo sapiens
ctccagaaactgcaggcacaaatttcctttacacctgaagggaatacgacaccggaatttggaaagtctaaggcaatggtattgattctaactgtcccagaggctgaggaatggcagctctctgaactgtgtgccagaaagataccggagctggacctacacacaaggcccttatttgaggctagcaaaggaaaggaaagagagcccctcctatgggaaaaagaagaggaaaaggccttcaaggatataaaggaagctctcatccaggccccagcactagggttgccagatgttaaaaaacccttctttttgatcagacaatggtcctgcatttgtggcagaagtagtacaacagctgactcagcttttaaagaccaaatggaaactggacacagcctattgaccacagagttcagggaagatagaacagatgaactggacactcaaacagctactaaaaaagttttgccaggaaactcacttacaatgggatcaggtcttgcccatggtcctcctccaggtgtcacaccttggattcaccatagctggctgaaagcagcggcagcagtgactccgatgacaaccagtggattagccaacaagacccagatcaccccacctgaatggtcctacaatgaaatccaaccactggacagacagcactattacgagttgatggacaaggagcaggacttggagctccagtactaattgtcaaaaagaatagaaggactcaagtgtgtccaaccctgcaattccgggtccataagtcattctgtaagcattttttttcctttttttttttttattattacactttaagttttagagtacatgtgcacaacgtgcaggagtatttgtcaactatagaggcagtagtaacccgaaacactaccatgctattgacggcattaaccaaatatcagccactgccaataaaagaaacagctcagctccgggaagagatggcaaatagtggtgctttctattaacatctttgttttaaaaagcaccaaatgggggaaatggaagaggaattgaaagaaattaaagaacgtgtaagcaaaaactcagtcgtatataagaaaacccagttccccctgaggaagagaaagagctggagtcctttaaaattaactgcctgtttttctgtggctagtgagccttatctctccctttcccagaattctctttatttttaaatgttgacagtttgaatacaatgtaccatggagaatactttttgaactgtgtgcacttggggatctctttctgtatctggacatttaaattgcatgctaggctagaaaattttcccctagtctttcatcatataggttccctaaccatcctcccccgtgtgtgctgttgctggagaggtgttgtgattacttggaggagaagcagcattctggcttttggaattttcagcattgttgcactggtttttcctcatctttgtggatttatgtacctttgaccaatgaggctgatgacctttggatggggtttttgtcaggggggag

SEQ ID NO: 480224 - DNA, 666 bp, Homo sapiens
tttccttgtgggcacgttgtgaggaacgtatgtagcttcttatctttggtgggaaaaagtacaaagggcatgaatgggggccaggtcactgacaatggcttatgcttcagccctggaggcagggctatgtctttgggtagtggatgtcaatgaggatccagggatgaggagatcttgtccatattggagtggcaagttgggttacactttggacaacttgaatgacagctgtggtggcaaaaaggcacagtgttggaatgcaaggagcggagatctgaggaggaccctgtggtgttctgtggagggtactgtagccaaaagcaaccatacagcttctaaatattttgttgagaactttcttctgccagatacccattttcatcactctcaagtttggccttccacaaagactgtggacttggacatagaggtcccatttgttaatactgccacattaagtgttaaattcaacctgagttttgggagggacaaatatttaaattatagaaattctaaactactttatgttaacaaatctaggaatttagattaagcggacaaatttttgaaagttataaactaataagttcacttataagaaatggataatctaaatggtagagttaacttttttttgaaaggaaaataatactaattcaaatattt

SEQ ID NO: 480225 - DNA, 652 bp, Homo sapiens
tggctccaggaaccaagtgccacaatgccaggccagactcaggttcaggccagtctccagaggactcaggatgcagacctgatcttacagacccagcgacaaggcctgatccagcaaatcccagtgtttttagcatctttgcaatgggttcaaacatcctcctttagcttggagaagtttgttattactgatcatctgaagcctacttccatcaactcatcaaagtcattctccattcagctttgttccattgctggcgaggagctgtattcctttagaggagaagaatcagatccatcagctgcaggtctgttggagtttgctggatgtccacttcagaccctgtttgcctgcgtatcaccagcagaggctacagaacaggaaatattgcagaacagcaaatgttgctgcctgatccttcctctggaagcttcatctcaaaggggcacccagctgtatgaggtatcagtcagcccctactggaaggtgtctcccagttaggctacttgggggtcagggacccacttgaagaggcagtctgtccattcttagatctcaaactccatcccaggagaaccactactctcttcaaagctgtcagacagggatgtttaagtctgcagaagtttctgctatcttttgttcagctatg

SEQ ID NO: 480226 - DNA, 721 bp, Homo sapiens
agtgactctatgcataatacctttgaaccaatgaatatagtgaagttgtggaaaaccaaggaatatagtgaagttggctgttggcacctaaattcactggatgaagtgacgaaagaaaaggataagctcagggattatatttcctggctccaaaagcacatacctagcctcaaatattttaagattgcccttggtgagagtcttatcttctgtaaacaaagggctggaattgtggaaaatcagacacaagcacttatcatgacaaagggacaaaagatgaatttgtatgatgaagtcagagaatcacagcccttctctcaatttcaagacttaagccagtttaccaacctagaaccccttaaacgaagagacgtaagccagtttacagacccagtccccttgaggaagagcctcactacactactgacaatttatgctgttaatctttctctaatccttccccaaggagaacgctggccttttacaagggtaactgtacactgggaaaataagaataatcagactttttgagtactactggacactgagtctaagctgacattggttccagaagatgaaaaacatcactgtggccctccaggtagagtagaggcttaggtaggtcagggttgttcattttttcttattaatttgtttacatttcttaaaggtgttgaatattagacctttgtcagatgcatagtttgcaagcattttctcc

SEQ ID NO: 480227 - DNA, 518 bp, Homo sapiens
ccttggtggttcagagaggacagaaaatggagcaggccagtcacctggatcccacagaccacacaccccaacttacatggacgatcttaccccaaggatttaaggatagccctcatctgtttggtcaggcactggcccaagatctaggccacctctcaagtccaggcactctggtccttcaatatatcgatgatttgcttttggctaccatttcggaagcctcatgccagcaggctactctagatctcttgaactttctagctaatcaagggtacaatgtgtttggataccaggtgctactccttgagggaccagtgcttcaaatatgcacgtgcatggtcctcaaccctgccacttttctcccagaggatggggaaatgattatgcatgactgtgaacaaaatagtccagacgtatgctgcccaagatgatcttttagaagttcccttaactaatcctgatcttaacctatacactgaggaaagttcatttgtggagaatggggtatgaagggcagg

SEQ ID NO: 480228 - DNA, 698 bp, Homo sapiens
ttgaaaacgggccatgatgacgatggcggtttttgtgtgtggctctcctggttgtggaggcctccgagctaattctgggccaagcaataactgtctacaccccacatcaagtaatgaatgtcctaaactcaaaggcctttcactggatctcacagagccatataagcaaatttccaacactccttctacagattcagaggccacacggtacacagatggcagtagctttatgataggtggaacccaactgtcagggtatgctactattaacctaactgaaatcacagaatctggacctctgccaggaagtagcacctcagcccaaaaggctgagctcattgctcttacctgtgccttacaattaggggcaggcctgaggcttaatatttacacagactcagcctatgtctatcatgcagtgcatgcccatgcagccatttggcaggaaagaggacttttaatggcctgaaatacttccattaaatgtgttcctgaaatcatggccccgttggaggcagctatgcttcccccacaggtcactatcattcactgcaaagcccatcagagaagcaatgatgaaatctctatcgggaacacctgggctgacaaataagtaaaagtggctgccaggtcaccctttcaggctgtcttcattcctagcctaacttccctgtctccacactataaagagggggaag

SEQ ID NO: 480229 - DNA, 1652 bp, Homo sapiens
agctgcctgactcctgcaggcatttgagtttccatctctgacttaaatgatcatatgattgcagcatgcttgaaaatgggaaccgtacatgtttttcctctctgaagcacactcctaaatataattttgacatcacccaaaacgcatcagctgaaaaaaatggtatagcaatctctgcgagcagcttacagattaagaataaggctttcctgaagaaggatggagcctcctcactgaagaacatggttttgcatgtcaccccagacactcacgcacagggacccagctcatctaagcagggagacatccttgcttctcttatccatacggattggtgccttctgcttgttcttctacattctggagttacaattcccttacaggaagattttctactgaaggaatgctttgaggatgaaggaagtgagagactgatcattgagagtctgagggccatgatgctagaataggcaccctttatttattctagaaatggacattgctatgaatttcaaatcaaaacagaaacattttttaggcagttccatcctttatataactgtgaataagtaaaacactggttaatgttttctttcttctgatgaattttcttatctgttatgttggtacaaaggtacttgtgatttttgccattactttcaatggcaaaaactgcaattactgttacaccaacctaaaatatatgatgcttcaaagaaagtggcatgtgacaataatacttattcgaaggactaagagagataaaagattgccatctcctgcttttgacttagaggaggttataaggccaccttatgagagatgaaattggaaaagtgtgacataggtcgtaggtgacatctggttccttatgatagtttttgttgtacttaatgcatggtctaaacacttaaggcagaataaaatgcatcatagaagctaagaaaaaagttgtgatacctctaaatacgaaagaatccttccagaaagagtgggacatgaggatggggtgctatgcagtgggtgatatgagggagatggccttgaaaccagaccttgaaagaggaatacatatggcctgaaattacactaaaaattaaacgaatgtttatgctacatgcttttatttgaataactaatttgaaaatattagtcaataataaattaagtaattaattattaattattaattataaggttaggtttagaaatttaattggtagaatgaccattccacaaattgagctttatttcaagtacctactacaattctcacattttagagcacttaatctgtgcaaagcaaaataccttaaccagaaagaatgtaataaactgttgaaccaataagtaagaaagatgttttttgtattttgtgaaattttataagaagaaataaatgctctgagaaataaatgagctgaagagttagagagtaatttgcatggtgtctactttaaataagttaccaaaaaatgagaagatactcagagacatccatggtgatactgaggatatgtttatttcagaaacatgtgaagattagtgggatttatgctttggactaaaaatggataagaaataaacaaaccattagacaaaatatatgaaacaattgctttcagatgttacacaatgatcaagacagaaac

SEQ ID NO: 480230 - DNA, 896 bp, Homo sapiens
atacgacagtcattttctcagatggtaaagaccagtcacaggtttcaggtacggagatgaagagtttggtattgagcttggaggaggaggaaaagaagaagaagaagaagaagaagaagaagaagaagaagaagaagaagaagaagaggaggaagaagaagaacaataacaacaacaacaacaacaacaagggaggaggaggaggaagaaagaagaagaatgaggaggaggagggggaggggagagggaggaggggggagaaggaggagaagaaagaggaggaagagaaagaagaggatgaggaggaggaagaagaaggagaaggaggagaaaagaagaggaagaagaaggagaagaagaaagaggaggaggagaagaagaaggaggatgaggaggagaaggaggaggaggagaaagaggaggatgaggatgacaaggaagaagaggaagaagaagaacaagtaggaggaggagaaaggaggaagaggaagaaagagggaggaggagaaaggaggaggaggcaaacaggaggaagggaaagaaggagaagaaaaaagaagaagaagaagaagaagaagaagaaggaggaggaggaggaggaagaggaggaggagaagaagaaggagaagaagaagaagaaaaagaagaagaagaagaagaaaaagaagaagaagaagaagaagaagaagaagaagaagcagaagaaggaaggaggaggaggagaagaagatgaagaagatgaagaagaagaagaagggaagaaggaggaggaggagaaggagaagaagaagaggaataagaagaaaagaagaagaagaagaggaggaagagaagaagaagaaaaaagcatggatggagctcgttattaggattcagctggagagtgtcagaagcct

SEQ ID NO: 480231 - DNA, 617 bp, Homo sapiens
cctgtcaaaatggaccaatcacctctctgtaaaacagaccaatcggctctctgtaaaatggaccaatcagcatgatgtgggtggggccagataagagaataaaagcaggctgcctgagccagcagtggcaacctgctcttgtccctttccacactgtggaagctttgttctttcactgtttgcaatcaatcttgctgctgctcactatttgggtctacactgcctttatgagctataacactcaccgcaaaggtctgcaggggaaattcaatctagctgcagaaattttcataactaccaaggatactaatgttaattccaaagaccatggggaaattgttgccaggtcatgtcagacaccttcacaacagccccttccatcacaagccaagaggcccatgaggaaaaagtggctgtgtgggccaggcctagggtccccatactgcatgcagtctagggaattggtgccctgtatcccagccactccaggtgtggctgaaagagaccaacatagcactcaagctgtggcttcagagggtgaaagccccaagccttgacagtttccatgtggtgttgagcctgtgagtgtacagaagtcaagaattaaggtttgagaa

SEQ ID NO: 480232 - DNA, 734 bp, Homo sapiens
tgggagtgggcaccgtggagcagggggtggcgctcgtcggggatgctccggccgcacaggagtccacggagggggtgggaggctcaggcatggcgggctgcaggtcccgagacctgcccagtgggaaggcagccaaggcccggcgagaaatctagctcagcgcagtcccccattgcccggggccagcagggctggctggctgctccgagtgcagggcccaccaagcccacgcccacccggaactccagctggctcacaagcgccgcacgcagccccggttcccgctcctgtctctccctccacacctccctgcaagctgagggagtgggctccggccttggccagcccagaaaggggctcccacagtgcagtgggggactgaagggctcctcaaatgccaccaaagtgggagcccaggcaggggaggtgccgagagcaagcgagggctctgaggactgccagcacgctgtcacctctcactgccacactgaatggattcgggtaggccctggccaggacagatcaccagggcaatatcctggccccatgccctgttcagaattccctggagtcagcaggatctacaatgaggaaggagagaggtgggtcagccaagatggccgaataggaagagctccagttacagctcccagcacgagtgacgcagaagacgggtgatttccgcattttcatctgagtcaaagaaaggggtgacagatggcacctggaaaatc

SEQ ID NO: 480233 - DNA, 589 bp, Homo sapiens
ctgcctccatctccgcattgccttctcctctgtatgtgtcttcatgtgtctttttctgtcttttgtcatctgcaagctgaggagccaagtccctaaacctcaaaagtgtggaaaccaacagtgcagccttcagtctgtggctgaaggccggagagcccctggaaaaccactagactctatgtacctgcaaattgctactggtctgagggcttatactcaatttcgacaacatatcatgcaaatggaaggcaaggctcttgtaagtctccccaataattcaggcagcagagtttttaaggacaagttggtgagtggggggacgccagtgagtggggaagggattggtcaggaattaaatcatagggagttgaagctgtcttcttgtgctgagtcagttcctgttcagggtccacaagtagaggagtgggtgttagcaactagcatcatggcttgtgctgagaacctgtccttcttttggtgccatttttagtgggtgcttggttgtattcaaaataaatttttttgtacatttaaaaaatttaatttacttttattttaagttccacgatacatgtgcagaatgttcagg

SEQ ID NO: 480234 - DNA, 488 bp, Homo sapiens
tttccaacagcagttgtggtgtcctgtttagaggggagattgagaggaaacggctacctggggtccagtgatgtttaacatggcagctccatcttcccttttgtttgccaaccacatgtgtgacttccagcctccaggactctcggagagtaaatgtgtatgtttacaagccatccagttgcaatgtggacacaggcacacacagaaggatgaccctgtgaggacacggggagaagatgatgtctacaagccaaggagagaggcctcaggaggagccaactgtggcaacatcttgatcttggacttccagcctgcagggctaaaagctgaaaattctaagaatcagagctcttctacccctccaaaagaatgcatctccttgctagcaacagaacaaagctggatggagaatgtctttgatgagctgacagaagaaggcttcagacaaccaaacttctccgagataaagaaggaagtttgaacccatc

SEQ ID NO: 480235 - DNA, 1456 bp, Homo sapiens
tgcaactcactctcaaccacgagtgtatattattcccaaagtcagccaagatgccaaaatttctacatgacagagtgagactccatctcaaaagaagaaagaaggaaagaaagaaagaaaggaacgaaggaaggaaggaaggaaggaaggaaggaaggaaggaaggaaggaagaaagaaagagaaagaaagaaaaaagagggagggagggaaggaggaaggaaggaaagagagagagagggagagagaacggaagaaagaaagaaagaaagaaagaaagaaagaaagaaagaaagaaagaaagaaagaaagaaagaaagaaagaaaggtagaaagaaagaaagaaagaaagaaagaaagaaagaaagaaagaaagaaagaaagaaagagaaagaaagaaagaaagaaaaagaaagaaagaaaaagaaaggaaagttttgccaggagaagctgtccttcacacaccagatgtgactttactattttattttaattgtttcaaaatatgtttagctttttaaatttttttcagcaataaattcagcagtcataatacctatattagattgtgagttaaccttcaatgcattatgcaattatattgcataaagaaaaccatctcatacattaaattgctctgggaatgggtgtaattaggctttacatatgaagagtgaaggagcatagagaaggtgctacccaggggaattccagtgggtctttgccaagagatgcataagggaacagccacaggaatagtagtgtgtgttgtgaggggtccaattataggggaattagagttaatataaggagaaaggttttttaatgaaatatcattttatctcatttaccagttttctgaatggatttagagtgtgtttctttactgctaagtttggagtattcttttttcttaattaccagttggttttcatacatgtctgccaatctataattggccttttcgtcttgtgaataagagtgtttgtacaccaatcaaaggtaggtttggtcttttcacatagtccgatatttcctgcaggctttgttcatttcttttcactctttttttccgtaatcttgtcttcttgctttatttcattaatttgatgttccatcactgatatcctttcttttgcttgatgaaatcagctattgaagcttgcatatgctgcacgaatttcttgtgctgtcattttaactccatcaggtcatctgtgttcttttctacactggttattctagttagccattcatctaaccttgtttcaaggtttagtttccttacaacgggttagaacatgctcctttagctcagagaagtttgttattacccacattttgaagcctacttctgtcaactcgtcaaactcaacctctgtccagttttgttcctttgctggcaaggagttgcgaatctttggaggggaagaggattcggttttttggaatttttc

SEQ ID NO: 480236 - DNA, 635 bp, Homo sapiens
tatgcattttgaatgttgaacaagaacaatgaagggcaatattttcaagggtattttaaatgtgttagtctttgccaatgtgatgagtgacaacagattctgttatgtcatccttatctacaattatagcccatttatcaattctatggttttctactttagcaatctctctgtctctgtctctctatctccatctttatttttaacctttttttctcttgaagttttaagatggagtcaaagatttatatttgaatctatcagtttaatatatttttcactttttcatccattaaattttatctgtgtattaagatcatttcttctgcttcctaagaaaaaattttcaaatatatatgcctttaaaaaattacataattataatttatcacactgcaacatagatggacctggagggcattatcttaagggaaataacttagaaacaggaagtcaaatgccacattttctcatttctaagagggaactaaataatgtgtacagctgaacatagagtgtgaaataatagacattggagactgggaaggataggaaagtgagaagggggtgaaggatgagaaattatgaaatgagtgtaatgtacattgttcaggtgaggaatatgctaaaagccc

SEQ ID NO: 480237 - DNA, 714 bp, Homo sapiens
ctgctctcactgtatacatcaggttactgagcctactacttggcatgggatggcttgtggggataccggacccggttttacatgatcaaccaaatcatatggttacaagctatcttagaaataatcactaataaaactgacagagccttgactattctggcccagcaagaaactcagatgagaaatgctatcaatcaaaatagattggctcttgactacttgccagcagctgaaggaggcatctgtgggaaatttaactttactaattgctgtctacacattgatgatcaagggcaagtagtcgaagacatagtcagagaaataacaaaactggcacatgtgcccttgcaagtggggcatggatttgatcctggggccatgtttggaaaatggttcctagtgctaggaggatttaaaactcttataataaagagttatcataatattgtatggaaaggcactgtgaaaattcctgtcctgttctgttccattctcattactggtgcatgcagcccccagtcacgtaccccctactcgctcaatggatcacgaccctctcacgtggaccccttagagttgtaagcgcttaagaggacaggaattgctcactcagagagctcggtttttaagatgtgagtcttgctgatgctcccagcagaaaaaaagcccttccttctttaacttggtgtctgagaggttttgtctgcaactcgt

SEQ ID NO: 480238 - DNA, 600 bp, Homo sapiens
aaccacaccagagggtggaacgactactctgctaagtagtatgtcaaccaaaccaaattgtaagacaaggacatgcaatcctttaaattttactgtcttaaagccagagctacctttttggtctacaggacagacagcactattacgagttgatagacaagcagcaggccttggagttccattactgattgtcaaaaagactagaaggactcaaatgcatccaaacctgcaattccaggttgataagtcattctataagcagtttgatcagtcagtgcctgagcttcccccatcaaccaaaaacttatttgctcaaagtgaaaacaaaactgacagcttaagaatttctaataatggccgagctgtcatgaaaatcacagctagaatgcacaagctggcccatgtccctgttcagacttggagtaatcagtccactatagaggcaatagtaacctgacacactaccaagcaattgatggcatcaaacaaatatcagtcattgcctgtagaataagaagctcagctccatgaagaggtggcaaacagtggtgctttcaattaacacctttgttataaaaagcaccaaaggggggaatggaa

SEQ ID NO: 480239 - DNA, 1072 bp, Homo sapiens
tcaggaaaggttgtcatcaacctgccagacactgctgaaaagggatgactgagggatgtgagaaagctgcagaagaaaaatctgaatctagcagaagttcatgacgtttaaggaaacaagccatcttcataacataaaaatgcagggtgaagcagcaagtgctgatggaaaggccgcagcaagttatccaggagagctagctaagatcaccaatgaaagtggctacactaaacagattttcaatgtagacaaaacagccttctattggaagaaaatgccacccatgactttcagagctagagagaagtcaatgcctggcttgaaagcttcaaaagacaggcagaattttgtgttagggcttaatgcagatggtgactttaagtcaatgctaacgctcatttacaattctgaaaatcctagtgcccttaaaaatgttgctaaatcttctctccctgggctttgtgaatgcaacagcaaagcttggatgacagtatatctgtttacagtactgtttaccaaatatcttaagcccactattaacaattactgctctgaaacacaaatttctttcaaaatatttctgccttctgacagtgtgcctggtcacccaagagctctgatggagatgtacaaggagattcatattgtttttagacctgctaacacagtgtctattctgcagcccatggattcaggagtaaattcaactttcaagtcttattacttaagatatgagtttcttaaggctacagctgccatagatagtgattcccctgattcatctaggaaaagtaaatggaaaacattctggaaaggatttagcactccagatgtcattcacaaccttcatgatccatgggaaaagacgacaatatcaacattaacaggagtttctaaaaagttgattccaatcctcatggatgactttgagggattcaagacttcagtgcaggaagtaactgcagacgtgttggaaatagcaagagaactagaattagacgtgaaacctggagatttgactaaattgctgcaatctcaggataaaacctgaactgatgacacattgcttctt

SEQ ID NO: 480240 - DNA, 517 bp, Homo sapiens
agcgaggaaaaagacaaaaaacagccccctccctccaggacctgcgaggggtccgtgtgcccataatggatacaactggggatgccagcatcttgggcctctacagtgtcttgcaccacattcaccaggaggggtgcccactggccctgcccactgaagcttctctccttgagtccctgcaagaagagctcctctccctggcggaggtgaaagctgagggcataagcaggcttatccttgcaggaggagctcctccccttggtggaggtgtgggcacacccaggtccctccctgcaggaggagcttcttccactgatggaggggatcgccaggataaaattaaggtgccagctactttgtgttctccccgagcctcccgatgctattccaaattcagtgcgtgttggtggaattcagttcttcgtggttctgggactgaggttcccacattcttgctgctgaaagtccttggccattagtgatttctaggtctatggacctcacaggaagtttacat

SEQ ID NO: 480241 - DNA, 1232 bp, Homo sapiens
agctctgttagaagccgtgggtcatggaagagaaccgcggaacccagcgacaagtgaacacagtggataccctgctggatctgtgggggcggaagtcagcagcaggtctgcgatggtggcaaacaacagtggtgaacagcaagcaaaagctcagctaaagcaagctcaaacactgtgcttggagaaccgctgctctcttcagagctgtcagacagggatgtttaagtcttcaaaagtttctgctgccttttgttctgctatgccctgccctgagaggtggagtctactgaagcaggcaggtctccttgagctgcggtgggctttacccagtttgagcttcccagatgctttgtttacttactcaagcctcagcaatggcagatgccccacccccagccagactgccgcctcacagttcaatctcggactgctggctagcagtgagcaaggctctgtgggggtgcgacccactgagccagaagctgagagccatgcagcatcaaggccgaacatcatcctggtcatggttgacgaccttggcattggagatcctgggtgctatgggaacaggactctcaggttggaaaggcagctcctcagtaaacacataaatcataatgttgaagaaaatcttctccacaagacatagccaaatgtgtctcactttcaacctgaacctttgcataacattgctttttacttttttaaaattagattgacctatgatgttgcttaaattttaaaaagcatatgcaaagataagatctcagttttaagagagcacttttaattaattatctatgtgtgttttctgcctcaccttttgcctgcatttttaaaacttttacagattactttttacatctgtgatatagatctttttaatttagtttttcttaccagtgtcacaattttattcagttttttattttatctttttttaactttatgtattcctaaggtgtattgagataatagataactgttcctaccaagatgtcttaattaaaaagttagagccaagtctttaaagttaactctttaccaattatcaaaagaaaaaatgtctaaaagtcccatggaagaattgatagcaatatcaaccctagatctgtcttgggctctatgttagagtcccgttttttctgagttacatttctcatattatagtttgtaatatcacaccccaaaatagtcatttttttccatgggccagtatagacactaggagg

SEQ ID NO: 480242 - DNA, 1239 bp, Homo sapiens
tggctttaggtctaacatttaaatctttaatcaatcttgaattaattgtagtatgtggttttggtgtggatgtcccttctgtttgttagttttccttctaatagtcaggaccctcagctgcaggtctgttggatttgctggaagtccattccagatgctgtttgcctgggtatcagcatcagaggctgcagaacagtgaatattgctgaagagaaaatgttgctgcctgatcgttcctctggaaggttcatctcaggggggtatctggctgtactgactcagtgctcaactcatttccctggactgactcagcaggtcctcaactgtgtgccctggactgtgtggtactggactacttcttggattgagtcagtcatggactgtgttttccagaccatgggcatctttggctgtcatccaccctcatcaactgttttccttggagtgactatgtctttcactattttccacagtgggggcatcttcatgccatcctgttatcagtgctttccgtagactggttctggatctctggaaatgttttactgatctctggaatgactcacgagcactaatgtcactgaatgattgagaatggatataactattgccttcagggttagctctacatctttgtaaaagtatgtggtcatgctcaaagccagttgcaacattccatctgtagatagccctttctcaatatctggaccataaagctttagaaatgctctgcctaaaatatcaacccaggagtaaggaataccataaattttcaacccaccaattcagagtatgacaatttcttccatttagtctcttgagtgacttgactcctggatcaatactcagttattcattttttattgccatatacttctcaccctgttaatatccatgtgtataggcaatatacaatgaccttaggatgctaggaagaaaggagtcttaaaatcctgtgggtgctatgaatccttactgttctataccacagagggacctgtagagtctggttcctggactggcttagatctttccaatctatcctgctgggggaatgtgccagtattctatcctgaagctcacagccccagccaagtatcactagtttccaaatttgcatatagcaactttcccttccatattgatctcctagtcatcattcctgtgtctccacattcacatatacatcaagtttccagtccactatatgtcatagaatagctcaagtgagctataatt

SEQ ID NO: 480243 - DNA, 638 bp, Homo sapiens
ggaatccaggtgggtctactgagtcataagacatccacaaagcccaccactcacgggcagccacagatcatagcgccaatggcgccacccttggccactgcctatcaggagcttaaaagatacacaagtggtaatgatgattgtgatgtagatggtgatgatggtgatggtgatgaagatgattgtgatgatgacggtgatgatgattgtggtggtgatcatggtgatggtggtgatgatgatggtaatggcaatgatgatgataatggtgatgataatgatggtgatgattttggtgatggtgatgattgtgatgataatggtgatggtgaagttggtgacagggatgataatgatgaagacgacggtaatgatgttggtgatgatggtgatggcaatgagggtaatgatgtttctgatggtgatggcaatgttggtaatgatgattgtgatgatgacgatagtgatggtgatgatgatgatgatggggatgatggtaatatgatggcaatagggggagtgatgatgacaataatgatagtgtaatgaccaataggcagacatcctatattcagtataaaagcagagttcagatattagcagacttccatggttaacttttttacctgagggtgggt

SEQ ID NO: 480244 - DNA, 2263 bp, Homo sapiens
cctgcagttaacaatgcagtatggtgcatttaaaaatatgtaaagagaatatatctcattctaagtgttattaccacaaaatatctgcagatcaactgcaagaagaaaccagcaatcctgagaggacctacacaccttctgaaggaagtggactgcttttgcaggactggggagacaactcaaatactgtgagtgccccaactgtggaagtggcaaagagacagaccttcctatgtgacccaccctcaggtaaaaaagttaaccatggaagtctgctaatatctgaactctgcttttatactgaatataggatgtctgcctattggtcattacactatcattattgtcatcatcactccccctattgccatcatattaccatcatccccatcatcatcatcatcaccatcactatcgtcatcatcacaatcatcattaccaacattgccatcaccatcagaaacatcattaccctcattgccatcaccatcatcaccaacatcattaccgtcgtcttcatcattatcatccctgtcaccaacttcaccatcaccattatcatcacaatcatcaccatcaccaaaatcatcaccatcattatcatcaccattatcatcatcattgccattaccatcatcatcatcaccaccatcaccatgatcaccaccacaatcatcatcaccgtcatcatcacaatcatcttcatcaccatcaccatcatcaccatctacatcacaatcatcattaccacttgtgtatcttttactgttgaccaagtactttcctatgttttcttacttgaaatgaattttatgaatttctgtcttcaggaaatcgtctgcaaaatgaatagacaagttgaaactgaaacacaagccatgaacaagagttaagtgcttaaatatcttgcagtaaacagtacttaagtccttgatatgctacagaaaaatgctggaaagggcagatgaagcatgttagcattggaaaaaaaagctagagctatcagaagtaaacttcttggagaagtagaccctgagatccattcaccgatccagaaaataatttttgagtgcctgttttattttgtgcagtagttgtgaggggctgcaaagatacgtgagtaaaaagcttcatctacaagagaaacatgcaagctaatgaggaagaaagataagcaaataatgtgattatagtcttacccaggcttcccttaacagtggtgggaaaagcttgtgggtggataatttaggtaagaatgtagttccagaaagaaggcgtctagaacaaaggaaataaaatagagaacacccagtacaatgatgcttcattgactcatccacctccagaatagcacatgttcaatcctgtcagggaccttctgaaaagcctctgaaatacaccttaaaattgtctatctgagacatcaaaggggtaaaccacttattttacagctcctgataggcagtggccaagggtggcgccattggcgctatgatctgtggctgcccgtgagtggtgggctttgtggatgtcttatgctatgtcagagaaaccctaagccaagcagcatggaagactgttgtccagttatactcggataaagcaccacacagaagtgacagtgtaagtgttggagaagaaaggatattgaggaacataaaagatgtcaatacaacaactctacaaaagtcttccttccataccctaataatagcaaaatctaaaacaaatgtatatgctttgatagagcaaataactctcacatttatttaataaattttgaaatttagtttcattttgccttgacaggtgaccacacaataactactaattctctaagataagaatattttctctagctttctaagaattggaatgttatgaaattaaccattcattttgtttgtgtactctacagtttactttcaaaataagcaaatctgtgacatatgcccttacaacgtttcataccaattcttaaataaaatataatttgagtttcgcagtgaagttttatatacatttttaaataataatttgagtttcacaacactgaagtgagaatttttagtgttttctaagataagtattctttacttcttaaaacatcacctttatatttcaactcagaaacatgtctttaaataatataagattatcttgcagggagaaatatgttctacattttgtaggaaggtagcacctgaaatacattctcccaaaaggaaggaagaaaggactgacaagagaaagtggttattcc

SEQ ID NO: 480245 - DNA, 886 bp, Homo sapiens
cagtgcactccgagtgcactagtgatgactagtcttcagtctcaatgtactctttctgatgatgaagaagaatctaatttctccttgttttctccccaagaggaggaacatggtgatgatcccctccctccacctcctatcatggaacctgtatatgttaactcttcttctactaagctgttgccccctctgccagaggaggacgtgtgtcattcttctgaatggtctgtttctcattcctctcatccttttggaccactcccctcttttaagcccactgtttcttttgacgctccgggaccccttctttcagagacgtggaaccctgcttccccccactccacatcctggagctcccactctccttctctctcttcttctgcccctgctagacctgtccgcacttctattcaggaggcaatgtgtagagctatggcttctagtggtttggatgtctggcagctccccatagccatagcctctaagtgtgaaggtgcaggagggtggggaaaaggcacagctaaaggccggtgatattatgaatctttctctgtacaactccttaaggattttaaagctgcttgtgatcaatatggaccaaattctccttatgttaaaactgttctacattcccttaccactgaaaaacaacttgttcctattgactggaatttgttagctcatgcttctcttaccccttcttgattcctacaatttaagatattgtggtcagaagaggccatgattcaaacttcgataaattttgaaaatgagactgaagtgccttatgatatgcttatgggtactagtgatttgtggaatatacttgctcgacaattggaatatagtcaacgtattttaactcaggtaactcaagtgtgtttac

SEQ ID NO: 480246 - DNA, 1441 bp, Homo sapiens
aagaaaaagtatttacttccataatagaggagccaagatggccgaataggaacacctcctgtctagagctcccagcatgagcaacgcagaagatgggtgatttctgcatttccatctgagttaccaggttcatctcactagagagttccagacagtgggcacaggtcagtgggtgcacacaccgtgtgcaagccaaagaagtgtgaggcattgcctcactcaggaaatgaagggggtcagggagttccctttcctagtcaaagaaaggggtgacagatggcacctggaagatcaggtcactcccacctgaatactgcgcttttccaatgggctcaaaaaatggcacaccaggagattgtgtcccgcacctggctgggaggaacctatgcccacggagtctcactgattgctagcacagcagtctcagatcaaactgcaagacggcaatgaggctggggtaggggcgcccgtcattgcccaggcttgcttaggtaaacaaagcagccaggaagctcgaactgggtggagcccaccacagctcaaggaggcctgcctgcctctgtaggctccacctctgggggaagggcacagacaaacaaaaagacagcagtaacctctgcagacttaagtgtccctgtctgacagctttgaagagagcagtggttctcccagcatgcagctggagatctgagaatgggcagactgcctccttaagtgtgtccctgaaccctgaccccagagcagcttaactaggagacaccacctagcaggggcagactgacacctcacacggccaggtactccaacagacatgcagctgagggtcctgtcttttagaaggaaaactaacaaacacaagggacatccacaccaaaaacccatctgtacatcaccatcatcaaagacaaaaagtagataaaaccacaaagatggggaaaaaacagagcagaaaaactggaaactctaaaaagcagagtgcctctcttcctccaaaggaacgcaaagaatgtataactagaataaccaatgcagagaagtgcctaaaggagctgatggagctgaaagccaaggctcgagaactacatgaagaatgcagaagactcaggagccaatgcaatcaactggaagaaaggaatttcatatccagccaaactaagttcataagtgaaggagaaataagatcctttacagacaagcaaatgctgagagattttgtcaccaccaggcctgccataaaagagctcctgaaggaagcgctaaacatggaaaggaacaactggtaccagccgctgcaaaatcatgccaaaatgaaacccatctcacgtgcagatacacaaataggctcaaaataaagtgatggaggaagatctaccaagcaaatggaaaacaaaaaaaggcaagggttgcaatcctagtctctgataaaacagactttaaacca

SEQ ID NO: 480247 - DNA, 1961 bp, Homo sapiens
aggggcagaagctctcctgcaacccaggaagcagtcggcaaaagcagctcctcctgagttaattgctaccctgtcttttctctcacttcactttctctctctctctctctcctctctcctcactctctttcctctctcctctctctcttttctctctccctctccctctccctccctctctccccctcccctcatgcagcttcagctgaagaggagctttgctgattccctccagaacatccaacaacatacactaatccagatccagctggttttcttctacttctaccttaaatcctacccctccctgtgtcaagcttgcaactctcataaagtctttctgcttaataaaaatgtgccctgggcctctccttcctccaaaattccttttgaccctgcagatgaacccactctgtattattatccccctgcatctgctcctcatctgtctgaaccctctgccatggtggcccttcctgcctccaagccttcagccccaaactccactcctcctccttctccacctgttacccattcaaaaaccacctctgccattctctctctgggagttaaaggcaatacttgcattcgtgtccatttctccacatctgagttgctgcagatcaaagctgtcctggaagccattttcatagccctgttcttaaagggcctcaccagaattccactattctaattgggaaattagcagaaaaaaaaatcttatatccactgaatcttcttttggttgtccatgtggctatgtatgtgttatctgtgcaatatctattaaaagagctctaattaattggcctaagaaaaataagcacttaaatatttttaaggaaaaggtttaagcaattttggaacattaattgtaaagaaaattctgtgtgtaaacatattggctaaagttaaaggggtatcatccagtttttctgtaaattgagcattaaaagcacaacaggtttttctaacctgttctttaacaaaattataaagggttaaaaatagtctataaaaatcttacttcatggtcagacattaatattgggtaaatgcatataaaggttttattagaaattgagtttaacattaatagcacactaatataaaggtaaaatctggcttatttggtataaaatcacacaggaaacattgtagaatataaaatgatgtttggctttctttgggctatttttgtataaatacgttttggtatgtgtcccaaacttatggagactcctataattctgatacatcttactgggaattatcagtattaattataattgttatgttaaaattattgtgtgccacagaggtagcagatatccttgtcacttgtgtctttaactatggctatcctacaactttttgttatccataaacaattgttgtcttgttttggtactctttaaaaggtggtttaatagttagctgtgaagttctaacaggtgctcttcaatgcaggtttctgataattttggagaatgtaacatcagaatagaagaaaaactttcaggactttgaagagctaaaatgttaattaatatcaagcaggacaggaattaactgcatgaattttactaatgggagactgaagtaatctttttaatgctttgctaatcctttattttgctttccaaagtcaaaaaaaattttttgggctattaatagcttttaacaatttagtatattcccataaacaaaatttggagcaactttttctctctacctgattttctcttgaatttggagactatctgtgagtatttttaagttatggtaatacagttatttgcatacatgcaatatggatctgttttcatttgcaacgggacacaattggagaaactggttattgtaccaagactttgactgaaattgtgtgctttccttaaaggcatcaaacttggctttatgaagctaataaagcctttggaaaacttgcctaatatttc

SEQ ID NO: 480248 - DNA, 580 bp, Homo sapiens
gtcacacaaatgaattgaaggaggtaaatgtggggattttattgatgatgaaagtggctctcagcgggaagagagatgaaacagtgacagagagggaaagtaatcttcccctggggacagttggactcctcaccaaagctacactgtcaagctgtccctgtgaagtcaagctgcatctctctgatggtcatgggtgcaactggctggggccagcatcatgggccataaatgaatttaccaagacagttgtggataaagaagaaggcagaagaggctcgggcagatgctccaggaggtatccagaagaaggcattattatcatgggacaggacagctccatgcatgttattgcccctgaataccttccagtggaacaagatgtagaggtggaagacaatggtatagatgttcctgattctcaggatataggacataagaggaagaacaagttaattccagactaaataaattactttgttttctactgatccaggtaccactgaaaacaaatttttaagcatatttttgcgaacccaaaggtatctgagagaggactcaatcagtttagaaagttaatttc

SEQ ID NO: 480249 - DNA, 503 bp, Homo sapiens
ctaagaaactggacccctggaccctgtggcctccaggtggccaagatgtctgcgagccatagcagccacagcaagcctggttcaggaggcaaaaataaatgcattaacatctacactgacagcagatatacgtttgctactgtccatgtacacagagccatctatcaggagcatgggctactcacctcagaaggaaaaactatcaaaaataaagaagaaattttggccttgcttgaagctgtttggttccctcaacaggtggctgtaattcactgcgaaggacaacaaaaagaagatatggtcattgcttgtggtaaccaaagagcagattctgcagctaaaaagacagctcagtttccagtcatgcctttgactctgctgccctctatatcctttctgcagcctgactttcgagaccacccagaatactccctagaggaggaaaaagaggcttcagatcttcaggccagtaaaaatcaggaaggttggtgaattcttcctga

SEQ ID NO: 480250 - DNA, 699 bp, Homo sapiens
gttatcagttaaacaggaacgggccattttcacttcttttgtaattcttcagttgcttcaggtcatctggatgtatacgtgtaggcttagactcagaggcctgacatgacttgcatcaggaatgatgtctcttgtgcccctttattcagatgggtttttggtgtgggtgtcctttctgtttgttagttttccctctaacagacaggaccctcagctgcaggtctgttggagtttgctagaggtccactccagaccctgtttgcctgggtatcagcagccatggctgcagaacagtggtggcagtagaacagtggatatttgtgaaccgcaaatgctgctgcctgatcgttcccctggaagttttgtctcagaggagtacccggccgtgacttggcgagtttgggatggaaagactgcgagagctcaggaattggagagcagcctgcacaacatggtaaatccctgtctctaccaaaaatacaaaaattatataggcatcacagtgcatgcctgtggtcccagctactggagacagcggctgaggtagaacaggagacaggactgttgttattaatgagaatactactactgaactggtacaattgtagacaaaaagcccagggaatttgtggtattgctagcttcaggaaaatttttaaacatcatttaggactgttaagtccatatgtaaaatgctat

SEQ ID NO: 480251 - DNA, 781 bp, Homo sapiens
gagtttgaaaggcggtatctgatttcagaagccttttcctgtaaacaccgggtggcaactcatactatcgctgactgaacccacaatggtccctggatactgctgattggaatagttgcactcaccgatgcagcagcagaaacacctcttgccaatgaacccgcaatggtccctgggccctgctgattggaatagttgcacacaccaacgcagcagtggaaacacctcttgcccaagaacccacaacagtccctatgccctgctgatcggaatagttgtgctcactggcacagaggcagaaacactagttttcctcctagaccacaaggaggatcgaggaagaatctcttatctcctcacagaagaagaaaagctcactgaccctgtggggttggaccttatgggagaaacccagtggaaccaccaaaaaggtgaagtaggaaaggcagaagggaaccatccggcagatgatgaggccaaaattgcttccagttggaacctcccattggaaatacctacagaaggacccttgatatggaacaatcctgtccaagagattaagccccagtattccacgaatgaaacagaatggagactttcacaggggcatggttttctcccctcagggtggttaatgacagaagagagaaaggtacgaatactcaaagccagccaatgaaaaatactaagacccttcaccaaacttttcatatccatattgagaacactcatcaaatggccaaatccctatttacaggcccaaatctcctctggaccatcc

SEQ ID NO: 480252 - DNA, 748 bp, Homo sapiens
taaggggctgcaagtgaaggagccaaaatggagtctgtccacttctctcagccaagggagagtcaattcaggttaaaacaagaagctacgcagtctatggtattttcattattgcagcccaaagtggatgagacacttgacgtcccttcaatcaatttcacgtggaatctccttgatactctcctaacagaagagaaatgcacagaacttgaaaataattttggaagtccaagttcatcaagatgtcaacctggtttctggagagagctctcttcctggtttgttgatggtcagtttctcactctaagttcacatagtatagctgcccagtgggttcaccttgcccgctgcctaaagagagccaatttctcaagacaggggacttacaatagagaaagagtattttatgcagagctggctgtatgggaaactgaagttttattattactgaaattagtctccctgagcatttggggatcagagtatttaaggataatttggtgggtagtgcagcagtgagtcaagagtgctgattggtgggattggagatgaaatcatgggaagtcgtggccatcgtcttgtgctgagtcatttcctgggtgggggccacaacgtcaggtgagccagtttatcagtctgggtggttccagctgatcaatcaagtgtaggctctgcaaaatatctcgagcattggtcttaggagcattttagagaaggtcagaatcttgtagttttcagctgattagtc

SEQ ID NO: 480253 - DNA, 703 bp, Homo sapiens
aattcacttctcagataattcttctgaaattccatgacttagcaaattctttcattcatgtggagccctcatcacacaaatagctctccaaggccatatccatcaaccttgtcacatagaggattatgctttaatatgagttttggagcagacaaatattcaaaacatagtggatttgaaaatagtgatgatgtttgcacagcactggggaggagaaaaagaggaaaaaggtgtaactctcattccgaggctaaaggcctgaggacctgtgagatcaattttgaaaatcttggaaccagggaagctgatggtataattctcattctgaggacaaaggctagaggacctgtggagcaccctcatcttttttgtccatatggtatgagtgattgccccaacggtactgattttgtggaagacaatttttccatggatctgtgggtggagtgtagatggtttcaggctgaaactgctccacctaagatcatcaggtgttagattctcataaagagtgcacaaaccagatccctctcatgtaccagtcaatggccttggggtttggaatgtttttgtgtggaggagaaatttattgtggggttggaatgtctctggttggaggggagattattgcgagtctgtcacgtctctagtcgaggaggggtttaactcagatttggaatgtctctgatcagagatgtcattt

SEQ ID NO: 480254 - DNA, 704 bp, Homo sapiens
tatcaactcccagggatctccagaaggacaactccgggtacataatgttgactggtttggatgggaaggaagatggcaccaatgagaagaaagtggatgctctttttagcatcaaccaggcttcctctgatctttgcaaccttcttattgtagtaattgatgatggtgatgatggtgacagtgatgttgatgatggtgatgatgacggttataatgacgatagtgatggtgatgatggtaatgatggtgatgctcatggtagtgactatgatgttaatggtgatggtgatgatggtggtggtgatatcaattacggttatggtaatgataataatggcagtgatgatggtaataacgataatgataatgttgatgatcatgatggtggtgctggtgataatgatagtaatgatggggatggtgatgatggtggtgatggtgatggtaatggtaatgataattatgatgatgataataacaatggcaatgggatgataatgatgatgatgatggtgacaatgttggtaatgataatgataaaaatgagatgatgcttttatctatgtttcatttatttatttaaaattttaacaagcttttaggaagtattctgcactaagatttttagcaacttaaaacaccccatgcacaagtctaaaatctttttaaggaagcaaaatgtctgctgggctctgtggcttatg

SEQ ID NO: 480255 - DNA, 1132 bp, Homo sapiens
gaagaggcacaagagcgagtgagggctgctagcacgttgtcacctttcattaggctagaggcggcatgatctccttttgcctgatgacagcttcctgcagaatctccttttttaaaaaggccagctttggagcttatattattggtcatgttggctatgtcactttccccctccctcctaagggacaaccatggaggaatccattgtttgctgaaaattttagcatgggattcacagacactacttttgttttagataaaagcaggcagaggaaggtggaagaactagactggctgagttttctggcctccatctttctcccatgctggatgcttcatggcctcaaacatcaggctacaagcttttggacttttgaacttacaccagtggtttgccaggggctctcaggcccttggccacagaccgaaggctgcactgttggcttccctacttttgagatttttgggattcagaatggcttctttgctcctccgcttgcagatggcttattgtgggatttcaccttgtgattattcagaaaatatgatttaattcacgagcatgatgttgtaatcaagaccacattagaatcccagggttagctcttaccctgtttgtcaccatgggcaaaccaagatgtccaagatctctcatctgaaaggtgaaaataaaaaatatgtcctacatagctctttcagttattatgaatataaaatgactgattgcgtatgtgatggctttataaattataaagtgctatgatatgtaagactcttgaattgactccaaaatgtatgagtggagcatgtcttctcttttctcctaatttatttggatttccttgtccattatccctggactgtttgctcctcaactttttaggctaccaaaagaaagtcctaaagttggtagaactagcttttcctaacttgtccctggaggtgctggagaaaagcagcatggcaaatggtggtaaccttaagttatgacaatgacccctaagcagctatcaacttcatatgctttctcacttccttcaaaatataatattttcagagaggtattcctaaaccagtttctacaaaaacaatctccgtgagttgctattcttaatattgctgttcttctttcc

SEQ ID NO: 480256 - DNA, 1657 bp, Homo sapiens
taattcacagccgtggcacaggaagtgtgcattgcacaggaaagaaacaggaaaaaaggaatggaatgtatgtcctgcacaggggtgaagcagggggtctgtcctccacagggaagaaacaggaagtgtttcatgcacaggggagacacaggaagtgtgtcaaagtgcactcaatagagaaacaggaagtgtgtcatgcacatggaagtaacagaaaatgtgtcactcacagaggagggacaaaaaatgtatgctacacaggaaagagagaggaagtatgttccccacaggggagacacaggaagtttgtcctgcacactggggaaacaagaagtttgtcaggtacagtaaaggaacagaaagtgtgtgctacacagaggagagacaggaagggtgtcattcccaggggaagcacaggaagtgtgtcttgcataggggagaaacagaaagtgtgtcatgcacagaagagaaacaggaagtgtatactgcacacccagggaaagaaagtgtgtcctgcacaggggagagtcaggaagtgtgtccttcacagacaagcaggaagtgtgtcatgcacaggagaggcccaggaagtgtcaaaacaatgcaaccagttttgtctcacttagcggtgacccagaagccccctctctgctttgagttctctctgtctttctagacaggaccaatgtacttcttacatacattgattgatgtctcatgtctccctaaaatgtataaaatcaagctgttccccaaccccactgattttacattatagtgagttgtatagttatttcattgtctattactatgtaataataatagaaatacagtgcacaatcaatgtaatgtgactgaatcattctgaagccatcaccctcctctccccatcctggtccatggaaaaattgtcttccacaaaaccggttcctggtgccaaaaaggttggggattgctgctttaaaagttcataatgtacgtgttttataactcagacattctgatcatggttatttatccaaaatatatacaagcacttacccaatcaaagtcatgtatacaagtataaataacagttttatttttattagcaaaaacctggggacaacctgaaaccccatcaagagttgaatggataaacaaactctactgtatacatacagtgaaatacaatccagaaattaaaaagaataaaaactaccaatacataaaacaacactgattaacttcaaaataattttattgagtaacactataaaataaaaaagaatgtgtaagacaccatagcatttatgtaaaattctagaaagtaaaatctgtagtggagggaaaaattttaagggaacatgaaagaatatggggaattaacggatatgcttattttcttaatagtgctgaaggttcaatgtacagatgtgtcgaaatgttatcaaaagtacagattttaaacacccatgcagttgtttatgcctcagttatataactgaaaatatagtgggttcagtgtaatttctactttgatggtgcttggaaaaagggcatttataaccaacccaacaagcatagttactgtttcaaaggagaagcgttatcacttcctcattagggaatttgtgttatcacaagtaaaaatatttcatcataaaaatgtataatt

SEQ ID NO: 480257 - DNA, 674 bp, Homo sapiens
gcacagaagaggaacagaaagttcatcctgcccagaggagtaacaggagaaagtgtgtcctgcacaggcatggaacagaaagtgtgtgcttcaccatggagaaacaggaggagtgtcgggaacaggaaacaccggaagtgtatcctgtaaagtggaagaatagaaagtgtgtgctgcacggaggtgaaagaggaagtatatctctcacaggggagaaaaaggaagtgtgtcttgcactggggagatggaggaactgtgtactacacagtggagacacaggaagtgtatctagcacacaggaggaacaaaaagtgtgtgctgctcaggagagaaacagagtgacatatttcctgtgtctcctctgtaagggccacacttcctttttctcccctgtgcagcacacactttctgttttcccctgtgtgggacatacttcctgtgtctctcctgtgtgggacatacttcctgtttcgtctctgcaagacgcacttactgtattgcccctgtggtagaagagtgtcctgcacagtggagacacagggagcatgtcctgcacaggggagaaacagaaagtgtgtgctgtataagggagaaaccagaagtgtgttatctgcagtggtgacacaggttgtgtgtcctacataggggacaaacagaaaatgtgtccttaacag

SEQ ID NO: 480258 - DNA, 903 bp, Homo sapiens
ccctgactcacactgtccagcagtgggtgtgaccctcaccatctctgccagaaatcactgcatgagcaagggccaccagactggcatccagctgccagcccaaggcaaaaagtcagccatctgcaagtcaagaagagacttctcaccaatactgatacagacaggaggcaaagaaatactggcctcctggcagtattatacagtgatttactggcaaaagccccaccctcaagcctggaaatttgtgggactaaatgggaacaggcattcctgttttctctcccaaatgttgcctttttgcccaccgtacccccctatcctgaacccatatacaccccaaaccccgggctccatgagcagaattgcagaggagcagaagaatggtgtagaagagaaggagtgtctgaacattgaaagaagtttggctggggatgctccccatcatcccactgagagccacctccattgggcaatgaagtcccccacatttaccatcattcgatttgtccatgtgacctggattcttcctggacgctagacaagaacccagcattgctgttttcataagtgaaggactaatgaaatagtgtttgaagtttgcatattagcactgagaatttaaacattgaaattgttggaaatttgaagattggaaattatctaagagactgaggtgcaaaggcatacagaaataaatctaacaatattttcaaatttctgcttgtggttttacagatattcattttctggaagttggcaacctaaaagttggagaaaagtgtttctgaaagttctaggcaaaggcttggggtggataatttgcaaatatattctcctattctgtgcatcatcacttcacttcgttgattgtttcttttgctgtgcagaagctttttaacttga

SEQ ID NO: 480259 - DNA, 729 bp, Homo sapiens
aaggcacagcagctgtaggccaagatgaagtggaccaatctcctgtacaagacagaggatgtgatgatccaccacgatgattgcctgctgcaggaggccctgaagcccaaggagaatcacagcgcccagcagcacagcgagtgggagaagcgcaactcaggcgtggtagagaagatgcatcagtgccaagacctgctggcagcagaacctgcacaagaagaaggtggcccacatccagcaccgaatgctcagagcccacaagaactgtatcctgctgcaggacctggagcttgcaggcctagcaggagggcctggcctggcccagcctgggcctttcccatgttgggctgccatcttccatcttgtctgcagagtcaggaaggaggaacaacggtcactgccccttctcctcctgcctgtgttctcaggggccacaggactgaagagggtggcctttgttgccaggccacgttagtccacagctcgccagaaaggaggacaaccctgaggtgtgtgtaacttccatgaaacatttattaattagcaaactggatcaaaaggcagacttcatgtataggttgatattagtgcatcgaaagagaagggttaaattgacaattcaaaagctttggagaattaatgaatattttttatgaattgttgcataagaaattgtaccaaagttaagtaagaagaaaggtttattggtatcttgtgattctagtggtt

SEQ ID NO: 480260 - DNA, 1366 bp, Homo sapiens
ccatcaacgatagactggattaagcaaatggggcacatatacaccatggaacactatgcagccatgagaaaggatgagtgcatgtcctttctagggacatggatgaagctggaaaccatcattctgagcaaactatcacaaggacagaaaaccaaacaccgcatgttctcactcacagctggacacatgagtgaagtctttttaaaccctgtaccccagacaagccatcatttgaagcagctaaataaatgccccaatgtaaccacccaacgggttcaccttgccctcttactagacagagccaatttatcgacagggcaattgcagtggagaaagagtaattcacacagagctggttgtgtggaagaccagagttttaatattactcatatcagtctcccagagcattcagagattgaagtttttagggataattggactgagtatgagtaaagtggtcttcttgtgccagatggctatgtgtgaacttatttacattcacatctgttgtagacctaaaatcaataaagctgtaaatattctttaaaaaacatatttagggcttaggtcaatattagaagtaattatcacatattcttcaatttgtggagtttttggaataagccaaaatcctttaacacctaaaaaaggatagcatactaatgtattgataattaacactcagagtcaaatttctaagtaattttcatttctgtcagtattcattagaattaaattttactgtgtgcacaagccttaatctaatcagaaaatccattaaaaaaaaaaaaaaaaaacttctctgatcagtcatgggaagaaaaaatttggcatcattacccaaaaggcagcaaactgtatgaaatctaagacattgtttacactaaacttattttcatattccctggcactgcataattcaaaccccccctgtgctaaatgggatattttcatctttaacatgaagaggaaaaaatataaccttttaaaagcaaatattcagtcgatcttcagtctctgatatcctttcttccacttgattgattcggatattgatacttgtgtatgcttcacaaagttctcgtgctgtgttttccagctccattaggtcacttatgttcttctctaaattggctattctaattagcagttcatctaacctttcttcaaggttcttagcttccttgcattggtttagaacctgctccttttgctcaggggaggttgttattacccacctctgaagcctacttctgtcaattcttcaaactcattctgtatccagttttgttcccttgctggtgagggtttgtaatcctttggcagagaagaggcactctggtttttggaattttcaatcttttgc

SEQ ID NO: 480261 - DNA, 2602 bp, Homo sapiens
aagaaagaaagaaagaaagaaagaaagaaagaaagaaagaaagaaagaaagaaagaaagagaaagaaagaaagaaagagaaagagagaaagattagctagaccattataaatgagtgtgactgttgtgttctttcacattcacacatatacagaaatggatgaaaagaagactggccattctaatattgaaaactcctgtggaaagactttttgtttcagatatgaaatcaatatgaagccaccctatgtctttactactcaaagtgtggttctggaatcagcaacagcagccattgctgggggtggatttcattgccaaacctcaggccctgagtcagaatctgcttttctgcatgacctcaaaggagtgatcccaggccacttctctgtgtcacatttccacagctcagttcaccaagaggtggtaggtgggcaatggagtagtgaaataaatcttatacatgcctgtaatcccagcactttgggaggccaaggcgggtgggtcacaagataatctgtttactggcctttacaaataagaaaacaaaattaaatagaaaatcatataactagtgtggcttaataaactttggaactttttattcacctaggctttcctctcctgaaaagaactgtgtcttgcatcctgttccattagccctggtgtggtaatctgcagtgagcaagttgtaaattcacttcctagcatggcaatacaaaccattcttaaatatccttccttgaacacaacggtgtaaacctcacaacctcattcccaagtgagctcaagttcaccattcacatagtatttttctaaacagctcaaaagcctcgatgacttatgggctttgctctagcagagctaaaatggaaatatggattgtagctgtcacttcagagactcagagctggctaggttagtatggacagatttgtaagtgtccatttccatagctatggacaataggtagtatttcattttgtctttccccaatggctactcttacaaccacagaaacatatgagtccattagtagtctcaaacgcttcataaaatttggcttgtttgggtctcctttgaaaatgttcccctgaatatgatttttctctgcaagtcataactgaatattttttaccagctgtgctatatttgatgcttctctaggttcattaatatccataaggaacctaaacttgcagaaacaaatcttttgaattcttgaatgttttcaacctgaaaaaaaaataaaaagttactctgaaacatggaaacatatcaagattcttccattaggtaacatatatgaggaacatttttcagaaaatggttatataataccgtatcagcttttttgagtacttaatgatattaaaattaattttaaattataataaaatatgtcatttgtatgagaagtttaaagaccaagaattataaaccagttgagatataatatccctttattacaaaggacattaaagacaaatatctgtgttatgcctcaaatgcagctgttgtacgtgtagacaagtgaccaatacaaattgaatgtaatgtagatgtgtatagacacagaacacacacatacatacattctaactactctataaaatatttttctgtaaggagacttaggtatacctttacagcaactgagaaatttgttgacattgaagccagtattttacagcatgcagcccatttggctcacctttgctgaacttgattgtgctcttaaaacattgtctggtggaagaactatacaggaaggtaggcatgttgttacattgcttcagtgctctttccaactacattttaaaatttgcatttataattaagcagacgggaaaagaatatgcatgaggaagttgatagagtcttgccacataccaaatattcttgctaagtgaggtattgttcaaagctccatcctcaagtcagtaaccattcaactcttactctgctaaatgctgatagaatcatcattttgccaatgtacgtatgttttctgtttccaataatttccctaataatgatctctaagtgcatttttagttctgactttgatgaatggtgtcaatgtaaatgaatatagcagtcaggctagcaggaggaaaagagaaataaagaaaccagaattttaccttttcttaactcattaacatcatttcagagtacatccttctttttctctgtcataaaccagtctattttgttcaactacaaacttgtcattttgtagatcaaagcgagttgaaggttggcaatgtcatctggacaagttcatatttgagtcaggcccattttcttgttttatttatcttatttaatttttatcgaaatgtcatagttatcttttttatttttaaaaaagaggtcatacaggtcaaacctaactgttcagttatctaataattctcagaaaaatgagtagtcatataatgtattaattttactaaaaagtgtttatatgtgccaggcattttgttagaagctacaagtagccaaaataacttgtttcctaacaagtctccaaaatttaatttccagagggggatatttggatataatatatgacatagatggcatttgctgccaaa

SEQ ID NO: 480262 - DNA, 633 bp, Homo sapiens
agccaccacagacaaaggaaaaaacattctgaaaggagctgagaacagcattgctctaagaccttatgaaagagaaaaaaagaagtatttgcacagtcaaggcaggagaatctagggtccctatgagtgaagatgaactgaaaagaggggtgagaaatatgaaagagagagaattcatgggacctgagtgtgagtcaaggagtggccatcccactgatgtaattggatggtggtgtcattgctattgcaaaggaattgaaattgacaaggcaaacggggaccccaggatgagtttgccagtggcagatataagtgtggtcaataatacagtacaaagcccatggttcctggaggaaggaatgttagatgtggaacttggggaacaagtggggagaaatcttaaacaacatcagaagagcctaaaaagaagaaagaggagaaaacatcacctgccttatcacctcctcttccctcagccccaatatcaaccggccaaaatagcaaagaggaaacagaggtcttacctaatcctccacttccaatagataggaaagaagacagagaatatgctacagctatctgttcatgtcttaagcaggcagtgctagaaggagagctcttaacctgctcagt

SEQ ID NO: 480263 - DNA, 756 bp, Homo sapiens
gagaaagaaagaaagaaagaaagaaagaaagaaagaaagaaagaaagaaagaaagaaagaaagacagctagattcgatagattaataactacatgaacagatagaccgatggatagatagatataatggatagacagggccaccagagggctccttggtctagcggtaatgccagcctctgggaagacgccattgccaagtggaccatgctttcactgagtcttcacaaaattttcctggtacctacaagggagactggggacaggttgagagaactgaagaagcaccctcaagatgatgtctggggagaattgaacagcagtggaggagactcttctccatgggtctcttgtcctccatatcttatgggtgtgataagaaagaatgacaggctccgaccaccctttacccggagcatttctcatggttgttgttctactccctgttcaaccttgaaggaggaggtgacatattcctccaggacaagagcaggctctgcttattgggggttacaaagtggtagagttttcccaagttctgtgtatccctcttgtaatgcagcccacggcaggtgtaggttcctatccaagttcatccgcagcacccctttgtgatactgataaaaaaaggttgatgttctggcaacgactttgctggaagcaagttcctctattcttcgacctaaaagttctgtgtcttctgccagcatccatagaattgcagcaagctattttattaacttacaaacaggatata

SEQ ID NO: 480264 - DNA, 637 bp, Homo sapiens
acgtccttccccacacccaagccagcagttgccgatatgcccatgctccacagacccaatataggccagagggtgctttccaagcatttggagtctttagctgatgccaagatctcatataagggccttgctgtaagggagaagtttggaatccaggttcggcagaatcccgctacacctagaaatttcctgagctgctgccttgtaactggggtgggcaatgcacgcacagcctccttgcatgcacttttaagtctgcgctggccttgggataccatgaattctagatattcaacctccaaaatcagacttttgccttgtccttggacacttagtaaccagcttcacaaagcaggtgaagaaggctctctgttccttagaggtatttctccctcgtgggggcagcgaagagcaaatcatcaatgtgttgtaatagcacacaattgtcactaggtggcgcaaaagcctcaagatcagagctgccggattaactcttttatgctcctctgtattaaatgaagttagcaaaagttattcacaatctggccaggtcaggttatgcgtgttaataacagaatttaccaaatcaataagagcctgagacttttctgtataggagggggtgggctgtttccaa

SEQ ID NO: 480265 - DNA, 1053 bp, Homo sapiens
ctgcggtctttacgcagagtgaaagcatgtggagctggtgttgcagcaacatgagaaaccctgtggccaccagcacaaagactgtgctggttcacatctcaggcatcacattacgggacttcaaacgatactacagcactacagtaaccaaaacagcagggcacccgtacaaaaacagaggcacacaccaatggaacagcgtagagagcccagaaataagaccgcacacctacaactatctaatgtttgacaaagctggcaaaaacaagcaatggggaaaagtctccctatacaataagtgttgctgggatagctggctagccatacgtagaagactgaagctggacctcttccttacactctacacaaaaatcaactcaagatggattaaagacttaaatgcaaaacccaaaactataagagccctggaagacaacctaggcaataccatcctggacataaaaacaggcaaagatttcatgataaagacaccaaaaacaattacaacaaatgcaaatattgacaagtggggtctaattaaacttaaaagcctctgctcagcaaaagaaattatcgatagagtgaagagacaacctacagaataagaaaacatatttacaaactatgtatctgacaaaggtctaatattcaacatagagaacttaaataaatttacaagagaaaaacaaacaaccctattaaagagttgccaaataattgtctactcgtgtccttagcctacttttttatgggattttttttttctttctaatttgtttgagcttgttgtagatcctggatattagtcttttgtcagatatacagattgtgaagattttctcccagtctgtagattgtctgcttactctgctgactgttcctttagtcgtgaaaaagctctttagtttaattaaatcccacctatttatctttgtttttcttgcatttgcttttgggttcttggtcatgaaatccttgcctaagccaatgtctagaatgttttttgatgtcatcttctagaattttttaagtttcaggtcttagatttaagtc

SEQ ID NO: 480266 - DNA, 551 bp, Homo sapiens
cggttgagttttgcacttctgagtgtgacatgccctagtgggcatgcacattcgtcggggtggcgggaacaggaaaggtgaacccagaaatgttgagtcagggtatccaaggtggcgatcgccatcttggagtcttcaccggagtccaatcactgagtattcttcatattgttcagggataggagtgggtcataagggcagaaacccgacttggaagcccttttgggttgtcatggcagtgtctgcacagggggcctttctcagccatctctggtatggtttagagaaccctctgttcttccactcaccttatttcaatgctggcccttgttggcaacagcaagcttctgtcctgcaccagaggaaacagagtgtgacccgattaaaacactgtgtcaatctcctgtgtggaactctgcaaagacattcctaagttcttatttagttcccacttacaactgtgaacatgcagtatttggttctctgttcctgtgtttgttcgctaaaggttatttttcaaagatttttgtacagaaatagcctgggaaaac

SEQ ID NO: 480267 - DNA, 623 bp, Homo sapiens
agggggagatggaacaaccaagatcagacacataggagcatcttcatagatccccagtgcatgaagaaaccagaggacagctgaagaccttgagattcacatctgagtagacacacttgctctccaacactcaactatttattcaaccagccatgacctgggtttgaacatgacggactcaccagagttccaaagcctgacaacctgcacctgtcaggaaaagccacctcctttcctgttccccctgaaacacatggttatggtgggccagatggggtttcccagattagatgacaagagaggcctggcatggacagacctgccctggactacactgcagttcctgtgggtgcctcttgccaaatgggcacagcctgaaaaattgaggcagcagtcagtcatgacccactctaacctgggcaatcctgtgagaaagagagaaaagaaagaaggaaagaaggaaagagaaagaaagaaagaaagaagagagaaagagagaaagaaagaaagaaacaaatgcgggcagatcacgacgtcaggacatcaggatcatccagaacaacatagtgaaattctgtctctactaaaaatacaaaattagctggtcttgctctgtgtgaggc

SEQ ID NO: 480268 - DNA, 495 bp, Homo sapiens
aggacacagcctacgtttctgcccatgggatcttctggaacttccattcccccagagagaaaagaggaccacgggggcacgggtggtatactccagacccacgacctcagagtggcaaatacctgtcacaatggaacaaagtccgtgaaatccacgctaccagacacagcatggatttcccagagaggacagcttacaccaaattccctcctgtgcagggccctccccagaacgggagtctcaggacctacagtcgaacaaaacacaccctgtggaattcaagcatatacacggacaatttccccatcctcttggggccttcgttctgtagactcccatgaagacaggtcccagaaacatatctgcctattcttttattcttctgcctctgacgagttgaggtttcagatgaaacttcagagggtggaaggcaaagcactctccctgctcccatgtttttgtgagtggtgaaaaatgacagtctcccaaggcaaa

SEQ ID NO: 480269 - DNA, 601 bp, Homo sapiens
aactttccactctatgttgaatacgagtgccttgctcgttggagctgatctgatcgtgatggataagctttttgatgtgttgctggattcagtttgccagtattttattgtgaatattcacattgatggtgttctgtcccagggagttgggagttttacatataagtctctgactcaggctgctgcctttctttcagagatgccctacccagtgaggaggaatctagagagccaatgtggccacacctgctttgcatgcttcttaattgtggtcgaacctctccccaccgagctttatcattctaggttgacttcaggcttctatgtaggtagtgagaacttgaagccagtggatctcagcttgctgtgctccatggaagtggggcctgctcagtgggaccacttggctccctggcttcagcccctttccaggggggtgactggttttgtctcactggtgttccaggtgccactagggtatgaaaattattttgcagctagctcagcctctgtgaaagcagccacccagttttgtgcttgaaacccagttctgtggttgtacaggcacactagggaatctcctggtctgtgcgtcgtaaga

SEQ ID NO: 480270 - DNA, 1221 bp, Homo sapiens
tgggtgtctcacacggggcagataaaatcaactggcaccccagaaactttctttcccacatacaaagaagaggaggatgcaggggtggccatctcctgcttgaagtccagggagacctagcacagcttctccttgatatcgcgcatgatttcccgctgggctgtgttggtgaagctgtagcctctctccttgaggatcttcttgaggtactcagtcaagtcccagccagtcaggtccagatgcaggatggcatggggaagggagtagccctcgtagatgggcaccgtgtgggtgaccctgtgtccacagtccatgacaatgccagtggtgcgcccaaaggcatagagggacagcacatcccggatggccacgtacatggccggggtattgaaggtctcaaacataatctgagtcattttctctctgttgtccttggggttcagtgggtcctcggtcagcagcactggctgctactccggggccccatgcagctcattgtagaagtggtgccagatcttctccatgttgtcccagttggtgatgatgccatgcttgatggggtacttcagcgtcagaatgctgcgcttgctctgggcttcattgcccacgtaggagtccttctggcccatgtccaccatcacgccctggtgtccggggaacccaacggtggagggaaacatggcttggggagcatcgtcccctgcaaagccagctttgcacatgcaagagccattgtcaatgacgagcgcagcgatctcttcttctactgcgatggacagaggagtgggacagaggagcggcagaagaacaaggcactcacaagacttccttgggtaaagacaggaataattctcctgccagggaatccaaaatgatggggaagctggccatccactttaaactttattttaatttcactaggaaatgagaagtgaaatgttacgactgttctggaaatatggccctaaccagtaaggagaaagcttgtgacctctacaataaaaggaatgataaataataaattacttgagatttttccatgtttgtttcctgtattgagttttgaataataaaaaatgtaaataataactgtaataatacatttaagtaataaaaacgtttaagtaaattttaactattaaacatttatatttatttatatgaattaaatggtcaatgtacatttctttattcatataacttcaacaggctctcaagtat

SEQ ID NO: 480271 - DNA, 1130 bp, Homo sapiens
gataaacacatgacagatgtttagcgtgttacagatgaggaaccagactgtggagagtgagggtggaaagatggagatgcttgggaagtggagatttgcagaacataattcaatgtccttgagaaaggcagcctatctcatgaagattccctggatctcctgtgtagtgatggtagagagtggaagtcaaaggtactgtgctgccattggatggagccatggaaatgagcaagaatatcaacttcaactaacggatgactacatcattagaactagtcgagtgattgaagaggaaaggaagaataaagataccctgaataagtccctctttattaaaaagttcttagatgactttgactgtggggaccatctgccttctgtctggatcccagctgcttcttacagatgcacagattatattggatctcgagtctgtcaccaaaaggtagaccagatagcaccttgtgtgtatggtagaggacagaaacaggctttcaggttaacatgagagtttgaaagagttctttttctttctgtgccatcatgcattccacaagcaatgaatgaattgttgtttttcctgcagcaaatcagttgtcatgttttaaaaatggtttagccattccaacaaatatagatgggccatgctaactcgttgtaattttcagtcacttaaagatatatgagtttgagcatctttttgtttgcttgccatctttgtattttcattggtgagctcagctttttacacattgtcaattgggtagtctgttttattgttgagtttcaagatttgcgtattttcagtgcaagtttttaccccgatctgtattttgcagatatttattttcagtctgttgcttatctttctatttcctgaacaagattttactcagagtataagcttttaatatgagaaaccttaaattattaattttttttttaccgttgctgatcggctttgttgtcatttgttaaaacttgtggccaaatccaagatcacatacatttatgtctgtgctttcttctagaatttgcatagttttacatttccagttaatggctccttcaccattaaaaaaaaaaaaaaaaaatgagggggaattgctggcaagattgctgaataaaaa

SEQ ID NO: 480272 - DNA, 1103 bp, Homo sapiens
cgccttgctgtgggacagctgcagggagtgctgtttgacctggtttgcatgtagcatgccgcatgtgagaataagtgtctatagtcccatgaacaaaggcgagcttgccaatgacagctttattaataggacagtgaaaaaggagaagaaaaaaatgcagaagaaagtattccctcgggaaagaagaagaagaagaaggagaaggagaaggagaaggagaaggagaaggagaagaagaaggaggaggaggagaagaagaagaagaaggaggaagaagaagaagaagaaggagagaagaaggaagaagaagaagatgaagaaagaagaagaagaagaagaagaagaagaagaagaagaagaagaagaagaagaagaagaagaagaagaagaagaagaagaaaagtgcccactgaagcacactgaagctccctgtgtaaaaggaatagaaacgattttctggaaggcccacaaagaggcacaggaaaggcagaaaaagcaagaggcagacagaggcattagtgacgcaattacaggtctacaaaatccaggagttttgagctggactgctgaaagtttggcaagctccaggactcttcaggaagaacagcagagaaaagaaaacaatgcctcctcaactctgtccagccagtggtggcgaccactggaaggtggaatgcctgcagagacatattttgcattacagggcccgattttagataatcaacctttggggtccagtgggtctaggacaaaaggagggcagaaagctacagctttgcacagaaatgcagtgcaacttttaagccacatttcaactactgcggaaaaacaggcagcagtacagacagcaaaggaatttgaagatgaacaactgacatcctatagtcagtcagaaaataaacagaagcgaaagatgaaaatggatgagtaaagaagacagaattactatttccaatagaaagaaaaacagtgctgtttgaaaaccccaaatgaagccttggtaaacctacagatgaatagaaatgaaaaacactttctactgtgcatattatcaggcttcgaaagaaccagaacaagacttcttaattactctgaactgttct

SEQ ID NO: 480273 - DNA, 3182 bp, Homo sapiens
cagctgctgcatctcagttttttttctctctctctcctctctctctcctctctctctctctctctctctctctctctctctctctctctctctctctcccccccccccccctttctttctttctttctttcagatgttagggttttactctcttcccctaggctgcggtgctatggcaggatctccgctcagtgatatttatatttcatgtgagtgttcaacaacggtgacctcagaagaggaaaaattttgtaagcaaatggatagaataaaccatcctgtggaaaccactcagtctctctcccgagcttctgctgtcatcacccagagggcccataaacaaagtggccatgattgcaggggtgaagattatgcacgggtgcagcaaaatggacttttactcaccaaagctaacctggctatggccactgctgcatgccccatttgcaagcaacagagtccaacactgatccccagaattattgggtacagaaatcaaggtgtggaagtgaaaatgtccccgctcaccgtcacccctagtgatccactagcaaaatgtttgcttcctgtttcctttacattatgttccgcgggcttacaggtcttagttccagggggagaaatgttgccaccaggagacagaatgacatttccattaaactgacagtgaagattgtccccttggcattttgggctactcctgcctttcagtcaacaggctaaggaagtgacagtgttggctgtggtgactgacttgcattagcaagataaagtcagtctactattttacaatggaggcatggaagaatatacatggaacacaggagatccattagggtgcctgatagtatttaactgccctgaggttaagatcaacggaaaattacaacagcctaattttgacaggactgtgagtgatccagaaccttcaggaattaaggtttgggttactctaacagaaaagaaaggaagaaagcaagcaagcaagccagcaagcaagccagccagcaagaaagcaagcaagcaagcaggcaagcaggcaatcaggcaagcaggcaagcaggcaagcacgcaagcacgcaagcacgcaagcacgcaagcaaacaagaaagaaagaagaaaagagagagagggaggaaggaagaaaagaaggaaggaaggaagggaggaaggaaagaaggaaggaatagaggaagcaagggaggaaggaatggaggaaggaaggaaataaagaaggaaggaagaaaggaaataactataatccttgaaatctttgttttgctttggcttggttattataatggcttagcaacttttatgtcataagacatatttaatttttgccttacgataaatattatgcccattgtgcttgcataatgtagtgtgccaatccacaagtgtgtatgtcttttctgtatgccttccagctgtagtcaagtttagttctatcccaaaagccattcattgagttttcttaattgccacccccaaaatagaggctgcctagctttgctttttttttttttctttgctatactagtgttttacggaaatatttaaaaagtaatgggaaaagaaaaggggagaaaaataaatatatgctttactatttaatcattgactaactgaactgactttgctttactaacacttaccttaacttgaatcaacagaactttacaaaagcttcttaaaattcttctgatttatagaaaccaaagattgagttaagtaatcttgaaaatataaaatcaaagtgtgcttttcttatgtacaattttctggagagatgatctatcactgttaatttatcaaagagaggcctgagactctagattttaagatatttatcagcttttctaatctctcagggctagatgctagtaaccaccttaccaattccacttctagtcatgaaccaggcttagggtaaaaagaaagtaaaatctattgacttacagaaaccctagccactcacatggactgtctgttacctccatgagctcaatgtctataactgtttgccttccacggtctgctccagccacagtgacctggctgtttttcaaacaatttaagcagacgtctggtggaggtcatcaaacttgttgatcttgatgcatgcttgtgtgattattaccttattattttatttagatatttacttcaaagtcactttagagactaattattttatgcttgtctcacatgagtccaagctgtactcaatagagaattttacctcatgcattttatatgaaattgataggatcaattaatataaagcaaacaaaaaaccttacactataaacactaaaacaaacaaataaaaaatctagaaacccaaattaaaagtgtaacatttaacttcagcatttgaaacaacattttcatgggacaaaatttagatctcctaaataaaaataaactgagattagaaaacagttcatgcttcacaactaaaactgaaacaaaattgcagagcaggcagcgtcaaaccattcaaagaaatctcaaacaaataaaaaaccgtctacacccaggaaaccaatagttcaccaatagttcacatcaaccaaggaaacacttaatcaagagagacaattttaaaacagttaatgttttggattgtcatactgcctcccagacacagatgaagcctgcaaaactgaaatccacattttcaatttgaggccctgattcctgattctagaaggagtaaaacagcccttatgtgctaatttattgtgtttgttctagtctttctagagaataaacgatgaattgattagtcatttttatttctgttttgccaaagtcagaagtcactcttggttgaaaatgccaggaattggtcacaaacatttaggttcctgagaaccaacaatgcagttacttcatataattgacaatctgataatacatattcagttttttttttaataatagcttgtatactgctcttatacaaaatgctatttaagtggatactaagctgccaataactaagaagacaccttggagaaatgaagaacatttataacttgtaaaataatacacaagcagaaaatgtctagataaaaataagctcgagaaatctgtgtctaaccctccccccaccaaaataaagctattactattacctagcaaagataattactactattatgcttattatc

SEQ ID NO: 480274 - DNA, 2518 bp, Homo sapiens
agcgtcttctttcatcactcatggaactattttaggacaatttctgaggaagcttttgtttcaaattctttctcctgaggaggcaagagttgaggttactgcagaccatgatagatttgacgccagtaactcagataacttccactgacgtctgcttaaattgtttgaaaaacagccaggtcactgtggctggagcagaccgtggaaggcaaacagttatagacattgagctcatggagtttaatggaaatgtcattctgtctcctggtggcaacatttctccccctggaactaagacctgtaagcccgcggaacataatgtaaaggaaacaggaagcaaacattttgctagtggatcactaggggtgacgcgtaatgtcatcagtgtaacagacaagtgtgatatcttgcagccaccaaaagaaatcaagatctctctgaaaaagattaaggcacaaaggtcaggaagcaaatgtggggttctaccagcagctaagtgtgtctatgccaataatgcattctggcactgggaaaatgaccttaggatgactctaggtacacgctcgacccactaaattgctttacatatctcatttggaaaactcattgcatttattgattacacttgcatttttttttcctttggattttcttttgtaagagtattctaaattgtttgaagatacaataagatgtttaattatgtcaaataaacttaaaaggtattttcttggaaagacaactttttcttaagctatgtttctactaatactgtgtgactactttttaaatgagaatataaaatatacaatatagttatttgtttttacttagtgacacacctgtcaatacatgaagatctgtttatttctgttctgtgctacataacttggcattcaatgtgctctaatttatgcagtccacatctaagatggattgatgtataatgctacatggacctgttatcaacattatttcacaattacaataaggctactaaaggtgtaaaagcacctggttgaaaataaaaagtatttggttgatcataaggcagcaaaaagttaggctttagtggcagatcacatatttaagatgtagctattaagtctaatttgtggcatgcatgacaataaaacactgtcacacaactttttactgtatactgtaatatatagctctttctagtttctaaaacaagctgcagcttctcatgagagtttattgttctttcaggaagcggagatcctgccatagcaccgcagcctaggggaagagagtaaaaccctaacatctgaaagaaagaaagaaagaaagggggggggggggagagagagagagagagagagagagagagagagagagagagagaggagagagagaggagagagaggagagagagagaaaaaaaacctgtgagaattaaactcattagtatctgtgtgtctcttagtgtattacctctttaagtgctataaatatcagctgctattattattgcttatcatgtatcttcaatttactcacaccaaattctgcttcatagcataaaaaacacatcagaacagtaacagtcagatagtagtggctatatggaaccacaaaagcatcagtgtctgtgtcagtaatcttttgtaatttacaacaaataagtgaccttttacacctacagattctgcaaacacagatttcttaaaacctaaactgtactcagtgtaacaatttagatttgcttcttatggtaagtaatttgtgtttggcttgtaggagtttttacaaggtatcgaatgtgtttaatctatttcttcaatcttcttcttctttctttatgaaatcattagatctaatttatatgaatgtgctgcctttttggtttagttatttcaaggtaaaatatttaagatatctttaccttagaatattggtttttaatatatggaaatatggaagagcatttatgtgttatattaattattattttttactcaagcagtttgaaatatgagtcagtgaagcggtgaggtaatcactaagatttggcttaactaacaaatattttattaacagcttcaagatacaaatgtttttgactctatatataattttttttgaacagtagaattattttctgcatgagggaaaagaatttgctatgattagcatacaaattgcctctatattcatcattaccacaggattttacaccaaaaaatgtttgtgttcctgccagtgactggtacatggctttggatttcactcataatgtaattataattggtttgattgtctattatactgctttatatttcctaacagcaaaattattatttcaatttttaaatatgcgaaaaacatttttgcagtaattgtgtgagaattcttggtaaacataaaattctctaatctaaatatgcattttttaattaaaaattatctctgacttcaaaaaatttgtatcatagcttattctaatttatcattcagtattaagctttatctattctaaacaaaatctttactt

SEQ ID NO: 480275 - DNA, 827 bp, Homo sapiens
acaagaaccatagaactcaccatggctgcagaccccaagttctcctgcctgtttcccgtgcccactcaaaaagtacaatttctttgtctgaatgcggtattcagttgcataacagcatttgttgaatttactgatcttggttacatgtcaaaaatcaattgtctacaattgacaattgtagacaattgtagagaaagaagaagaagaagaaggagaaggagaaggagaaggagaaggagaaggagaagaagaaggaggaggaggagaagaagaagaagaagaaggaggaagaagaagaagaagaaggagagaagaaggaagaagaagaagatgaagaaagaagaagaagaagaagaagaagaagaagaagaagaagaagaagaagaagaagaagaagaagaagaagaagaagaagaaaagtgcccactgaagcacactgaagctccctgtgtaaaaggaatagaaacgattttctggaatctctttgtgagcatatatttgtgcacaaagaacaaagttctgtctatgtcggactgcgtttcttcatgtgagtgggctgaagctgtagctggagatttctgactggctcacagaaattaacagggctagtttaaactacaggcaaattctaaagacaactaatgagactagaagacaatggccaatgtaagatttgaaacaaatttttctattttccttgttcatttctgtaaaaaacaaatataataggcctgggttgacagcaaaatggtctataatttgatagttaaaataactattggcataaactgtgggccaaataattgctcttaaataggctttgtaca

SEQ ID NO: 480276 - DNA, 696 bp, Homo sapiens
aaggaggcggcctgggaggaagctgatgatgggaggaagctggcgcctactgactcaggaatacacaactgcccctcgtcggggacagtccaacttgctcctcatgtctgacgtgttgagtcaagatgagctgcgagaaaagctacaccaaacgttgaaggatcggggtgtactgggcacactcaaatatcaacttcaactaacggatgactacatcattagaactagtcgagtgattgaagaggaaaggaagaataaagatgactttgactgtggggaccatctgccttctgtctggatcccagctgcttcttacagatgcacagattatattggatctcgagtctgtcaccaaaagtttcaagatttgcgtattttcagtgcaagtttttaccccgatctgtattttgcagatatttattttcagtctgttgcttatctttctatttcctgaacaagattttactcagagtataagcttttaatatgagaaaccttaaattattaattttttttttaccgttgctgatcggctttgttgtcatttgttaaaacttgtggccaaatccaagatcacatacatttatgtctgtgctttcttctagaatttgcatagttttacatttccagttaatggctccttcaccattaaaaaaaaaaaaaaaaaatgagggggaattgctggcaagattgctg

SEQ ID NO: 480277 - DNA, 640 bp, Homo sapiens
caacagggaccccgccaggaagaagggagagagtgacgggcctccagaagagagggagagaagccagtggccccaggctctgtgaagtcggccagacgtccctccgtgccacctcgactttcaataacagtggccgctaggtgatgcccgaagacaaccgatgcttgcaagtgtcagtcggcacggaaaagaaacgaataatgagtctttctgtgtcagggtggaggttggggatggagtgcggaagaggcacaccccagtcactggcctcttccagatccctctcacatcaggtcgtttccgggcccagggagaactcccaggcaattcccacgactagcgaccagagccccacagaggacacagcctacgtttctgcccatgggatcttctggaacttccattcccccagagagaaaagaggaccacgggggcacggagtggcaaatacctgtcacaatggaacaaagtccgtgaaatccacgctaccagacacagcatggatttcccagagaggacagcttacaccaaattccctcctgtcctcaggccagttttcactcctgaagtacccatttctcagtcgtgttccgcaaagtcctctctgtcgtgaatcattcaaaaatttagttcagtgaat

SEQ ID NO: 480278 - DNA, 608 bp, Homo sapiens
ctacttcagacggtcttccagtgtgtgtttcactgaagtttaatggaagatgctgaaagttgggcattttccggtgagcccacttactattgcggggaaggggaaaaaaaaaaaaaaaactctggtggagagtctgtagcaaagaaaaaattcctgcagtgtgaaaagagaggaggcaacagccatacacaaagcaaggtgaaaataaatgagcagctgttgcggcaagccatcattgcttgtgaacatcctgctcaccggctcctgatgaaaacgattccattttctgtttttaaaagtttcaatactttcgatattacaactgctgattactcaccttcctatcccgtgtcaactcttcatctgtacacagttatgcaaacacaagccccttaccccatgaaaacatctaaatacagccagggccccaggtttgagggaaaagagctggattagaacattctttttcttctcatttctgtgatcataaaaaaaccactgtgtttcaagtctccccagccctgaaatatatgcacattggggattctgctagcatcggcttccaagcaatttctttgaatatataggagtcttgctctgtgtgaggc

SEQ ID NO: 480279 - DNA, 767 bp, Homo sapiens
cagggataggagtgggtcataagggcagaaacccgacttggagtgtgcgtgggaggagctgcggctggagggggagcccagactgatggcagacccagggcccactactctcctccaaattcgcgaggctcccattgtcatggctcacaggaatccaagaagagcaccagggacaggaggcagacatcctgacattgtgacaaggatgggcaaagtgcttacttatggtgatgatgatggtggtggtggtggtggtgataatggtgatggtatgaaggtggtgatgaagatgatggtggtgatggtgatgggtgatggtgatggtgctggtgattatggtgatggtgatgatggtggtggtgatgatagtgatgatagtgatgatggtgatgtgatggtgatgatgatggtggtgacagtgatgatggtggtgatggtgatggtggtgatggtgatcgtcattatggtaatgatggtggtggaaatgatggtgatgattggttatggtgatgatgttggtgatggtggtgatggtgattttgtgatggtgatggtgatgatgatggtggtgatagtgatggtgatggaagatgatgatgatgatgatgatgatgatggtgatatataacacatggtactaatcacagtgcttcccactaggcagtctcattccagagcctatgttcttaaccatcttactatactaattctcatgagtgttaagtataattattataatttttactgactaggaagaaatgtggctg

SEQ ID NO: 480280 - DNA, 737 bp, Homo sapiens
cacacgcagtaaaactaacctgtctcacatgggtctaaccataatgctttccagggcatgcgcaccgctctcaggtgaatccattccagtctgccttgtccttcgcaaagaaaagagagctctgcaggggcgatcacctacattctttggattcaatgtgggtttgtcacagatgcttggtgtgacaaattgcatggcttctaccacttcatttgatcagcctcctattgactttcagctaagtgctgcagaattgcttctcagattgtatctttccgcaagacaaagctatttcacagtctctaactgtcccattttgtggctgttaatttatacttacatgtttttcaactacttattctggttttctgtttatgaaagctttaacctgtgctattttgagggaaatactgatgcatatctaaactttaagagtgtttttcaccctggctgcagacacttggtgaataatttttcaggtgatagaaaaacccatcatcatgagaatgtagcaacttttattttgcagtaactgttaaaactgtagctgtggtgctcagtaaaatgggacctttcccttatcagtgcctgaattatattatgagcttcgtaaagttgtatcaatgaatgaatgattcataatctgggcactgcattctaacacttaactgaaaaaaaatcttagatctatcttccatgtaaaagcatatctaaaatgcaaatcttaatttgataat

SEQ ID NO: 480281 - DNA, 731 bp, Homo sapiens
cctgaaataattgaaccgggtcacagggcacagcacctgtgctgtgttatggggagctcctcctggtccttggtgccagcgggctacagcggccaactcaaaccacagataacagtggctgcccctccctccctccgggaactgggtccatctccagctgtttccagcctgctgccgctggccagctggaattctaagtcagtgggtcttaacttgggaatgcatggatatgtctcccactttgctggaattctcggggcagagtatgcaaaactcctggatttccatgcatgccccagtgagccagcgagcactaggctgagactccacacagctctgtgtttcagacccaagccatggtgcctgggcctacgaggggatctcctgatctacaggttgcaaagatccgtgggagaagcatggtttgccagacaaagtcgcacaatcactcaccgcctcacttggctgcgagacttcccatactattttgaagaggagtggtgagagtgggcatcctcatcttgttccagttctcagagggaatgctttcaccttttccccattcagtattatgttggctgtggattttctagtttatgtgccttaaggtgttcatagtacccatgaatgatctttattatttcagtggtgtcacttgtaatatcccctgtttcatttcttagtgaggttatttggatttttttctcttcttgtcttggttaatcttgcta

SEQ ID NO: 480282 - DNA, 718 bp, Homo sapiens
gcctctataatgaagtttaatgttgttgtctctgcagtagtgacaaggatcactaaagaattcattaagaaacagttaattttatattatgtgaaggaacttcacctcactaaaaagacaaaacttcttcctcagcattccacagagtgctctcagaatggggttctggtccctccacagtccagaactgcctggggccaggcccaccacatactaggcatgtactccagccacactatccaccagctcctcgacctgttaccagtgaaagtatctgttactgctgtcaaatctatcatggtctgcagtaacatcaactcttgcctcctcagaagaaagaatttggctgaggggaataaagtagcaaaagagactgagaaaagtttcacagcaaacccagcagttgccgatatgcccatgctccacagacccaatataggccagagggtgctttccaagcatttggagtctttagctgatgccaagagtggcttagggtagagaatcaagagaaagcatttggatctgtatatatgtttactttttttcttggccaataatggtgctctggttaatgctattaatttagccttctgagcagaagtcccagaaggaagactttcattttattataatcccatgtttatagggccgatttaaatgtttcgttatgtcatcaattgcctctctgggtggggggtgttgacggactagtacc

SEQ ID NO: 480283 - DNA, 522 bp, Homo sapiens
ggcggtgttgctctggtctgtactgaggagaaggcagctgtagccctcgggcaacacgagctgaacccgatggtgctcccagggtcagaaaaggcggactcatgctccccctgctggcagccagaagaactgcaagacccccatggtcaaggtgaggcagccgtgcgcccccttctggctgaactgcggcaccaaataaaagcagagttcagattgttcagtgccatcattttggaaattcaaacggaaatgttgcctattatcctgtttcgtaaattattatttattttaggttcaggggtacatgtgaaactttgttatgtaggtgctctgtcccagggagatgggggttttatttgtaagcccctgactggggctgctatcatttgtttcgaaaataccctacccggagagaagaaatctggcagtctggccacatcagccttgctgagctgcagttcaaacttctctgaggctttgtttacaccatgaggtaaagcagcctactcaagcctcagcaac

SEQ ID NO: 480284 - DNA, 729 bp, Homo sapiens
aggggcaggatgcaatgcgacagctgtaatctcgcgttgtttttcagtcgttcaccttccctctaccccccaagtaacctgaagagtctgcaaatgggtctggctaaccacccgtttcacttggaagctgaggaaagaaacatttttgtagaacacactgaccttcttgtctcatgggggtctctctctgctgcccctttcagtgagggtggaaagatggagatacgcgggaagtggagctttgcagagcatacttcattttccttgagaaatgcagcctatttaattggagattctgtggttctcctgtgtagtgaagatgactttgattgtggggcccatctaatttctgcctggatcccaactgctgctggcgaatgcacagattacattgaatctcgtgtctgtcatcaaaaggtagaccagatagctccttctgtgcatggtagaggtgagaaagaggttttcagattaatttgagaatgtgagttctttttttctccaccattgtgcattccatgagcaatgaatgaattcctgttttccctccagcaaatcatttgtcatgttttaaaaatggtttagccgttccaacaaatataaatgggccatgctatctcattgttgtaattttcagtcccttaaagatatatgagtttgagcaactttttgtttgctttctgtcggtgtattttcattggtgtgttcagctctttactcattgttaat

SEQ ID NO: 480285 - DNA, 693 bp, Homo sapiens
gtgattcagtctcacagtgcttatcagaggcgttctctgctcagctgttctctgctgtggtgaggcgcctatgctttgtatatgtctgaaattaattgaaaagctagtgacagattctgatgtcatttgccatgagctttattgttgtgcaggacctatagtgagtgtctgcatccaaggtgatcagacaaagtattgccaggacatacagaaaatcatccagaagcactgtgatattgtaagacacaagccatctccttactggttagggccatattatccagaaccgtcagaacatttcacttttcatttcccattgaaatctgaggagtgtgttttgaactctatagtgaaatgcctacaactacccagtaccatcaaaaaggtgacagaacacagattaagtggatatacaacacaaagaatgcagaccacaaaaatagctctggagggttgctacacaagtaaacaacccacaaactaaggaattgtggatgttaagaatttgttatccaaatatgctgaatactatccaatatttcaattcacttcattttactattctcaaagacctaagggaacccaggagtacagtgattcaaaactgaaaataccagtaaagacatacagattattttaaaaatgaaatcaataaccttgaagttactaggaagctgtgtgattgaaagtcag

SEQ ID NO: 480286 - DNA, 732 bp, Homo sapiens
cttttccgtgaggttgaaaagatggagatgttgaaggactggagctttgcagagcctaacttatttgatgtgagaatggcagcccatttaactgcagattctgggcttatcttgcatagtgaagggaagcagaggagagggcaagtgactgctacaccaggaggaatgcacatctcagttcagactggtcacctttccactgtcaatggatgcatgtggctggagagtccttctttacttaaagaagtaggtctagatcagctggctcatgaaattgtggtatttcagaaagaactgcagaaagcagaaaatgctatcatagctgagcatgaggagttcaagaaccacaggccagctctgcaatacaactgcaacatgcactgcaaggccacaagctatgcaaggctacaagttacgggcataactggtaatccgaccaagaagggctgcagacaacgagagtgtctcactaattcagaagaaacttacaacccaaccaacagagcatgtgagagtagcctgctaagtcagctcagaaggaaactggacgtagggaaagtggctcaccaccccaactgggaacatgggaactggtagcaggatggtgtggggaagtgtgtgaatggagaggcctaactaggctcatcagccacgaagtgaggaaccacaagtctcttagtgaagactgtactccaagccaaatgtgtggctgactaagactagttgtgatcc

SEQ ID NO: 480287 - DNA, 612 bp, Homo sapiens
gtaaagggtcttgggaagttaagatggttttcgcagttacagtgccatgtattggcttttcattgcttatgtattggaacccgcaatggttcctgcatcctgccgatcggtatagttgtgctcaccgtaacagcagcagaaacactagttttcctcctagaacacaaagaggaccgagcaagaggtccactgcagacactgtttgcttgggtaacagcagcggtttctgcagaacagcagattttcatgaaccgcgaatgatgctgtctgatcattcctctggaaattttgtctcagaggagtacccggccgtctcagagaagtttgatcgtctgaagccttcttctctcaactcatcaaagtcattctccatccagcttcattctgcctctggaccctctgctgaaggtctgttggagtttgctggaggtccactccagaccctgtttcccgaggtatgaacagcagaggctgcagagtagtgaatgttgctgaagagcaaatgttgctgcctaatcattcctctggaagtttcatctcagaggggtacctggccgtgtgaaatgtcagtctgccctattttggtgctgtctcccagttaggctactcagg

SEQ ID NO: 480288 - DNA, 763 bp, Homo sapiens
cagctgttagaattattttctttttctttcatgcatagccaccccagccagcagtggcaacccactttggtccccttccacgatgtcgaagcgttattctttcactcctcacagtaaattttgctgtggctcactctttgagtctgtgccatctttaagaactctaacactcactgcaaagaattcggctgtgaatccatatggtcctggactcgtttttgttggtccacctggtgcagagaatttggctgtgaatccatctggtcctggactcattttggttggcccctctactctaaccaaggagactcagagggcaaatactcatctagtagaatgggaaccagaggcagaaacagccttcaaaaccttaaagcagtccctagtacaaactccaggcttaagacttccaacaggaaaaaacttctctttatacatcacagagagagcaggaatagctcttgcagtactttctcagacttgtgggacaatcccacaaccagtggcatacctaagtaaggaaattgatatagtagcaaaaacctggcctcactgtttatgggtatttgtggcggtggctgtcttagtgtcagaggctaccaaaataataacaaggaaaagatctcactgtctggactactcatgatgtaaatgccatactaggtgccaaggtagtttatggctatctgacaaccacctgcttagataacaggcactactctttgagggacttgtgcttcagatatgcacatgtgtgtccctt

SEQ ID NO: 480289 - DNA, 677 bp, Homo sapiens
gtttgacacacagcagtgtcttcttgtgctttaccagttacatccctgagatgccatgatgaagtatggtaaagtgaatattgtcaccatcagtgaccacttcattgacatcaactatgtggtctacatattccggtatgattctacccatggcaaattccatggcactgtcaaggctgagaaaagaaagcctgtcatcaatagaaatcccatcaccacttccaggagcgagatccctcccaaatcaaatggggcaatgctggcactgataactgccatcactgctacccagaagactgtggatgacccctctgggaagctgtggtgtgacacccatggggctctccaaaacattctctctgtctctacagacactgccaatgctgtgggcaagatcatttctaagctgaatgggaaattcactagcatggttttccatgtcccaccacctacctgttgatgtaatattatagtgttcgttttaaatcttcttaagttggtaatatgggtgtttagtgctacaaatatttaccttaacaccgctttagctaggtcacagagatttttacgtgttatatatttattagtattaatttcagggaattttttgactactgcctaactttattgtttcctaaatgttatttaaaaatgtattatttaatttatatttcatt

SEQ ID NO: 480290 - DNA, 744 bp, Homo sapiens
acgacagccattttgccacactatggtgaattccatgccttccacccctcccagactccagcactgtaggggaaaagcacctactaaagcctcagtaattgtgggtatccctatccccaccaagcatgattatttcaggtccacttcagactgctgtgctggcagtgaaaatttcaagccagtggttctcaccttgctgggctctgtgggagtgggacctactgagccagaccacttagctcccttgcttcaaccccctttccaggggattttgctcttgccatatgatgtgcctgctctcagtttaccttctgccatgagtaaaagctctctgaggcctcctcagaagagactaagtggttgtgaccaaaatgctgacagtgatgacagtgaagtccaggtttataagaagaaattcttaaacagcaaaacatctgagaggaaaaatagtggcttctaacagtctatgtttaaatgtaagagcaaagcaatggtttaaaggtgaaagctatattttttaagcaaaaggagagtgtaaaattttggaaaatttgcagcctagtcatatggcatagaaaataaaatagcattattgggaggaggctgtggagaaaccacttgatagagatgttagcataagtaaaataaagtcaacttctagtagtagagacaatggacaaaagatcttgaaagcctttcaagaatattttctgcaggccctcccttaaaagccccaaagtcttt

SEQ ID NO: 480291 - DNA, 1101 bp, Homo sapiens
tttcctgttagctattctgccaccatgctgcaccatctatatttagccttgtctctgttctcaggccctccaccgaagaataaggttttatccaacaatgcaagcagccaaaagccgactcactcaagctgcataccattgttgaggctgcctgataagcagcagaaagttaatgagagcattaagacagacatgctgtgcacagacaaggaagaggagtgccctgctgcctccctgctgcagaaatacaccaataacagtgagaagccatctgggaagagacaatgcaaaaccaagcacttgatatctcaggacctgaggcaggggttcctgctaacagggaagtgctactcaactgtcccaagattcagaaagcaacttgaacccagttccaactatgatctgacttcatccaagcaggagatgaagcccttcaactgcttgcaagagttgctaccagcttcccagtccatgaagctgccacactcatgttcccctcaggaaaccaaccaatctcgcccagtgcagctgagagcaaggagaattattgtcgataggcatgctggtgagactctcctgcagcaggcagcatggcttggctatgagcttctggagactatcatcttacactctaccttcatgacatcaacttttcctacatatgagcctctccatggtgcagttgaaaatgattgtttggaaattgtccgcctcctcctttcctatggcgctggccccactttggccacctactcaggcagaaccattatgaaaatgacccacagcaaagttatggaaatgtttctaacagaaccagataatggaggggaatccaatgttttggcagaccccccaggaccagaggaccaggatgatgacaatgaggcttgcagtgatgtgtttgaatttaaattttcagataccccctcttaccttgttaaaacattcaagtttcatctttgcaggggtgagcatggctgctatgtcactgaaaattagctgagctgatttgtgggtagtagcaggacttaaagctctttttaagtagatgagggattgctactgattcgtaaatgaatgctgtagcattgaacagtttct

SEQ ID NO: 480292 - DNA, 3550 bp, Homo sapiens
tctgggaactaatgacctcacaccagggaggtcaatttcatagtagagagtgggatataggaaaaaagtatgaaattttaaaacgtgctaaaagattactgcaggctgatgtcatattgaactacttggcagtttctcttatgtactgctactgctgttttgaaggagtgtcccaagtaacatctatgttgttgctctgccaaggtggatgcaaattggcttatcagattgacggcctggaagcactgatcatggaccacacaggcctgaaacaggaagggctcctacaaaagcgtaccacggaggatggccatcagtccccggaacgccatcaattcccacacctatcctcatattcagaacaggaaacaaccagggtgccatttgccaaggcagttgctagtggctttccaggcgatacaactctcgtgttctgtgcctcccctcagccctcaccccaggtccaccttcccacccaggctgttgcagacatattctctgagttccatgagcattatgccaggatctctaccgctccttcagtgacactgtcaaaggcaaacatgatgggcagtgagttccccacagcgaggctctccaatagcaaatatcctgagaccctggaagtgggtgagagtgctcagccagtccccatgtacacctggaagacagtggctcaagacaggaaagatggtgtctcacctcctctgttagagaagcagagtattaccaaaagcatctcaaataagccagtagagttgtcttctaaagtggtggaggtagatgcttccaaagctgatcacatgaaaaagatggcttccatgggcctggttcacagcatggctggaagtggcttagtgctctccagaagtgagattctgaaagagatatcttctctaagaaatggctgtgctatctatagatctgaatttattagcactgatccatcatcctgggtagtacccaggccaagaactaatgaagagaacaatggtgaaagcatgttgaaaaacaaggtgatggactggatgataatacaacagcaaagttctttttacctttgcatgaatggcaaaggaactatgatccctaatgttttggggtcagtgtcctgtgcaggccaccccacctctatattaactctatattaccagtccccaaccccacatagggcagatggcactaggaccaacaggagctctgtggataccacatcatccatcattcagcaagtgggccaacctccaaccgtgcctgtcaagcaaagcagcagcactagcagcaaggttgccaaagccagcagcccagaactgagtttcaaagcaaataagaatggccttcaaccaagccccctatttctacctccaaatgaggctttcaggcccccatcaatttcccaccccagaagttactttccttacccagtacctaaggccactgctataagacccttctccttacatgacaaagggcctgtctaccctcatccagttttgttgcccaacaacagtctctttctggggtgtcttgcctcaaagcctagactgccttatgtggtgcccatgggccatccagagtttctgatctaccaagatgccctgggatttggcatggtgcaacccatgttgataacacacaggcccatagagatcaccaaaaaggagaaaccagagaggaggtcacattcccaagaaagagcctgccgcaaagacccaactctccagaatcagttttctgagatgctggaagctagcagtacagcgtttcatccagaagtccccaatgacagtctaaaactgaaccccagctggaatcaagactccaaccaacaaagagaaaaaagaggagaaaccagagaaagatcccattcccatgaaagagcctgccacaaagacccaactgtccagaatcaattttctgagatgttggaagctggcagtacagagtttcatccagaagtccacactgacaatctaaaactaaacctcagctggaaccaagggaagactgttagcagaaataaaaagattgtttacatagaccttctccaagaagaaccagatgccaaaactgaggcaaacatgtccaaaccatgctttacagtgaaaaatattggtcagaatgccaagcctgccaagcccccaattgtcaaggcatccctgcagcagcatggtgattttatcatgctaagagaggagttggggcacattggtgacttgcatgaagcttatgctctcaaacggactccagccaacaaagagaacatagggatgccagtttcaacatcattcctggagccaactctagtgagtgatggtcatgctgtaacttttggtaaaatccaagagtatcccaaaccatattgccttggcagtgccccactaagtatggacataatctctacttacaccaaagatggagccaatgaggccaaatcaagtgatggcaaacttctgaaaccaaagccatctaacctggtaaagagagtcaccacctcagcaggttgcatggctgaccgactcaagtgtgttactactgaactgtatgcagattctaaaaccaaggacgccaagccatacaaattcagcacagctgactcagagaggtggaaaggaaatcaggacaaaaagccaaaatgtcttctggaggaggatattgccagccagaataactgtgagagatgtagcagacctggggtgtgtttggtcgcaatgcctgggcagaaattattggctcaggaacttctcttccaggagaatatgcctgaatgctttgtagattatcttgaattagatacagagaaagttgatgcccgtgatggagagggcataagttataacaagacccctcttcgcagcaccttaagtctgcccaggttctcagccttcctctggcagttgtttccctctgctgattttgcaggcaactgccatgtcctggaccatgggccctatggaagagatgattacttctgcccattaagggtttaggtttcttttgacatgctgtctcccttccctccttcttcatgatctctgctgttggtccaagtgaatattggtgttaccacttcagtagatgacattttgggtatattttgtgtcttcatctcatcagccttttatttcaaaataatgacctcagcacgtattactgtagagatatttatgccggtcctggcttgattggatcatgctgctgaaagaaaggactgtaatatttttttttaaaaagatagcattgatgtctcatcttctttcttatttgtctcattcccctaatatacagagatagaaggagagaattatgagtgtggtgtatgtctaactttctgctttgcttgctgctcatcttcagtgtatccttcctttggacaagtctatttatgagaacttgatattaacaatgtgagaactccagtttctaaagaagcatctgtcaatagcagattaccttggcatggtctcagctgttccctgaatcctgccttctcttggtgatttttgaattcacttatgtattctggttttctctcctgctaggcaagcat

SEQ ID NO: 480293 - DNA, 1645 bp, Homo sapiens
ctgcgcttttccaacaggcttaaaaaacagcgcaccaggagattatatcccgcacctggcttggagggtcctaccccacagagcatcgctcattgctaacacagcagtcggagatcaaactgcaaggcggcagccaggctaggggaggggtgccagccattgccgagttcgttgtgtgattaggtaaacaaagcagtgggaagctcgaactgggtggagcccaccacagctcaaagaggcctgcctgcctctgtaggctccacctcttgggggcagggcacagacaaacaaaatggcaattacctgatgacccaaaagttactacccttgagttcttttctgggcaaagcaaagaacactcccagactaagccccaatttggggctcacctgcattgtatcagtttggtgtccaacatgggacaaagaagaatatgacagtgtgaaagttggtgatggcgtcatcagtgaggtgatgtcaagagaagacaaatttgtgagaaaaggagataagatgggaagaactttattatgtgcaggctttttggccctctatcgggatcttaacctaagggctcgctgtagaatgtgtctggcttgtgatactctcagacatccagaagctgcattagatatgctacaggacctcctagtagctgctcccctgccttgcatcctggggatgaagctgactgatcatggtggtgaagcttttggatgtgctgctgaatttggaccctcagctgcaggtctgttggaatttgctggaggtccactccagaccctgtttgccagggtatcaccagcagaggctgcagaacagcaaatattgcagaatggcaagtgttgctgtctgatcctgcctctggaaacttcatctcagaggagcagccagctgtatgtcagttggctcctactggcagatgcctcccagttacgctactcagaggtcagggacacacttgaggagacagactgtccattctcagatctcaaactctgtgctgggagaaccactactctcttcaaagcggccagacaaggacgtttaagtctgcagaagtttctgctgccttatgttcagctatgccctgcctctagacatgaagtctacagaggcaggcaggtctccttgtgttcagatggagtttttgtgtgggtgtcttttttgtttgttagttttccttctaacattcaggaccctcagctgcaggtctgttggagtttgctgaaggtccactccagaccctattttcctgggtatcagcagcagagtctgcagaacagcagatattggaatcagaggacagtacaactgactgtgagggaaatgttccaatgtgaatcacagatgcctctgctgcacaaaagaagtcacacaaggaagtggggtagcaggtggcagccttgccatgagtgtgatcaatccaagagtggagtcctgcaatcttcactgccaaggggttggagagaaggatggtgtttcaatcctcgaggattaactccttttgtaaaagatgaagaatgtaccatttggcaagatgtgcatcgctgaataatcactttagcttctttccagtgtgaaaaggttccaagggggaacaaaccagagtacacagttgtcccattgttactctgatgcttcc

SEQ ID NO: 480294 - DNA, 637 bp, Homo sapiens
cagccaaagacctttagggagctggcccctgtgccagcacctggaactgctcatccatcatagccaatatggctagctgtaaggaacaaactctggacacgccgccgttaagaactgtcacactcatctcgagggtccgcggcttcattcttgaagtcagtgagaccaagaacccaccaattctggacacaggagggcctccatcttccagaccccagaatagtagatccactgacagcttgaattttgttcctggagaagccacagatactgaatgccagctggtggaaacaggagcaaagcttgatttacatgatactgacacaaggactaaccccactgttcccagaggcaccgggccccagatcccaattgcaaaacttttagagtcttcttcttttagcactaattcactggggcagagtaagtccagtcctgtgctcccagttgtggctgctctgaaagagaagactatgggcttcccatttgaccaaggaaagcttctggcattgccccagttgggagtggtgcctggagctgatccctcatgaagtttctgaatggtttcttatggagttgctgtttttatcaaatttagacctgcattgatctgcccaatacttccccttcctacttc

SEQ ID NO: 480295 - DNA, 542 bp, Homo sapiens
gctgtggcatgccaccgagctgttatgctctccaggcataaggacatgaaggcaataaggagattttctcctcagacgccatccatggctccccatgggaggtggaagggctccagtgctgttttaattgctgaccacacagaccaagtggagaagggaatatcgcagccctcttgttgtgctccttgtccaggggaccagagaattggaggcttgctcacggacccgagctctcaatctccacccaatttactggtttacaagctctttgttcttagaggccacccatggctcccatgggtgtctcacacaggggagaagaagtcatctggcatcccagaaactctctttcccacagagaatgagctatcttgttctggagtcctagcaatgttcaatgatttctgtcagagaacccaaaagcctcctgcaaagtgcaaacaacctcagcccccattaagagaccaagacccacaacctgggttgcagccagcctacccaaagtcccttgtccttcctgaaatccctggaggccaataaat

SEQ ID NO: 480296 - DNA, 851 bp, Homo sapiens
tccttgagtctagcgcatgcgcattcgtgaggcaggcaaggcctccaggctagcagaactgtcaggctgcctaagcacaggaaaatgtacagtcagagccgacctggtgcagatgaggttgagagagtatcttggaaacgtctgtggtggtgccaagtctgaaattgtgtccagtagtgctgttaaggggcactgtgtattccccttgaaagcaaagaaaaatcaaggctcaactgagagaaagagctgccttatggtgaaatccaagcaatgttcaaagactcctgtcagaggacccaaaagcctcctgcaaagtgcaaacaacctcagcccccacaatgagacaacaacccacaacctggagtgcagccagcctaccccaagtcccttttgctccctgaaatccctggcagccaaaagatctggggtgagaggcagtgcaatgcagcaacaacccaatgaaagagcccctccacaatgagaaaggacttgaagatgaattgaaacagaggctagattaccaggcaatatcagacatagctgcctgcttctcatcatacaggaatcttgcagccctctgaaaaataagtgggagaataggagtttcctttttggtggctgtaactgacatttacagttttaaaagtatcaaagctgcccagtcattaaaacacgacagtgtttagaaggaaacactcacacaatggattcaaatgagggtcgtcctccatgaactgggaaacctttattgtggtagacatttagacagacccaggaaaacctaggccaatgagggaaatgtaagtgaggagaagaggagacaagtgtgaaggtcacatcccaccaaacat

SEQ ID NO: 480297 - DNA, 2231 bp, Homo sapiens
tgccctgggcacacgggaggcctaccgccatggtcgccaatgcagtgatccatgtgcactgctttgctggtgcagaggccctcacaagtgcaggggtggccgtggtgcctgctagcggggctctggaagccagggccttggcatcctactccagggctgctgctggaggctgtgcaggagaggatggcctgtgcacagagcaggaaggcaaccctgggggaagaggcatgctagtgggggatgacatcattgcagagatggaggtggtggccaaggaggaggccaatgtggagccacagcaggaggacctgcaggcacagcctggccctggccccagtacgccccggccagcaacagactcgctggacgtccttcacttggagcgcagctacatgaatgtcccaggctgcagggcatccccggcttctgggccagagccatatccttgcagctgccaattcgggatgctccatggggagagccaggcacagccctgtagctacttctacgcacagcagttccatggggtggacacatgcacccctcagggagaccaggagaaggagagaccacacacccagacagcagcagagcctgtccagcacccagcacaggagggcctcctgcagctcagaaacactgagcaagtagttgcctcacacaacaacaccctgcccgcaaccccctgccaacttcttcagtgccagcccctggtcagagcaggttgtctgggcctgtctccacccaccaccaagaccaccacagctctgatggtgccctacacgccagagagagacagaggacctggaagggaaggtgccctgccccacactctccgtgctcttgcaaacttgcagggtgtttccttgcacgcccacccaatcatctggcggctccttgaccagaggcagattgtgcagcacacccagatgttggccgggatcacaaatgatgatgaagtcctgctaagttacgtatgtgatggatttgcagggaaggggaggaacgcaactatcccgggtaccggaggcaggatgaagttttccctttatcacaatctttacttccacaatgaagtgatcattcaagagtattgcttcggcatcctcgacaagagaggccactacacagggaatctggagaaccacactgggctcacagtattgtgaataggttaaaccttgtatagtattgtcattctctctttcataaatttttgaagaactctgatactgtttccatccccccacccctgaggagaacatgcagatagttccaaacaattgtggaacgtaatattgcacatatgaaaaaaaatgcagtgttaaataaaaagtagtggaattaagaggagtcattgcttagtgaattaaaacaacacacaaattgagaagaaaagacagtgatagaaaatatattgtctattgatttaattcagaataattttcatttttgtctattagcattaaatagtaccattaacataatatcattttgtatattgtcttctaacatgtaagtggtttttattttgtatatttggaaacctgatcaaagattctttatacattttattttttccgaaatttgctacctaatagctagctaaatgctagttgcctgaatgcctctcactaagttgtttgtcttttcctaatacatttaatatgaacttggtgtgtagtttgttggcatctttactaaatctacaggtgttgaagttgttcagatctcagtcatggatcctcttgggttttctcaaggctaaaacaccctttctatgctgaccattaagaaattctcaacttcaggccagatctttgttctaccttcagacttggcatatccaacttcatgccttacatctccacataccaaaaccagaccttcctttcatccccaaaacatgtttcctcctacagtattccactatttcagaaattcacagcaccaaataccctgtatttcaagctagaaatgtagaggatgattcttcaggcagccttttctcaatgactcttcatcatttacatccaactcttcacaggttgtgtgtcctctctgagaattacatagtcttagtaaatgaagagtggcccgtaagtaaccttcaatcgtccagtttttttttcttcaattcacgccagtttctctacagaacagctggagctctgcaatgtcaatgttggagtaagtaccattctctgccagtattaccattttatttatga

SEQ ID NO: 480298 - DNA, 1482 bp, Homo sapiens
agtggctgtgccgcccagggagacgcccaccgccctcccattgactggccacgacgggaggaaggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatattgcaaaccacccccagatgtcagccctgatcactgacgaagatgaagacatgctgagctacatggtcagcctggaggtgaggccaggaagactggggctagagggtttagcgggggaggaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcagaatcaatgagaagtaaagctgaaaatcattcagttcagtctgtggcacttgattccacggctgtcaaccccaccggcagtcatcccgccaaccccatgagattgggctccctgaatatgaaacagttccaacacgagcatccatgttgaccacacgctactagagtgctaacattgctgtcccgtatagactccagtcagcacagcttctgtgagaagagctatgttgtttcagggaagagggtttgacagtcaaagttcctgaatctgttgtggtgcctgcaatatgcattctacacctcctgctcggtgtcaaagcagttgagctttgaaaatctatcgcccggttttgtccctgctcctatgcagacctctgaagctctggagcgggagtcttgtcctcctctgactaccgtccccctgacccacaaacacaggagaaacaggtgttctaagcaaattattctgaaaacagtcggaacactttggccccctcaagctgccctctatcctactgtgtgcatgtcaaagacactgtggtccagtac

SEQ ID NO: 480299 - DNA, 1284 bp, Homo sapiens
gagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatattgcaaaccacccccagatgtcagccctgatcactgacgaagatgaagacatgctgagctacatggtcagcctggaggtgaggccaggaagactggggctggagggtttagcgggggaggaatacagggcttctcattccactccaattgagtggtatctggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcagaatcaatgagaagtaaagctgaaaatcattcagttcagtctgtggcacttgattccacggctgtcaaccccaccggcagtcatcccgccaaccccatgagattgggctccctgaatatgaaacagttccaacacgagcatccatgttgaccacacgctactagagtgctaacattgctgtcccgtatagactccagtcagcacagcttctgtgagaagagctatgttgtttcagggaagagggtttgacagtcaaagttcctgaatctgttgtggtgcctgcaatatgcattctacacctcctgctcggtgtcaaagcagttgagctttgaaaatctatcgcccggttttgtccctgctcctatgcagacctctgaagctctggagcgggagtcttgtcctcctctgactaccgtccccctgacccacaaacacaggagaaacaggtgttctaagcaaattattctgaaaacagtcggaacactttggccccctcaagctgccctctatcctactgtgtgcatgtcaaagacactgtggtccagtac

SEQ ID NO: 480300 - DNA, 1503 bp, Homo sapiens
gatgggcagctcggcgtcgatgtgactctttggggaacaaaggggagttgccacggaccagtgtggctgtggaaagccggagcaggcgtgggtactattgtcctgcatgcggcagagaaacccttggtgatgccgagcagcagacgtttggggcatctttttgaagagcagaagcgagttcagagcggaagaggtttttcagtgaataaagctatttttaagggaattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcagaatcaatgagaagtaaagctgaaaatcattcagttcagtctgtggcacttgattccacggctgtcaaccccaccggcagtcatcccgccaaccccatgagattgggctccctgaatacctctgaagctctggagcgggagtcttgtcctcctctgactaccgtccccctgacccacaaacacaggagaaacaggtgttctaagcaaattattctgaaaacagtcggaaccctttggccccctcaagctgccctctatcctactgtgtgcatgtcaaagacactgtggtccaatcgtgctgaattatacaggctgtgtaatgcttcttccactgaatatccgtacacgtgggccacagatgctaagggcactgacaaatttgcaccgtgcctcagtaactcggaagcacatctgtgatttgtaccgacagggacttggtgtcttttccctctgtgcctggaatttctatctttcaactcatcatcagcattcattgggattttcatatatatatatatatatatatatatatatatatatatatatatatatatatatacctatataagaatacctatgtacacacatatatacgtatatacatgtatatacgtatatatgcacatttatatacgtatatacatgtatatacgtatatatatacatgtacacatatgtatttatttctcaagttacgaaacggcttgcattctttcctgtgtcatgaaaaagactttgctagaaaagaaaagcactgctttataataaaatattttatttgcatttattttgttaaggcattttaaaaattgtatgtttgtttaaaaaatgtcatatgaaatgatacatatttacaactta

SEQ ID NO: 480301 - DNA, 1045 bp, Homo sapiens
gagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatattgcaaaccacccccagatgtcagccctgatcactgacgaagatgaagacatgctgagctacatggtcagcctggaggtgaggccaggaagactggggctggagggtttagcgggggaggaatacagggcttctcattccactccaattgagtggtatccggattatgaagtggaggcgtatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcagaatcaatgagaagtaaagctgaaaatcattcagttcagtctgtggcacttgattccacggctgtcaaccccaccggcagtcatcccaccaaccccatgagattgggctccctgaatgtgaggagccaataacgtatgtagctaacaacagtacgagtgcattttgtgctcttgcaaagtctagtgaggctctattctccctcgtgattggcactgcagattgtatctggagcccagggcccctaaattttctgtggcctcttcagcatagtttgcctaaggtttagaacgtaaagcgaatatagttgc

SEQ ID NO: 480302 - DNA, 1445 bp, Homo sapiens
gagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcaccggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatattgcaaaccacccccagatgtcagccctgatcactgacgaagatgaagacatgctgagctacatggtcagcctggaggtgaggccaggaagactggggctagagggtttagcgggggaggaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggatgtgtgactctgacttctgaaacatcaacgtgagaagaaatgggcatgtaaggtgtatggagggactgtgggaaaggtgacagaggcatgtgggaaggcattcaggatacgcttttggcagagatgactaagggaaaacagaaacttacagaagtgaggggaaagggggtggattagtggaatataagattgttggagaatccatccatggactctcttgtcacttgatgacccaggatatggacactcttgttgatgtttacatctttagttgttttaagcttttctccaagattctgtgttaggtgaggagccaataacgtatgtagctaacaacagtacgagtgcattttgtgctcttgcaaagtctagtgaggctctattctccctcgtgattggcactgcagattgtatctggagcccagggcccctaaattttctgtggcctcttcagcatagtttgcctaaggtttagaacgtaaagcgaatatagttgc

SEQ ID NO: 480303 - DNA, 1460 bp, Homo sapiens
agtggctgtgccgcccagggagacgcccaccgccctcccattgactggccacgacgggaggaaggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccagctagaccgcagaggcgccgtcatccagagcgtccctggcttctgggccaatattgcaaaccacccccagatgtcagccctgatcactgacgaagatgaagacatgctgagctacatggtcagcctggaggtgaggccaggaagactggggctagagggtttagcgggggaggaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcagatgaaacagttccaacacgagcatccatgttgaccacacgctactagagtgctaacattgctgtcccgtatagactctggtcagcacagcttctgtgagaagagctatgttgtttcagggaagagggtttgacagtcaaagttcctgaatctgttgtggtgcctgcaatatgcattctacccctcctgctcggtgtcaaagcagttgagctttgaaaatctatcgcctggttttgtccctgctcctatgcagacctctgaagctctggagcgggagtcttgtcctcctctgactaccgtccccctgacccacaaacacaggagaaacaggtgttctaagcaaattattctgaaaacagtcggaacactttggccccctcaagctgccctctatcctactgtgtgcatgtcaaagacactgtggtccagtacggtatccctatagcggcaatggggcaacagattggtgtgtgcactctgggcaactcagattaggaaacgtctggggacttgcctataacgaggt

SEQ ID NO: 480304 - DNA, 1593 bp, Homo sapiens
actgaatatccgtgcacgtgggccacagatgctaagggcactgacaaatttgcaccgtgcctcagtaactcggaagcacatctgtgatttgtaccgacagggacttggtgtcttttcgtgtttaaagtagcacgtgtgtgtttgtggttgctctcctccctgagccttggcttctctatgtgtgtcctaactccaggacccacaggcctgtcaacccccagccctgggctgcttccctggcctcttctctgttccctctctgagggcctaactcccttgggtagtgctgcagaatatagagccacaggccctggctgatgatctggtggactgggcaaattggtcgtgacaggtcaggttctggttcaaagccaattcctccgatgccaaggaatgtcgaagaaggcagtgacctgcgggaaactcgggctttcacctgcatgaccctagaaccactggactgcagtggagccagtcgccctgtatcctggagggagacgagtcaggaaggcgcacgccaggcccagcttccgaggtactaccccctctactcctcagggaggatgccaacgcaatactccttacaacttctatcttctatcatggaagccaaggttatttggaccaaacctcctgtcttagttcattttcacgctgctgaagaagacatacctgaaactgggaataaaaggaggtttaattggactgacagttccacatggctgtggaggcctcagaatcatggtatacgaataaaggcacttcttacatggcaatgccaagagagaatgaggaagaacctgaggcagaaacccctgaaaaacccatcagatcccgaagaatcctttatttccttgaacatttatgagactatacagattatatatgtcttcttgtatcaattttactaagctatatacatagcttatgtttatatattatatatataaatgtaagatacaaatataaaaattatgtataaatatgaaaatatatatagaaagcgatatatatgtctatatatatagacagattataaatatctgtctatttgacctaagttttcaaatttgtaggttaaggtgttaacgatatttccttattagcttcttaatctatgctgtatctatggttgtgtaccttttaaattcttagttttatctatgttttctccctttttttctaaacttgactgacggttgcatcacttattatatttctccaacaagcaaaggttagctttgtatgttttactaattttgtctacatcattattcccacactttagtttttcagaattgattctgttgtttcttttctaattctttattgaaatatctagtacattaattttcaagttattagagaaatatttgtctgtaaactcctattgtaatatcacttttcttgctactcacagatttaatctttaatattggcggtatcattgagttctaagtacatttcaattcctagtatgataatctatgaattgctgagaaatagtgtttacaattttgttgttctatttccacttaagtttatttttacttctgctaactcaattgaaaattctttactaatttttaaaat

SEQ ID NO: 480305 - DNA, 506 bp, Homo sapiens
gttagtccacctcacacggaatctggaggaccacactgggctccagtatgaaattgccccttcacagccctgtttctccttcttggacaggcaggtggaggaactcggccaccctgaatacaaggggtaggaagaagtttgcctttcatcacaacatttacttcggaaacaaagtgacgactaaggagtattgctttcccgcaggtcactgcctgagcttcttcagctggttgtctgactgtgagggcccaggttacggcacgattgctgaggtggggcagctatggggcatcatggcaaaggaccttcttcgacattccttggcatcggaggaattggctttgaaccagaacctgacctgtcacgaccaatttgcccagtccaccagatcatcagccagggcctgtggctctatattctgcagcactacccaagggatattggtgaggacacccagtgtctcttggccctgagcttgtgcacacaaacacgcacattgtctaaac

SEQ ID NO: 480306 - DNA, 1316 bp, Homo sapiens
aaatccaacatgcagctttgaaggactttctcatgcaacttctatcttctgtcatggaagccaaggttatttggaccaaacctcctgtcttagttcattttcacgctgctgaagaagagatacctgaaactgggaataaaaggaggtttaattggactgacagttccacatggctgtggaggcctcagaatcatggtatacgaataaaggcacttcttacatggcaatgccaagagagaatgaggaagaacctgaggcagaaacccctgaaaaacccatcagatcccaaagactccagtcaaggcctagggactactcatgaaaagagtttaatagccgactctctcccagtggatctggattccaccggactgtatcttcacagtaagggtgaaacagaagcaaacccattcctatttccaagctcaaggaactttggtcaaagttctcttggagctgagcagaacaaggaggcaaacagaaaagatttgtaattcttcatatatattgaaatgctctgcctggggaaaaaaatctgagcctagcgttttatctctaggaagaatcctttatttccttgaacatttatgagactatacagattatatatgtcttcttgtatcaattttactaagctatatacatagcttatgtttatatattatatatataaatgtaagatacaaatataaaaattatgtataaatatgaaaatatatatagaaagcgatatatatgtctatatatatagacagattataaatatctgtctatttgatctaagttttcaaatttgtaggttaaggtgttaatgatatttccttattagcttcttaatctatgctgtatctatggttgtgtaccttttaaattcttagttttatctatgttttctccctttttttctaaacttgactgacggttgcatcatttattatatttctccaacaagcaaaggttagctttgtatgttttactaattttgtctacatcattattcccacactttagtttttcagaattgattctgttgtttcttttctaattctttattgaaatatctagtacattaattttcaagttattagagaaatatttgtctgtaaactcctattgtaatatcacttttcttgctactcacagatttaatctttaatattggcggtatcattgagttctaagtacatttcaattcctagtatgataatctatgaattgctgagaaatagtgtttacaattttgttgttctatttccacttaagtttatttttacttctgctaactcaattgaaaattctttactaatttttaaaat

SEQ ID NO: 480307 - DNA, 582 bp, Homo sapiens
actgaatatccgtgcacgtgggccacagatgctaagggcactgacaaatttgcaccgtgcctcagtaactcggaagcacatctgtgatttgtaccgacagggacttggtgtcttttcgtgtttaaagtagcacgtgtgtgtttgtggttgcgtagtagtgatgtcaatgccgtttagacaatgtgcgtgtttgtgtgcacatgctcagggccaagagacactgggtgtcctcaccaatactgaggtgggccttaatatccagccagattgccttctggaaacacacggaatgtcctgttctgttttgccatctcttcacatttcctcccctgtgagccctgtgtggtcctccagattccctgtgcggtggcctgccttttttggggtggggagttgctgggtgaatgaggatggcggagggaaccaagtatgtcagtggagcgtggtgtcatccaaacggtacttagcaggcctgggagagtcattctgggaggacgcagacctagagaggcctcaggtgggcatctgtgtggagggtgagagatccctggttgagcccaaactgaaccccaggtagaagca

SEQ ID NO: 480308 - DNA, 608 bp, Homo sapiens
cggtcttggcgcggctccaggtgccctttgagtgcagtccgttaggtggcgcctggaagccaggtgcatgcgccctgagttcccgcccacccacaggctacagaaagggcagcgcagggttcctgtgctatgggtcgggctgcacaggcggtggtctatgggagtccggagaaggacaccgtcttcagggtgcaccgtcttcactctgcccgaggcgcagagggaggaggcaaccttgaagcaggagacagtgctggtgttggatgacataatggcggaggtgggggtgatggccgaggaggaggccctcgtggagcggcagaaggaccagcgggcacagcctggccctgggcccatgaccccagagtctgcactggaggagctgctggccgttcgggtggggctggagctggttaatgcccaagccaggaaggccttttctcggcagcgggaaaagatggagcggaggtgcaagccccacctggaccgcagaggggccatcatccagagcatccctggcttctgggccaatgttgtatccttttcagtgtttcttctgcctttctagttgagaggtgctcttggggaagtgattgacttggcaatgc

SEQ ID NO: 480309 - DNA, 514 bp, Homo sapiens
gatcctccgagctgtcttggtggggctctctgggaaaggcatgcaccatgaaaaaggcaagtcaaagttggatcaatgttctcacacctcggactggcctctcttgggtgcagatgaggttgaaacagcatctcagaggccatctgtggcgattgcaaacctgaaaatagtgtccagtagtgctgttgatggacaatgtggaatctctaggaaagcaaagaaaaatcagtgctggcctgagagaacgagctgccttgtgctggagtccaaggaatgttcgatgcttcttgtcagaggatgcaaaatcctcctgcaaaatgcaaacatgctcatcccccacgacatgtccacaacccacaaccaggagctcagccaatctacccaaagtcttttttaccctctgaaacctcttgcagccaaaagatctgtggtgacaggcagtcccatccagcaacaacccactgaaggagccccgtgacaatgagaatggacctgcagatgaaatgaaacagaa

SEQ ID NO: 480310 - DNA, 1265 bp, Homo sapiens
ttgcaaaatggctggggaccttcaacagccggagtgctgagagccgaatgggagtctggacatcttggaggagtagcaatgccaggatatttcttgctgctccactcaccaaccagaatctctcatgcagcagaatggtagacaccttcacaactctcagttgtgccccaggatgcctcaggcccagtatcacagcagtgtcttcaggactcctgtactttcctccaagcatagaggaaacaccaggggttgaaaatgtagtggctgcttcaggaagatcaacccaggtcctagaggtcccttgggagctagcagaagaggctatggataggagaacaggagaagagaccagaggaaaaataactgagaaagatgggaaaatgcaaaatgaagggaatgcacaagaagaaaagattgaacaagaagaacacagtgtatgtggagatggaagagaacaagacagaaaaaagaaaaaggaggaacaaagagagataagagaggttctcactttaccagctttaaaaacagcaaagcattcaataatatcagcttcagactggatccagtgcatgtctgctttggctacagatgttcagatgtgtccagagtttcttccttctgatgggtttgtggtctcgctgacttcaagagtgaagctgcagaccttcccagtgaatgttacagctcttaaaggtgtaacagctccagagttgtttgttcctcctgctgggttcttggtctcactgacttcaggaatgaagccacagaccctgaggaccatatcagtgatagcctttcttcagggattaattgctggagatttacctggaatccatgttgactacaagatactggtggatgttcagcatgggtctgtgatagtaatataccatgtgcccagggacctactcctagagtttcagccagaatccacgtttctgcgttctgggccacaatatctaatatttatgccgaatccagggtctcactctttcagtttcagtttgtaaccatggtttaattgtatcagctttcaagtgagtcaagagtcttcctgattgagtttctggctgggaccacgtttggaatatggttgtttcaggctgattccagggtctgatcatgtcaactttagagtgaattaagggctcaattatgttcataataggatttattaagatccatgtctgcattgggggtttcagtataacagcctcatgtttattcaatgtactaaatctattcatttgatataaaggcctgat

SEQ ID NO: 480311 - DNA, 495 bp, Homo sapiens
tgattggccgctggagtgtcccctggtaatggtcccctggtgtcccaatctaaaaattgcttgttcagcttctatgtcgggttggagtcttgcccttaccatgtcagagtttattgaaatcatccaagttccggagaaaccagggattatgctccaccacctagagactatgcatatcgtgattatggtcattctattcaggatgaacattcctctagaggatatagttaccgtgatggctactgtgaggcctatggtagagattattctgaacatacaagtggaagttcttacagagatgcatttcagagatatgaggactgctggtcactctctgcgaaacagcggctggagccccaaagatgttcgagtctgctatatcccagaaaacaagattgtcaaagttgtaaatattcagtggctatctgtccagattcagagtgagcataatgaatgacggtacaggtgtcagtcatggacactattcttggcata

SEQ ID NO: 480312 - DNA, 1110 bp, Homo sapiens
atcgggcatttctcagagagggtgatgtggcaggacaatagggtaatagtggagagagggtcagcaggaaaacgtgagcaaatgcctctgcatcatgaacaagagcccagcagactcaaaagtggcagggcctgacacttcctacctccactcccattggactattagctacggagaaatggaggagcctcaggtgactcttgaagtagaagaatgtaatgacaactgcaagcaaaccttcaatactctcaaggagaaattgggctctgctgcagccgtgggagtccccaagttggatgaactattttttctttatgtgaccaaaaagcaaagcacaggccttggagatattgctgctaccacttttctagcaggcaaagctaataaactaacattagaacagcacctacaggtttttgaccccacatcaagggaagatgaagcagccaaggcccctgcactgaaagggtcaatgaagcttatgggcgtgctggcaagcatacatagaactgagccagaacactctgaagaagaagaaaaatgggccagggatttcatttcagtaaacctgtccaaaattgagaaacctatccagttgaccagctttccccaacttggaaaggaccacagcaaggacatcggagctctccaacagacgttcaacgccaagggattaacaaatgggtacacctgtgtggaagtaaagctgttgcttattctgggagccgaatctgaggctgacggatgtgggacataaaccacaaaagcaacaagacatgtacgggaaaagtgcttcttaagatcattttattatcatgtataaactctttctgatttcaatataagtttaagaactcttaaatcgacgaaggaaagaactaaatttacatatagttttgaagctctgagattctttcctccacttggcctattctgtgagtgatagttgtggttgcgttgtgaagttctcattttgtgtttttcagctctatcatgtgatgttcctctctaaactgaatattctggttatcaactactgtgttcttttatatttttaacttcttgcattaagttagaacgtgctccttcagctcagagaagtttgttatt

SEQ ID NO: 480313 - DNA, 496 bp, Homo sapiens
ccacttctgcagaggcctctactgcatccctgcctcatgggcacaatgtcacagaacagaattacatcatgtgggagaccatatgcagtcaaagaccccatgaatgggataagtggccttgtaaaagggagccaagggagcttgttctccttccaccatgtgaggacccatctaggaggtgccctctataaagagcaggccctcaacagacacccaatctgccactaccttgacctcccatttgccagcatccagacctatgagtcaggaccctcagctgcaagtctgttggagtttactggaggtccactccagaccctgtttacctgggtatcagcagcgatggctgcagaacagtggatattggtgaaccgcaaatgttgctgcctgatgcttcctctggaagttttgtctcagaggagtacccagtcgtgtgaggtgtcagtccacccctaaggggttgtgcctcccagttaggctactcagggatcaggga

SEQ ID NO: 480314 - DNA, 549 bp, Homo sapiens
ttgagttaaacacctttattcttgctgagatcaacacaacattttgcaagcaggtatttgcattgcggtgtaggaaaactgtgtactttgaagagactatatgcgttataggcctttcctgggtagtaagaacaggtcgccagtaaaaacaaggcttcttctgagtgtacttctgcataaaggcattctgcggggaaaaccccatctagtggggcctagggctggagctctctctgtgcggactgctgactccctctaccttgggttccattggccccagcctgggacatgggccttggcagattctggcccttcctggcccttacgtcgctgtcagaaaccccatcttgtgctcggatgccccagtgactgtggctcgtgcctttctggaaacactggaaatctctcctctatgcatggtcacctaaaaccccaggagctcaggacacagggccgccatccacctcactgctttcagaagagaatgctgagagtctcttacagactctctcttgacttgagttcttcatgggtgtgtggttaagatgt

SEQ ID NO: 480315 - DNA, 614 bp, Homo sapiens
tttttaatctgacagctttcacggtatacatgtgtaatattgtcgacggagaggcgcgagtgggaaccggggctgcgtgcggtgcttgcgtgccagctggagttccgggtgggcatggactttgtgggccccgcactcggagcagccagccagccctgctggccccgggcagtggggaacttagcacccgggccagtggctgcggagggtgtactgggtcccccagcagtgccagcccaccggcgctgcgctcgatttctcaccgggccttagctgccttcccgcggggcagggctcgggacctgcagcccgccatgcctgagcctcccacccactccatgagctcctgtgcggccagagcctcccggacgagcaccaccccctgctccacggcacccagtcccatcgaccacccaagggctgagcaatgcgagcgcacggcacgggactggcaggcagctccacctgcagccccggtgcgggatccactaggtgaagccagctgggctcctgagtctggtggagacgtggagagtctttatatctagctcagggattgtaaatacaccaatcaggaccctgtgtttagctcaaggtttgtgagtgcaccaatc

SEQ ID NO: 480316 - DNA, 1962 bp, Homo sapiens
tccacagatctgtatgaaggctggggaagcctcaggtaacttacaatcatgttagaaggggaagcaaacacatccttcttcacgtggcaacaggaaaaagaagtgctgagcaaaagaagaaaaacccttcataaaaccattggatcttgtgagaagtcactcagtatcacaagaacagcatggaggctgtataggaagcatgatgctggcatttgtttggcttctggagaggcctttacagtcatcacagaaggtgaagggcaagcaagcaaacaacagaatctagagaataggctaaccttcctgtgttccctgagcccagtcatgaagggccctcattcctgggcctcaggccaagaaaggaatactacaaaagggctagggtcccagaccacacagaagctccatgagacctctcctcatctgtgcatggagctcttggaaagagactatggaattttctagaaattttttcagtcttctttactcttttctctttacttttatctgagtgttttcaaagacctggtcttcatgctctgagatttgtccctcaccttggttgattctactgttcatactagagattgtattatgaaatatttgaaatgagtttttcagctctgttagatgagtttagttttcttcttaaaatgatcattttgtctttgagctcattgttttgtcgtatccttagattccttggattgggtttcagattttcccaaatctcaatgatcttcattcctatccattttctgaattatatttctgtcatttcagccatttcagcctggttaggaaacactgctgaggaactagtgggtttgtttggagaaaataggacactgtgtcttttggggttaccagagttcttgtgctggttatttcttttcattgttttgatgttccttcagtctttgaagttgtcttcctttggatggggtttttacttttatcttctttgatgcctttgggggtttgattgtggtataaagtaggttcaatcaactagcttcatttctggaagattttaaggggataagtctcaactcttagactgtgtcccctaactctgagggggggctgatatatggccgcttgctttgttctgtggccccttgagtttaaaaacctcatgtgctgcagggtccaatatgttcccagtccactagctacaacactttcattggcagtgctggctaaagcattttgttggcatagtggcagtgggatccatgcttgcttgtgtgtgccagcagctgcagcagtgtggcggggtgcacacgcatgggctggcatggcatactggcaggagtggggctgtagcattcctgcttgtgcctatgccaatggcctctaatcttttttataagttgtcggatttggtttgcttatattttcttgaagattattgcacatatattgctaagaaatattggtatgtagttgtttttcttttcttgagatgacgtatttttttttaatcaggccatatataatgggttaaatattttttctcttttattttattgtaaatatttctttaagattggtgttgattacttaagcttttggtaaaattaaacaataagggcacttagtcctcaactcttatttacgggaacttttaaaattaccgttataaaagctttattgttaccggttggaatatattttctgtttcttcttaagggggttttagaagttttgtatttgtggtcatctatttcatctaaggtatctaaattgctttcatacagttgttcatgttatttcttataatcatctttgtttctgtaatgtctgtaaaaatatccctcttttattctaaatttaactcatttgagtcatctgtatttttatttttagtaagtctagccatagttgccaatttgttaatgttttcaaataagcaaattttggttgtactgttttgtgtctattattttcctagtcttt

SEQ ID NO: 480317 - DNA, 570 bp, Homo sapiens
ctacaggttaccccatgacattacagatctgcagtcagggaacaaacccaggagtctatttatatattagcaaaaagcctcagacccgtccagcccaacaattcctagtatttgagtcattttatgagcatatcaaccaggagttgcctgagccctcccctttgtccagaaacctatttgttcaactggctgaaagtattgccagcagcctaggcatctcctcatgctatgtctgtggggggaccaacatgggggaccaatggccatgggaggcaagggacttgatgccccatgataacttcactctggtggctccttcccccaaacccatgctcacagatcggagcatctggctgttaaaaacctctattgtcgggatgttctgcattgcctgctggggaaaagcctttacagacccaaattttggggagtttaaatactccctagaggattccattggttactttgggttcgccctatgtaaatggagaggatgaagtaaagttacaaaataatttaaggcatacccctatggagagagtattacctgttataggtgaagtgtgagtc

SEQ ID NO: 480318 - DNA, 1019 bp, Homo sapiens
aggagatatacctaatctctctaagttcatctcagctccaggtaaagtcaaatccttctcccatgatgtggacattaaggttccccagtgaggatgattgtttaggggcagacgatccccctttcacattttcacgctttgggcactcagagtttttcggccatttcctggagcctgaagtagcaattcacttctttcaaagggtctgtggattcctttggctttcctggtatggtcctgctgtggttcttcaagcaaaagttttggatatgggtatccacatgctgctctgtccatgtaagtgggagctgcagagccttcagccacagagccaggaagatgctgctgtctctagtacttcacatgtactcgcctgcttcggacgtcatgctcctaggcatggtgctcacccatgtgccggcctggggagtctggcagctgccctccgtcatcccgtccgccagcttcttccaggcggtggacagctggctctactgcgtctaccagagtgtggcgctctttgagaactacaccagagtacagatattgctacatggaagtatgccaaaaattaagaaaaatataatgtatttagcaaatcatcaaagcacagttgactggattgttactgatatattggccattgagccgaatgctcttggacctatgtgctctgtgctgaaagattaaaatgacttccatcatacaggtgttacttgtctcagcatggaggaatctaaaagaaagtgccaaatgtattgaaaaagaaatgagaaacaagtggcagagctacatgaatgcggaaactgctatgcattttatgatttttttccagaaggtacaagtcatgtaataatatattccatagaataatgcttttaaaaaaatgtgaaatgctcttttttatgttataatttaaacttgattggctacttattctttatgttaacatttctgcttactgctagtgaatttttgctagaaaattataccaatgatccaaatgaaacacaccgatc

SEQ ID NO: 480319 - DNA, 478 bp, Homo sapiens
gatatttggatcgtggggtggatccatcatgaatggcttgggccatttccatggtaatatgcacatttctcaggtgctggcagttgcagtagtgggccaagcaggtgggcaggacctcaggcccgtgggcaatgtccttaacatgaacaatggtagtagcagtgtcgggataacggtgtatgtgggggaatgtctgtggggttctgaagatgtggagatgctggttctgctgggcctgaaggcaaactataatcagcctccactagtgatacccagggaaatagggtctggagtggacctccagcaaactccagcagacctgcagcagaggggcctgactgttagaaggaaaactaacaaacagaaaggaatagcatcgacatcaacacaaaggacttccacacagaaaccacatcagaaggtcaccacatcaaagactaaaggtaggtaaatccatgaagatgaggaaaaacctgca

SEQ ID NO: 480320 - DNA, 522 bp, Homo sapiens
ggcatgtaaagaaagaagtttgacagtgagatgttccaggccatggggcccccttgggcacagactgtggcagggagacgtcccacaccttttctggaccagccctgtggagggaagaatgctttgctccctctccagcctgggaacctgcacatcttgcccctctcagtgctggcagttgcagtagtgggccaagcaggtgggcaggacctcaggcccgtgggcaatgtccttaacatgaacaatggtagtagcagtgtcgggataacggtgtatgtgggggaatgtctgtggggttctgaagatgtggagatgctggttctgctgggcctgaaggcaaactataatcagtcaaggaaagctgtgagggactgtgccatgaggaacagtgcactccagcccagatactacgcttttcccatggtctttgcaagccacagaccaggagattccctcgggtgcctatgccaccagggccctgggtttcaagcacaaaactgggtgaccatttaggcagacacc

SEQ ID NO: 480321 - DNA, 831 bp, Homo sapiens
ggcatgtaaagaaagaagtttgacagtgaggtattttctgcagtaggggcagggagaaagatgtttctctcaccagatccattcaagggacttgggggaccctcctccaatcactggtactgtgcttgcatttcttttaatgaaaatgaacctaagattataaaaatacagatccaacaaattatttctaaaccagaaatgatgaacaacactgatgatatattgatggaacaacagatgaatcctttcaatgccctggtttattttgtggtcccttggagatgtgaatcttatgaagtctttgaaatgtggcaattggttgaaagagctattaccaatagaaacgaacgtctgggttatgacaagaggtggtggagaccaaagttttattatgcagatggagcctccagaaaggtggagacaactcaagttaaggtcccccaactgggggcttccaggttacaggtaggccttgacttgagtgcaatgtattcaggagttgattcctgtaactttactgccgaggggattgaaagaagaacagtgcaaggcccttgccagcttgacatagggacggagggatgtgagattttcactaataccacattttccgttgctattttataggacatccagtagtggggatatattgctcatctccaaaattatctgctatttgcagagctgcctactttccagctgcagtgagggtttggtttgggagcagcataacatctttccatgtgaggtgaaatacctgagttgaattgtgaaaagtttctatatacctatcagggtcatcagaaaatcagcctaagtttccctttattt

SEQ ID NO: 480322 - DNA, 691 bp, Homo sapiens
aggggtttgagcagcagggcactgaagaactatagtaggccccagtacagcaatgtcctatgcccaggaaagctgtaagagcacagaagcctctacctagatatgaaagaatgtcccggagagctgagctgcagggaaccaggcagaaaagcataacgtggagtgggatcaccagcagagatccttcactggacaatgaccatctgagacttgtagcaggacctcccctcacaaaccacagacttttaggatttataaccagactccagtcccggcaggccccaaaaagtgagacacaaagtgtgaccttggaggaagtacactacatttcagaaaacttacttgaattttccaatttatatagacataaatacaaggaatatgtgtggaaatggatattaaaggtgtgggataatggaggaagaaatataaagtttgaacagactaaatttattgatatgggctcattaagtagagattccacatttaatgctgtgaatcagagagttataaagtactttcacagtttatttggttggttgactgaagcatgaaccaaaagatagcctacagtgagtgaactggaaattcccaacctgcctaagttaaatatagataaagtggttgaaaagcttaggcatattgcagagtaggcctttattcataaaattaagacttagttaacatgacc

SEQ ID NO: 480323 - DNA, 580 bp, Homo sapiens
aggcacctctggacccactcgaggtctgggaaaactcaccaccatgaagggaaagacaaaggcctggctggctttaccacctcctaattgtagagccccagatattaagccaatattaccttcaaggagaaatgctcaggtgaaggcagggcagcagtgctgtgggcctttaactgcagagaccaggtcccctcagctggagcaacagagactggcagctgtggggtgtgtggcacacttgcacttccctcctacaaaagtagctctgggttttattaatactcttgggggcatgcacatgtgctgggcctccttgctctctctctggccctggagtggcaaggacttagcctgtggctgtggcagctgcaaggggctagtcagcgacctctgggagtgtgctctcagaggaacacacagccacagctgcagtgttcagatgaaggtggggcaggtgcactggaggcctaaagatgacaaggcccatttggcaggaagcagtgaagttggggagctgtggggcataaaatctgttgctgttctgtacctcatctgcagttatctgtgctgacagtgccag

SEQ ID NO: 480324 - DNA, 1024 bp, Homo sapiens
gtgaagactgccagcacgctgtcacctctcaggatgaataggaagcccctctgctgccagtctgctggagtttgccggcggtccactcccaaccctgtttgcctgggtatcaccagtggaggctgcagagcagcaaagattgctacctgttctttcctctggaagtttcgacccagtggggcacctgccagatgccaaccagagccctcctgtatgagtttgaacttcccggcagctttgtttacactgtggccctaaaactgcctactcaagcctcagcaatggcagacgccccttcccccaccaagctcgaccatcccatgtggatctcagattgctgctgtgctggcagccagaatttcaagccagtggatcttagtttcctgggctccatgggggttgtgaagaccgtgatacaagtgcagtatctgtgccggagttcctcaggctcagaccttgacggcttcccctgggtagcggggggaattccccgaacccttgtgcttcccagagtgattgtggtttccacagacatgcagaactatgataagaaaataagaaatattagaggaaaatattatcctctaaaaacaaacaaacatcatagagagtctgggcttcgggtcacagcctttagccttaagaccagacttgtataaaacctagagttaggattgttaaccattttttatgtgactgacaaccagcctctgaatgtgttttgcaatagcaaaatatctatctgctactactatctgtgaataatccctatgtgtgattattttaatcacccaaaattacatatagatagatggatagatatacatattgtattactatatgaaaataaaaatgctgtcttgaattgctgattggaaaacaaatatgcagttatctccattaggaatttcaggtttttagcaactgaaacatattattataaacatgggtttcatgaaattgctcttcttgtgctttatgtttgaataaaattgtatctcttaatttgctcacctttttcttt

SEQ ID NO: 480325 - DNA, 1340 bp, Homo sapiens
taacgatttaatggcctctagagtgtctgacaacccttgtttgttggggcagtagggggggtctcagccagttggatggcatgggaagcaggattcatttaacaaagcactttggctgtcccttggtagagggggtgtgcagcactggagggaaactcactcatcagggcttcccagattcctcagagctagtaggaggaaagactaagtctcctggtctgtggagactaagaccaaccatccccttaggggctcagtcccagggagatcagagttttgttcctgagcccctagctggagctgttggagttcttgcagggagtccctgcagtggaagtgttgctgccacccttcccccaaagagctcagctggcttagaaagcaggcagctgcagcagtgccaatctactgagagcccaaatatagcaaaaaggcagaaggagggcaaattatctctcttcttgaactggaacattcgtcttctgctcttagatattgacgctcttggttctcaggcctgtggtctccaggacttacaccagtggatcccgcagttttcaggcctttagaagtatacaaaattatatcactggctttcatgattctccagcttgcacatgaaaaatggtgggacttctcagtctccataatttcatgaaccaattcccataataaatctctctctctctgtttccgtctttctctctctatctctcttcctatctctactgctgcctttatctctctgtctctctatacatgtataaatggtattacattactttatttctttattatgtgattattagatttataaatgttgatttatacctatattatcttatgtgactatgtaaatttgaagacacagctctgttttgcatataaaaccaaattgcatactatactttatgggaaaattacatagaaactataaatgaaagtataaattttcccttgggaaaagcttttaaagaaatctatattattctgagagtgcaaacatctcctttacacagactcaaagaaattcagttgttatagtaagtatgtcttctcctttgaaaatgtgcattataaagacattttaagaagcacgcattctacaagtttccctttgtaatttagccattagcaatggtatatacatacagacaattattagtcttgtgcttcgaaatagctgttgatgatggactggttctataacatttttaagactctacatgctcttttttaggaaaatgactttgcacctttctttctcatttattgtaaagtggtaatcctataaaggcaagaaagccaaataccaaaattatgcataattctcttatatt

SEQ ID NO: 480326 - DNA, 671 bp, Homo sapiens
ttggtgatattttacaagaagagagaaagcaggaaaaacaaaatggtcgctaacctaatgataatattgataatgaaaataatagcagcacaccagacccaacaacttcgtctatttaacacttcaggtgatgccaccaatccagacagaatgtacgaccttgttgctgttgtggttcactgtggaagtggtcccaatcgaggccattatattgcgatagttaagaatggagatgaggaatttactgggaactggagtaaatgtctctcatgctgtgctttagcaaagagactagcggcatcttgtctctgccctagagatctgtggaactttgaatttgagagagatgatttagggtatctggcagaagaaacttctaagcagcaaggcattcaagacgtgacctggctttttataaacgcgtacagtcatatgcactcacaatgagatgctgattttttttgctatttaattatagatgtttctcttatattttgaatatcaatcccttgtcagatatatgatttgaaaatactttctcccatttagttgcttgacctttcattttgttgaatgtttcctttactgtgcaaaatttttttagtttgatgtaataccatttgtttatgtttgcttttgttgtctgtgcttttggaattacattcaatcat

SEQ ID NO: 480327 - DNA, 571 bp, Homo sapiens
tgaatgaatctttagggaattatgctgagggaataccttaatccaaaaggcttacataagttcagcctaaaggtttttctgtacatcgtgaactataacaagtggaggtataacccagacgacagcctatacttgtgccaatcacctagttttggccaatcaaatgtagccaactgttcaaaccatgttcaaataagtcaaatgccaagctgtaaccaattcagctgtttctgtaccttacttccatttactgtatgtcactttcctttttctgtccataaatcatcttccactatgtcgctgtgctggagtcccagtgcctgctctagctcaggaggctgcctaattcgtgaatcatccattgcgcaattaaacttctttaaatttaatttggctgaagtttttcttttaacagttggcatcagaagtgagatccaaagtagagcttctaacgacctccaggagcgctgagtgaccaagcaatgtactcaaccacctgttgtgcccatcgctcgagatctcagagcagctggggattgtgatattagaaaaaacttgagtgttgtgatct

SEQ ID NO: 480328 - DNA, 614 bp, Homo sapiens
caatcggtccatgtataatcgccttcatattctactttatctcccaaaggctgaactcccttgtctaggcagccacccaaaaacaattgataccatctttctcctccgccaagtctggtgtcagcacctccaggaaaacaactctgaagtcagacatccactacttcaaaacccaaaccctgattacagtgcccaggcctcagtcaaagtgaaacatttcactggggttcgggccgtgagaaacaacctgcctaaccacctgaccacaaggtggacaaaggcccaaatgaagaaacagcctgcctcttatcatattctgctgggagaaagtacaaggaggagcaccacattctaccggtacaagggccagaaccacctcatcatgggaacatcttatcagtatcctgccgggcagcaagccatactgcccagacccctcctgcccatacctagaaattaccccagcggtgggcactgtcattaggctggtcccccacttcttaattttatatatattttattttgtagaagctcaccaaaatatggttaagtttgaaaaatataaacaattacttgtattagtattaaagattttattaacattcatggctttg

SEQ ID NO: 480329 - DNA, 2772 bp, Homo sapiens
ccatctctgctgacaccttgatgttaggcaatgatgttcaatccaggagccaactggagtgtaggaaggaccccttcagctcaaagccatgaggggttgcaattctgtcctgggcacccttcagtcctcaggaaagtctcatttccagtggctgagcttgtgatagaggggacaagccatgcagtttatcccactgaggaagttggccctccagtgggctggcttccggcattgatggcagttacctggaaggatattctgaaggcaacatggaggaggctggcggacttgcaaggcagccatcagttggagctgccacttttacttttgcctctccctttcctgagaaagttccttttcctcctggtcccagttgtaaaagacagagaaagctattttgaggatgtcaggcatatgggtgttgggtacttgtcttgggagtttcctctgaatatctggagcttcctgagttagaaaattgttcttttgtactagttgcccttctggtggctctggatctaggtttgtatgtttcattagggctctttgtagcctctctgggaaagcattctggaaataaattttatattgaatatatttaattataatataaactactactctatacattttatattttaagggcatgtaaaagggagagaaactcttgattttaatgtattacatcaattgttccattttggttaacagtttatgtactgtttaagtaatctttgctgtctcaaatgtatgaagaaatacttctatatttttgttttagaatactttttattttaaatttagttatatgatctagttggaatttttctgtatggtgaaatgtaggaaaacattttggttttatctatatgaatatttttatagtttatcttaattcaaagacattgctatattatttacatttcaatttgtcacacaaatatttctaatttcttatgttcatattcatgttgtctacaaataatgagctttattttttcatagtacactggataagatatccagtataggtttgaattgagagaataatgggcatttttatgtcatttttaatcatgagaggggaaatagggaaatgtcgtattttactaattaaattttatatttgctgtagattttaaatatataccatttgtcagataaaagaaattccttatattccttgcttaccatagttttttttttacattgatgatggtgaaattttctcaaatccttattctgcattgcatctatgaagatgacttactactttattatcttaatgtgataaaagaaggtaattgttgttaaaatgtggtctgccctgcatgagaaaataataccaacttgttaatgatgtattgtacctttaaaaaatcactggattctatttgttattttttagaattattgaatttatgtttatgaacgtgattacccctaagtttcctttcctgttatttgttattcacaaaattacagtgaccccattactctctatatccaacctctctctctttccttctccccttttttgtttctccaagaaagttgtgtacaattagtgtcacattttattaaaagtttggaaaaattcagaagtgaatacatctggcactaaagatattttgtggggaaacatttatttgccaatttactgactttaatagatacagtgctatttatatatttttattttatcttgtgtcaattctgataatttgtgtttttctaggaattattcaattttatgcaaaattttatttgtactttaaaatttttcattatgctatttaaaaagctttataaaatttgtaaaacatcttgtgatagcacctttttatccctggtatttcaaatttgtgtctttaattatttatgtattttaattttgctcaatttggttaaatgtctatcaaatgttaatctttcaaaaaatccacttttggctttgttaataaactaacttctattgtttattttgtatttaataaatactctttttattttctaacttctacatttttggtatacaataagatgtccttttactcacttcttgatataaatatttggttattgatttttgacttaccatcttttcttatttataaatttttgaatatatattttcttctctgcacagacttgctgcattccacaagttttgttatgctgtatgatcattagtttacaaatcaaaatgttttaattttcattatgatttctaatttgataaattgctttgatgtattttgttaaatttctaaatagttgaactttttttattgcattattaatttttaggcttaattccactgtagccataaaatataccttgaatgatttcaatgctttaaaatttctttagatatttttaatagccttacatgtggtcagtttgggtagaagtataacgtacatttgaaaatatcagttattaaacagttatttacaactatttcaatttgcaaattgggtcacttttgtaaattctgttaattgaatcatctggagatgaaatgtttttattattttcttgttttatcagttactgagtgtgctgttttaaaatttcccaccgtgatgatggatttatctattttcattttgattctataaaatatggctgtatatttggaaactctgttatttgggagatacatgttaaaactgttacattttttccagtggattgaccctcttgattgaatggcaaattaaaaaataatagcaatataagcaaagatgtaaagcaactgaaactct

SEQ ID NO: 480330 - DNA, 1074 bp, Homo sapiens
agcagcagttggacctcaaccccttgtgagacaactcttaaatgtagcctttaaagttacaaccatagaggcaggaaaaagagagacagccaagaagcgcatttgttgatagtttctttagcccctttccaccacagaattacccatcttgagaaagaaaatgtcatgagatcagcatctaggatgcccagagaagagcccccaacatcccagcccctgggccaaaatcagtgtgcatactataagcaaaagggccactggaaattagaatttcctaaacaaccccagcttggactctccaaggctggaaagccagaactgctgagtcatccaaacagcaaagatggcaacctgcacctccttctggaagttttgtcccagcaagtttccaaatcccttcagctggagaacactggtgggtgtggctcaaggctctggttgggaggttccaccttaagtgacagttacttctactgggaagcccagaaatctacaatatccaaagcttccatgtctccatatgtgcctgagtggcagctttgccaaggctccaaatgggccatcaaactgccttactattctctattcttcaggggtcgagctgtttccttgagtagttccaatgtaagcatctggatgtttcagctgaagatagttcattataacaatgtgaaaaagaactactacagaaaattggtatcatcagagaagtggggctttgctctaaagatacctgaaaatgtggaaatgaccattaaacttgacttgttgaatggttttgaccaaaatgctgaagtccaggctgagaaggtctcagatgaagatgaggaactcactgcaaactgggtccaatataagggacaaatggactgtgacacagccctcaggagatcctgagattatgtgaccaattggtcagggtacaacttgattttatacattttagggagacataaggcattaatcaatacatgtaaaatgtacattggtttggtccagaaaggtgggatggctcgaattggggacttccaggtcataggtagatttaaagattttctgattgacaattgattg

SEQ ID NO: 480331 - DNA, 576 bp, Homo sapiens
atttagaattttccaggaaaggtttggaaccttctagaagccgtgggtcacggaagagaaccgtggaacccacccgaacaggagtggcaatgggcgccttgctggatcaggagcacagtgaacaccctgccggatccagagagatggaagtcagtggtgggtctgtgacggcagcaaacagcagtcgtggacaacgagcgaaagctcagaacatacatgtgcatcaagagaattataatgaagaattggctcatgagactgtggagactaagtcccataatctgctaaatacaaattggaatccaaagaaggccaatggagtaattcagtcctggactaaaggcctgagaaccagtggagccaaggggggtataatttccagtctgagaatcaaagaaaatgagttgaaatactggacactcagtggtggtcatagccaagttgcccttggtgagttaaaagccatgttgctaagcaagtctccatttctgctgccatggccacttcgtgaaccactgagcaacgatggtgtggcaggggaaagaggctgactagtatctggaaaatgggtattct

SEQ ID NO: 480332 - DNA, 1924 bp, Homo sapiens
ggcaaggctttgaagtttgagtgggactaaagtaggttttcaagtttggagaaaccaagatggaagtgattaccaccattaagaatgaaaagagtaaaaacttagacgtctacctggtattctattgtattgctgctgacctggcactcacaccacaagatggggtctttcttattcttccttcctctttccaaaggcagagcagtcacatctcatggccaacaccactacaagcccatggggagtactgccagactactgctgatgtttccaaatgtctgggatccagcgcctggaatggggggcctcaaaactgtgatcagtaccctattctgctgtggctgagctcatatctaagatgcaagacaaagtcctccccactattttctctactctcctcagttgaaaagaaaaggcatctcttggagccacaagttgtgcagcctggggctaggtgtggagtgatgccagcactcccacatccatgttagctgtgcatcatgtaacaatacaaagttaaaagcaggtactgagagtgctcacctgtggtgctttgctcaagtaaatagttattaaattggtgtctttgcaggagggtgtcgggggtggatgatggatggagctttatattctttcatcttgttctgcctcttttatatgtagtctttcaacttctcatacttgttattttccctctgtatatgctatcttaactagctacagtgaacttttcttgtaatctttctctaacgctacttattccattttcaactaaatttcatttttgtctgaaaacctttgtagatgacttagagattctgttttctactattttatcttatattaccatgtatttttatctttataacaattacctagtttccttgtccacttgtgtatttattattttttgagtgataactattttccttatcagattgtatgttccatgaagaaatggaatgtgtctgcttcttactagtgcagcctcaatgacagaagattgtgtggctcacaaaaagtatgggtgggtgtaccaatgtgtgaatttatgtgtatctttgtggtatcactaaaggtcttaaggaaatcaggattttcccaggttttttagtctcactaaggattttatttttctcttaatctagcaggcattcttcactgattaaattccattttcttctttctcccccttcacaccatccatcccatttcataagtaacttagaaagcttcacttcagatacaatgataaattattagattatatttcctagcattgaaatttttggaaagctctttatattataaactattttctgttatgtgttttagtcacaattaaatctagctgtgaataaattgaaaatatgtcctctcttacctataaaaagcaaagctgtaaaatgattcaagtatataccctttaaaaaatgcatttatcaaaaccaacacttgtctgtcaataataaccaatttctgtattgtgtttaaaatgtatccctctatagattcaaaaaatatttaaaattttgtttcaccataattatttatcagattgaatgcatatatgttttcagaaagcatgcaagactaaaaagacatttctggattagctagaaatgtagtagactaactgctttttattattttgatttagcatttctatgcttctcattattaacaggtttatgtttgagaaatatcagaatattatatgtaatgattgactcaattatggaccttgatataaataattttgccctctataagtaaattaatattttcaataaatattaaaagggtgcttttttaaagaaaatatacatgaaattgacacagggccagcctttaagtgagttacaattataaatacaaacacctcattctagtattccattataaagtttaaatcaatagcttt

SEQ ID NO: 480333 - DNA, 750 bp, Homo sapiens
ctccagtatctcctctgttctcaagtggataattgtgaacagatgacaccaaagaatgttgaatattccgccccccactgtcttctggcttgtacggtttctgcagagagatctgctgctaatctgatggacttcacctttcaggcccctctgctgcaggtctgctggcatttgctggaggtctactttagaccctgtttgcctgggtatcaccagcagaggctgcagaatagcaaagattgctgtctgttccttcctctggaagcttcatctcagagaggcacccaccagatgccagctggagctgtcccagccagcaggcagaaatgtttaagtccactgaagttgcacccacagccacctcttcccccaggtgctctttcccagggagatgggtgttttttctataagcccttgactggagctgctgcctttctttcagagatgccctgcccagagaggaagaatctagagaggcagtctggctacagcggctttgccgagctgcggtgggctctgtctagttcaaatttcccagcagctttgtttacactgatttgaaaactatttgtgagtgttcttagtgtatggcaaatagttatttgcataagtgcactaagaatgttttattttgcaacaggacacaattggataaactggttattttatcaagactttgactagactcatatgatttcctttaaggaatcaaacttgacttatagagccaataaaagccttttggaaaaa

SEQ ID NO: 480334 - DNA, 763 bp, Homo sapiens
agctaaaggattgtaaatgcaccaatcagccctctcttcattactgaagtccgggagaccacgaaactaccagaaggaagaaactccagacacatctgaatatctgaaggaacaaactctggacacaccatctttaagaactctgacactcaccgcaaaggtctgcagcttcattcctgaagtcaacaagaccaagaacccaccagaaggaataaattctggacacaattttactagttttcattcctaccaacagtgtaaaagtgttcttttttcaccgtatccacaccaaagtctatttttttttattatgtccattcttgcagaagtaaggttgtattgcatcgtggttttcattagcatttccctgataattaatgatgctgagtatttttatatgtttgttgggaatttgcgtatcttctcttgagaattgtctgatcatatccctatcccactttttgataggattgtttgtttattttgctgatttgattgagttccttttagattctggatattagtcctttgtcaaatgcatggtttgtgaagattttctcccaatctgataaataaatagagagatgacactgaaatagcagtatagagataaagatatagaaacatagagataacagtcttaattatttacttttaaatttttgataaacagtttcaaaatcttagacaattttcagctgaatagccttaaattcgcatattaaaggaaataactaaggtgagaatcaaatagcaaaattta

SEQ ID NO: 480335 - DNA, 643 bp, Homo sapiens
ttttctccctgcatctggaaaatctgcttgtactcaacaacccaggttacctggcttattctgaaagcattcacttatatgcattcacaaagagatggtttgaaatgggaacttatgtttaaaaaggaagcagagcataaaggtttggaaaatttgcaggctgaccatgtggtagaaaagaataacccatgttcttgggaggaatacaagctggctgcagaaatttgcataagtagcgaggagtcgaatgttaaccaccaagacaatggggcaaaggtctctagggcatttcggagatcttcatggcagctcttcccatcacaggcctggaggctgaggagggaaaaatggttttgtggcccaggcatttggccctgctactctgtgcagccccagaagttggtgccctacatccaagccactccagcttcacccatgcataaaagggacaaacatgcagcccaggccatcacttcagagggtgaaagcccgaagccttggcaacttccacatggtgttgggcctgtaggtgcactgaagccaagagttgaggtttgggaacctcaacctagatttgagaggatgtatggaaaggcctggatgtccagacagaaatctgctgcaggggcataaccttcatgga

SEQ ID NO: 480336 - DNA, 831 bp, Homo sapiens
gcggtgaaagttatccgagtcacagcgcaccgaaatatatcagcaaagtcaattcctgccgcctcagaagaaagaattcaactgacgggcataagggagattgccttctgctggtgccagctgtgatcaattattattttagagagacagccagagctatggaaagcagcagtagatgctgggattatgctctccccagtcacaatcctggggcaggaggagagctgctacagctgcagtttctcctggatggcaaggactgcagtcagggccagcttggtgacctagaactgattgtggagcagcaaggacctgtctgctccactaccaaagcagatattcaggtatttggaacatcagtcagctggatgagcagcctgaacttccccacccttcctgtgcagagatccttgtgcaggtgggggttgtgggagtggagctcacttttacaagctcaggcagatttccaggaattcagagcacctgctagtctggttcagcagcctgagttgccccacctctcctgtgcagacatcttggtgcaggggacccactctacttcaagccaaggaagacttctcggcatctgaagaacacactctcctttctttaagatgcattgttagcttgctcattgacccgctggttattcaggaacatattatttaattttcacatttgtatagtttccaaaacttctcttgttattgacttctagttttattttttattccattgttgtcagaaaagatgcttgatatcatttcaaagtttttgagtgttttaagacctgtttataaacctggtttatggtatatccttgagaattat

SEQ ID NO: 480337 - DNA, 717 bp, Homo sapiens
caaagcaaaagatagttatataggcatgaaaactaagtatttttctcaaaacattttattcagtgagtttcatgcgcgtccgtgtgaagagaccaccaaacaggctttgtgtgagcaccatggctgtttatttcacctgggtgcaggcgggctgagtccgaaaagagagtcagcaaagggtggtggattatcattagttcttataggttttgggataggcgataaagttaagagcaatgttttacggaattggggcattgctacaaagataactgaaaatgtggaaggagctttggaactaggctggttaagtggttgcaaccaaaatgctgataaagatatggacaataaagtccaaggtgatgaagtctcagatggagatgaagaagatattgggaataaaaacaaaggcttatgggtagaagagacttgccttgtctcagatgagacctttgattttggacttcggagttaatgctggaatgaggccatgtaaaatgtacctgcttccctttcaccttccccgataatttgaagatttattaatatttatactaccacaaatataaaagagaaataagtgccagtaatcccaattctttaaactgtcaatagatcccacttcttcagtcagcacatggagaattttttctgttctttacagtgtagtataattatatgacacatatgaacagtcactgcctcatgaactggtct

SEQ ID NO: 480338 - DNA, 568 bp, Homo sapiens
tgaaataatatggtttgtctgcgtctccacccaaatatcatcttgaattgtagtttccataatccccacgtgttatgggagaaacttggtgggagccaaaggctccaagaaatttgggattatgttaaatggccaaacataagaataattggtgttcctgaagaagaagagaaatatagaagtttggaaaatgtatttgggggaattattgaggaaatcttccctggccttgctagagatctagacatccaaatacaagaagctcaaagaacacctgaaaaatttattgcaaaaaggttatcatctagtgtagtcgacccagatatttgccttgtacaaccacctcctggtgtcccacatccctgtggaacagttaaatacaacttatttgactcaccccactgactcctttaccccatatggattgtgcaggatcagactttaatgtttattttagcctaatttgattcttgatgcttgtaggggtgatgactctctaagagatccttagttatgagagtctttgcgttctggttttccctaatgctggttgtagtagttatattct

SEQ ID NO: 480339 - DNA, 669 bp, Homo sapiens
gtttgcacttcttttgtggtggaatgtcatcagttaaggagggcagggcgtattcacttcttttgtgattcttcagttacttcaggccatctgggtgtatacgtgcaagtgacaggggatgcgatggcttggcttgggctcagaggcctgatgctcacccaatgttgaaaggggggcagaaggaacacttacccatccacaggagccaaaatgatactgacttgtctccaatgtgtggcttgggtgaaggtctccacccaagctttacagcttgggctggctcagctgccataagaggattggcgtatgatcctgtaaccagccagccaaaatggcagacagtgcccaacgaagctaagggagcagggacattccatgccatagggatagtgccatccagtagagcctgtggaggcaatttctgcatggcagagtgtcagcataggcagagccctggcagaaagccccatcatggccataggtcaggcactgcagacagccatgacataggcattgccccgctgagccttcctgatgtagtttgcatgctcatcacctctaaatcccatgttgaaatgtgatccctaatgtaggagatagggcatagtggggaaggtttgggtcatggagagattttgagtttttttaattaattttttattatacttt

SEQ ID NO: 480340 - DNA, 577 bp, Homo sapiens
gataacattaggagatatacctaatgctaaatgactagttggtgggtgcagcacaccaacatggcacatgtatacatatgtaacaaacccccgcagcagcccctgcttctccccaaggctccactcaagaaaatttgtgtccatcaaaaccactaccaatttcagttggaagctccctttgcctgtgaccccaggatggtgttcgatgcattgaaatttaccatcatggtggaaggcaatggagaaacaggcaccttcttcacagggcagcaggatagagtatttgacatgacccacggagaacaagaaaaagcagggtggtgcaatggcccacctgggagccacacagggcaagtccatgccaccaaggcattgagtcacaacagacctgtgcagattctcaacggccacttggctggagaccgcttaagactaccaagttgctggggagaggggtggccattatcacggcagctgactgctgcctaagacaactgagctccccgggggaaggatggccatcctcaaagcagctgcctgctgcctaaggtgactgagctccccaggggaggggtgg

SEQ ID NO: 480341 - DNA, 576 bp, Homo sapiens
agctgcactgaaggaagcccagcagccattctgccatgaaccttcctttgcagggttcttccttgcaatgggttcaaacatcatcctttagctcagagaagtttgttattactgactttctgaagcctacttctgtcaactcgtcaaagtcattctccgtccagctttgttccattgctggtgagcagctgctatcctttggaggagaaaagactgctacactagcagtgagcaaggctccgtgggtgtgggacccactgagccaggcacgaggtataatatcctggtgtgctgtttgctgtgaccattggaaaagcacagtattagggtgggagtgtcccgattttccaggtacagtctgtcacagcttcccttggctaggaaaaggaaatcccccgaccccttgtgcttcccaggtgaggcaataccctgatctgctttggctcaccctcgatgggctgcacccactgtccaacgagtcccagtaagatgaaccaagtacctcaattggaaatgcagaaatcacccgccttctgcgtcgatcacactaggagctgcagaccggagatgttgcca

SEQ ID NO: 480342 - DNA, 736 bp, Homo sapiens
cagggctgggtgtatcggcggcatgtgggatccagttcatgtaaggagggatgcggcttccatgcacatctttctgtgtgtgtatagatacctgtgtgtgcctgggcatgttggagtgtgtctctgtgtgtgtgcatatgcatgcatcagtggctgggttttcactctgccccgggctactgtgatgaaacttgtggctgtattccatgtgcacttgccctgctcacccctggaacccataggaagaaacataagaggaggcggatgcttgcagatcagcattactctgccgacgagtgagccccaagagcagagaaggcagcatccaaacctgtggatctgcaagtgtggcctctgcaaaaacagcctcagcatcacctatgcccatcttagcaacaaagatgccaactccactccagatccgatggagcagaaacgccggggacttcacagtagccaagctatggaaacaagcaaagttgaggaagttctcctggttaatatcctgaagtgtgttttccagcttgtttccattctccccatctgcttttggtactccactcaatcgtaggtttggtctttttacaaagtcttatatttcttagaggctttgtttattcattttcattctcttttctcgcatcttgtctgcatgtcttttttcagcaaggaggtcttcaacctcagatatcctctcttctgcttgattgattcagctgttgatgcttgtgtatgc

SEQ ID NO: 480343 - DNA, 1871 bp, Homo sapiens
gcagctgccacagctgctgtctactgatgctacccaggagcctgaatacaggcctactcagggcgtaacaggaccatggaaggctttcagaagtcatttttgaagacacaacgcaaattcgactcaggagcccagctggcttcacctagtggatcccacaccggggctgcaggtggagctgcctgccagtcctgtgccgtgcgctcacattcctcagcccttgggtggtcgatgggactgggtgccgtggagcagggggtggtgctcatcggggaggctcgggccgcacaggagcccatggagtgggtgggaggctcaggcatggcaggctgcaggtcccgagccctgccccatgggaaggcaggtaaggcccggcgagaaatcaagcgcagtgccggtgggccagcccggctggggcactcagtacaccctccgcagccactggctcgggtgctaagtcccccattgcctggggccagcagggctggccggctgctccgagtgtggggcccaccaagcccacgcccacccggaaccccagctggcccgcaagcacggcacacagccccggttcccgctcgtgcgtctccctccacacctccctgcaagctgagctaagggagagcatattcacatggaaacaaggctaggtgattaagggagaaagggagagtctaaaaacaaggttagtaaaagcaaggttctaaagagaggacatattaatagtacacatgtaaacagtagctgactgaatttttaaaagattaaataaagaagcactaagacaagtattaaaattttataaacaattattgcttatccttcattagacagcaacaacattggtgggaattgaacaatgagaacacatggaaacaggaagcggaacatcacacaccagggcctgttgtggggtggggggaggggggagggatagcattaggagacacacgtaatgttaaatgatgagttaatgggtgcagcacgccaacatggcacatgtatacatatgtaactaacctgcacattgtgcacatgtaccctagtacttaaagtataataaaaaaagaaaagtttatcatagatagtacatatttgaatctatgcatatttatgaactatgaaaatgactgccatgttcataacaatggtaatataaaacagtttatgggcacttactggaaatcaaatgtcaaagactcagagactaagtcatttagaaaagaaaataaattcatttgcagaaaattattaattggagtacaggttttaacagaacttgctgtaaaattaaaaaaaaatgattagatatttaatttatcaaagctgtaatgttcatgatggacaattaataacttctttgaattattgtcaaattagatgatattctcccatttttatatatcaacatttcaaaggccaagataaaattatttttgttagggagtcagtaacttacagaaaagctcaagatttgatttaatttttggaaccagacagaatgagtctgttttacttgttgttgttgttgtcattgtggtttaccttagggaaaatgaagcatttaaaaatgttttccttgtgtggaatatgatgtaaaccctcattcctttaatggagcagggcaaggtgatacagtatttccttatagacactgtgcaaggcactctattcacttatgtctaacaacaagcccatgatgatcacagggcactgcttactcactgaattttacagttacactagaggtggagttaaacctgcattggtaatacattaggcttagtaaataatttagtgagccccttgagaatgatctaagatatgagcacctaattgtaccaaatgtatggtcaatattatttcctgtt

SEQ ID NO: 480344 - DNA, 775 bp, Homo sapiens
atactaagcaaattatcacaaggacagaaaaccaaacaccgcatgttcttattcataagtaggagttcaaaaatgagaacacatggacacaggctcaatacatatttcttgaatgaatccatgaatggaagatattggaaaaaggattctggaaaggattttcagaatcctataaaggaaagaagaacacagagttccttggggctgtgggaggagagtgctgacctgccacattccaagggaaaaccaccttctcacttcatctcccttctggctctccatccatctgctgagaactaccactcaattaaaccttgcactcattctccaagcccacgtgtgagacaatccttcaggtacaccaaagcaggaagccccgggatccagaaagccctctgtcttttcaatgctgcttgggatcggagccccacaacctgtcctaactgctcgctcggtgatgggaggaacatttatattgtgataaagaaaatagtaatactggcagagaatggtacttacttcaacgttgactttgcagagctcctgctgttcgccactgttgacagccgtagttatttcaatgtccactgaacaattttaacttaaggtaacttcatacttctttgtaacattaaagagtctttggattcaactttaaatcttgaaatacagtggatttaactatttagagtaagaacagatatatttaaggtaataatattggttgaaatgtctaatttatgacagaagatatgctgtctacactcatcatttc

SEQ ID NO: 480345 - DNA, 571 bp, Homo sapiens
agctgtcggacatgtacgacatgtgggcaaacaagggttgtgcaggggaagaaggtgtagagatggacacgtttggcagtggggggctggtggcagggcccgaggggcaactggtgggacggggcttctggtgggagcagtgtgacaggggacaggtggggctgcggggctgccacaggggcagggtggggcagcgggggaatagagaggatgttttccagatgaaaatgtaccaccttaggtcatcctcaggcattacattcaggccacagataggtcccgagccctgctctgcggggaggcagctaaggccccgcgagaaatggagcacagcagctgctggcccaggtggtaagcccctcactgcctggggcttgtgggccatcctgccgctccagtgcggtgtccaccgatcccacgcccacccggaactcgctctggcccacaagcaccgagcacagccctggttccctttagtgattgtggtggctacggtgagggctatggtagagatcattctgaacatctaagtggaagttcttatagagatgcatttcagagatatgggtcc

SEQ ID NO: 480346 - DNA, 538 bp, Homo sapiens
acggtgagttgccatggacaaatgtgaccatggaaagccagagcagaccttcctccacattgtcctgacaggtggaagaagtgaagcatcctgttcatctctgcaagatcatgttgttctttctgacgccccctacttccagaataaagtgattaccgaggaatatctcgtgaacgtcacaggtacaggtggctcccaagatagggcttctcattccactccaattcagtggtatgaggattatgaagtggaggcctgtggccacagacactacaacagcggccttaacttattcaactggttttctgaccacaacttcacaggatctaataggattgctgaggtggtctctcagtacgaggggtcccatcaatgtgagaagaaatgggcatgtaaggtttatggagggactgtggaaaaggttacagaggcatgtgggaaggcagtctgagtggagaagcagattggtgtctgcactcagggctactcagattgggaaatgtctgggcacttgcctgtaatcaggtcatgtgaaaac

SEQ ID NO: 480347 - DNA, 616 bp, Homo sapiens
cagctgagaaaatttaaataaacatggggctctttttgcaatctttggtgcttgctcatgtgaggatgtgtattggagaatcaatattggagaatcagaatattaaaacatcaaagggtatcacttttgtacagtttctcttgactgattttcatgtgaagaaagaaaggaccagagccaagaagatgatgggacagaggaaagggccagcaatacttccctctcaccattcctctccatgtctccaaaaatggccagacagtgagagcttggacaccaaccggttagggcacacgagcgaccacttccagaaaggaggcaggctggtgaatgcagtgttctgccttggaatggtgaatggagagcatggcatctgcacagatgtggccccaaacagaagtcctaagtctcattgtgacccgactaaaatcttatcctaaccaccaaggcagagagaatatggtgcattggtcagaaaacaccagctctgcaagtgtagaaacttagcctgtttagcacctacccccagttcctcaaacagggtctgcctcatcatagcagtagctcaataaatgtctgttgttgaaaggggatttcttacatggcttgacagctc

SEQ ID NO: 480348 - DNA, 545 bp, Homo sapiens
tggtcagggagatggggagatgaaaacaaaacacttatttaaaaagatgtttggactctcataccacccaaaacagcttttcagcagtagtttctgtattttgattttagaaaagctgattattgcagagctccctggatcctcaacagtaaggctgacctccctgtgtgacctgcccacccaactcctggagctgtaccaacagggcttctctctggcagccatgcacccctttgtgcagcccacccatggacaggagaagacacccctggagcatatctttagggccatcctcatcaagaaaaccgacagctctgtggctcttagtctacatcagtgtaaattagaatttgctgtgaaaggtggtacatgtctttgctcaaacctagaattcacacattttttggagagctgtaagcatcaggctaggtaagaaagaacacaggactcgtggccagcaggcctgtgttctaggctgcatgaggctactggttcattttcctcttagaatacaagagtttatattactcatctatgtgctcatg

SEQ ID NO: 480349 - DNA, 655 bp, Homo sapiens
agtaaatctccactatggaatgggccctgcacaaaggaaggagagttacttattgcaaggccaggcacacaggtgagggtactgcttttccagaggtacattgtgaattatcactgggtcagaatcctaataatgttgaaacacagccaacaggggatattatcacctatctctgggcctatgagctaggtgatgtgtctctcatgccagtgccctgccacagagaacactgtgacagagcactagatatagtatctagccttactgaacataaaagagtccatactggaacaaaaccctacaaatataaagaacgtggcaaacatttacatgctcctcaacccttatttaaacacaagagaaatcatactggaggtaaaccctacaaatgtgaagaatgtggtaaagcctttaagtacttctcagaccttactaatcataagaaaattcaaactgtagggaaaccctacaaatgtgaaaaatgtgacaaaacattgagcttgttttcacagctcattggacataagataattcatagtagagagaaggtccataagtgttaaaaaaaaaaagtggacctttaacaagtccgcacattgtgttcagcaacagagatttaacactgaacaaatgcaatataaagaaagccagtctt

SEQ ID NO: 480350 - DNA, 507 bp, Homo sapiens
gagaaggaaaaggaatataggcccaatatgtatactttcgacaggagtaagggcaaagggagagtactacacaaatctattgagccctatcctgtggtggaggtggacaggcattgtactgggacaggaggagggggtaattggcactgggttgtgggtattgaatttgaggagttgcaaagagaaaggttcataatatcgctggcctttaacagtgccattgccccactctcctgtaccctcagatttaaggactatggctatggggaactgccaggcatccaaaccacaagaagccctagctctacccatcaccttctgaatacaagtgtagacaggtctatcagggcagaggaaaggagagaaggagagcaaaggcgccgggaggtagacggggggaagcaggattccaagcctctgaaagaaaggatcccagagcgttgaaagaaacagtaggcttagaagaggggagaggtccaaatggatgagaggaacaagaaacaggcc

SEQ ID NO: 480351 - DNA, 714 bp, Homo sapiens
actgttactcgtttacctgggtcctctatatccagaatattatgggatattgctgggcccagaaccctgataacatgactctcatgactgtgcggaataccagaaggttttatatttttaccaagctcacagaagcttacaacactaacttatattgtataaactctttggtagtagagaatttcatgggtcttttgatgatgaatgattcaacacactgggtcctgcccagaaggtggaatgtgacatctcactggcgccatctcgacatagaatgggccgtgcacaaaggaagtatagtgacatattgccaagccagacccacaggcaaggatactcttttgccagagccatgcccaaaggactgcattttgacatatctctggacctatcacctaggagttttaactatgtcatcctactcccttcttgcccaaatgatttatgttcataaatttacgggtgcagagaaacatcatcagtttggtccacagatatgcgtgttcgactccctgatgagtggtgaatagtctgtgtatggtctgggataactgtgggtcacattgagtataaacattatacctatctcttctatattaaactctggttgaaacagaaaaggtttcgagtgcccatggaaaatatgatcactgcattcagggcagtggtaaaattctgtccttggtctcctgaaaaaggacccttagacgtaga

SEQ ID NO: 480352 - DNA, 937 bp, Homo sapiens
ctacaacctaagccattaaggcactctcatacatttctgatatttagatattatatcctgtgcctggctcggagggtcctatgtaggcccatggagcctcactcattgctagtacagcagtctgagatcaaactgcaaggcagcagtgaggccgggcgagggacacctgccattgcgaggcttgaataggtaaacaaagtggccaggaagctcaaactgggtggagcccatcgtagctcaaggaggcctgcctgcctctgtagactccacctctgggggcagggaatagccaaacaaaaggcagcagaatcctctgcaggcttaaaagtccccgtatgacagctttgaagagagtagtggttctcccagcacacagctggagatctgataacagacagactgccttcttaagtgggtccctgacccccgtgtagcctaactggggggcacctccccatcaggggcagactgacacctcacacagtcaggtactcctctgagacaaaacttacagaggaatgacaagggagcaacatttgctgctcaccagtatccgctgttctgcagcctctgctgctgatacccaggcaaacagggtctggcatagacctccagcaaatgccaacagccctgcagctgagggacctgttagaaggaaaactaacaaacagaaaggacatccacacgaaaacctcatctatgaatggctaattagaataacgaatgcagagaagtccttaaaggacctgatggagctgaaaaccgtggcacgagaactatgtgatgaatgcacaagcctcagtagacgattcgatccactagaagaaaggatgtcagtgatggaagatcaaatgaatgaaatgaaacgagaaaagaagtttacagaaaaaataataaaaagaaatgaacaaaacctcaaagaaatataggactattt

SEQ ID NO: 480353 - DNA, 805 bp, Homo sapiens
ctaatgctaaatgacgagttaatgggtccagtgcaccaacatggcatatgtatacatatgcctggggctcaaaatttagttgttgttgtacatcagcatgagaatacctcccctggagcttatcaacagttgtattttgcctggctgcctgattctggttgtcttgttgttcgcacagttcatcatattctaccgtccagaggaggagtccaagtcttcgctattgtgaatagtgccacaataaaccttagcctagaagtacaggaagagtgcaagctgattccaggcaaaccaacgctcccagctccgaagagtctgcggttgttagagagccctttcccagaaagggctgacacctgtgtatttagtccagcagctgtgctagtcacttttaactggccaacaatttcctggtatttagcccccgaattctaaggaaaaataggacaatagcaagggaaaggggtccaatgggacttaccgattgaaaggggaggtggctggcaaggtccagttgaaaacattcagaagacaagaggtgaattagcaaagtggaaagagatgttgaattaaatgtatgcaaatttttgatgacaaactgcatgtaaatcataggttatatataatcctaaagacagaacattgatggccctacatcaaccttagtgccagagtaaaacaaaaggagatgcgcaccactggggtcttccctaaaatacaaaattcaaaaaaaaaaaaaaaatacgtgaacatagaaataataaactgagactgagagtgaatatgggactgacagtcaatatga

SEQ ID NO: 480354 - DNA, 611 bp, Homo sapiens
aaatgaaacactgtcggcaaacaagccatggtggttcagagaggacagaaaatagagcagaacaataacccagtaaggcttgttatcagtgtggtttacaaggacactttaaaaaagattgtacaacaagaaataagctgctgccttgcccatgtccactatgccaaggcaatcattggaagacacactgccccagaggacaaagtttctctgtgtcagaagcccccaaccagacaatccaacaacaggactgagggtgcctggggcaagtgccagctcatggctgaagctcataaaggattactggatatcgttaaacacttaaaagctcaaggcttagtaaggaaatacagcagtccctgcaacacccctatactaggagcacaaaaactgaatgacattaaaacagttgtgagggttccttgcacatcactggcttttgctgactatgggtccctgaatacagcaagatggccagaccactctagactctaatcaagaagacccagaaacagccttcaaaatcttaaagcaggccatagtacaagttccagctttaagccttcccacaggaaaaaaaaaaaaaaaaagccaaaataaaacttctcttt

SEQ ID NO: 480355 - DNA, 631 bp, Homo sapiens
caggccagctccaagggtctttcatgcagttggccctgtgggatctggaagctggatgcataggacctgagggcggagctaccctgaggctgtttctgctactgaaattcacgtttattttctgtttctctggacagtggaagataatttttcctcagacaagggttgcccaggggaagaaggcagcgaggtggacacttttgggagtggggactggtgtctgggacccgaagggcacgtggtggggcggggcttcctgtgggagcagtgtgacagggggaaggtggggcagcgaggcttccatgggaacagggtggggcagcagggatggggggagagctagcaaggatggatcaaagagcaagtccagagactttgcatttattatttctgagaaccctgcagatgctaagaatgctgccaaagatatgaatggaaaggttaagaaatactcgagcttctcattgcagatcaaagaagtgactagagtgaggccaacattccttatattcttgtgtttgctagagaattccccctaatttttctgtaagttcctagcagtattttttcatggtatgcttcctcatctaatgaattattccatttcctaggtctcctggtagtggtcccc

SEQ ID NO: 480356 - DNA, 464 bp, Homo sapiens
gtgggcagggcataggaagaaatacgtttcaaagtcccaaacatgtcctggcttcgtgtatttcagtcaacatatcttgagtcaagctcaacttgcagagccaataaaagccccttggaaaaacaggactcatacctcatctatacagtcatagtgcaggtttatctgtggaaagaaagggatcaagaatgcagactaggatcagctaaactatgtggttctcacagagaaaaatgcaaggtgtgcataaatacagaaccatcaaatgaaatatccagccctagagaaactgttggatctaattttgcaggttttgcataccagaagaagctgttccaactgaacaccccttggtctcctgatgtcttcaagggacacattctggctacagattcttacaggtcagtctcaggtaccctgggagcccataccatagcatctgcactggtgggccatgtctgacc

SEQ ID NO: 480357 - DNA, 471 bp, Homo sapiens
tggacaagatccatgtataagagccccgatttcactttaagattgttttcaggaaaggagtcacagccccagaagtgtgatgaatcatggttcaaatgttaccaaatcacttgtgaatcaaagccatcccgagcaacagtgcaagactctgtctcaaaacaaaaacaaagacagaagaataaagaagaaggaggagaagaagaagaagaagaagaagaagaagaagaagaagaagaagaagaagaagaagaagaagaagaagaagaagaagtaggagaaggagaaggagaaggagaaggagaagaagaaggagaaggaggaggagaagaagaagaagaagaagaagaagaagaagaagaagaagaagaagaagaagaagaagaagaagaagaagaagaagaagaagaagaagaagaaagaagaagaagaaggtcacttaacctaggtgctgggctctgcaatatgtaatca

SEQ ID NO: 480358 - DNA, 1561 bp, Homo sapiens
acctgtaagaggccagtttgacatgtaagaacactgcttcaaactgcacttgacgttgtcatggttcatgcctttcccagagagcaccagagatatccaggataaagggaggcagtgaagtcaagggcctggtcgtcttttgcagacacccacctctggggtctcaggtatggaggcagaacaggagtttccagagaccacctcaaagtctggaaatgcctcctcctccagagaagcccgactacgaagacggcccaaatgggccgcctgcctagatgttgtagccgtgagtctttttgaaacttgccccattgtgatttctaggtacattttgcctgtgttctccagggttgatctctcccatgtggggcttgctgcagaaacatgcatcctcaggagatgccagctgtgtttttctgtgagagtattgtgagtgatggattcctcttgggctacatggctttgtgttctctatttttctgtgaatcattaatttgtggtgaatacataaacggaccaggcccacccagtgtgagtgtgagcagcaataaggttagtgttgatcttccttttccttcatgggaaatccgcagtgctcctccacagcactgcgggacatattttcaggcttgccatcgccacagacagcctctgacacattgtctccacatcatctgcagtagtgggaggccagtattattctatcaatcacagaaccctgaaaaacacaccagactacattccaatccacaaaggaccctatacttgtacatagcctcttttgggaatggagtcagaagggtagtttctagcgaccacctcacagtctcaaaacacgtcctcatccagtgggagcagaccacaaagactgcgaaaacctagggtttctgaggtctggctcaacaatttccaaactaaatatttcccggttcatggagaacaaccctcatgagaattcattgtgtgagtgtttctttctaaatactggcatattttaatgactttaaagctactttaagagtagctttgatacttttaaaatcataaattcccatcacctctgccaacaagaaaactcttgttctcccacttctttcagaggtctgcatgattctggtaaaatgagaagcaggcagttgtttctggcttttcctggtaatatatcccctgttatgtttcatttgcatggccttctcattgtggaaaggctctttcattgtgctattgttagatgggactgcctctctccacagattatttagcttccagagatttcagagagcaaaagggacttcgagtaggctggctgtggtccaggttgtgggtcattttcttgttgtgggttctgaggttgtctgtactttgcagaaggcttttgggttttctgacaggaatcattgaacattgctttgaatctagcacaaggcagttttttctctcaggtgagccttgatttttctttgcttttatgggggaatccacattgtcccccaacagcactactggacacccttttaaggctttcccttgcctcagacggcctctgagacactgttttaac

SEQ ID NO: 480359 - DNA, 469 bp, Homo sapiens
tccagtgaaagaccacatccacagtgagaaaggacatgcagatgcaatgagacacagcatagattaccaggcaaaagccagacatggctccctgcttctcatactacaggaatcatgcagcactccgataaaagttgtagaacaaaagcttccttggtcgtcttctgtgaactgggagacgtttaacatggaagacactgagccagaccaaggaaaccctaggctgacaaggaacatggaagacaggaaaagaagaagcaagtgtggtggccatatcccatcttgcatctatcaatctcactttcaagtggagccaagtaggaaagctctcaaattgggagtttgccaggatggccccagtttgcacatcaaatattctctgcatgttggcgtactcccacctgaacatcaggccatagtgtggactacttgtgtaattaaggacatgtgaggatgcagttggaatcaa

SEQ ID NO: 480360 - DNA, 1456 bp, Homo sapiens
gggctctggaactcagtgaagtatttctacatctcacacttgccagcacttgccaaagcagtagcacgatggtgtgttacttgccaacagccaatgcgaggcaaggccccacagttccaccattcatacaagcttatggagcagctccttttgaggatattcagggggatttcacagaaatgctgcaatgtagaggtgattgcttgtggaccaaggactggaacgtagcccctttggggccacggtggaaaggacctcagatcatcatcctgaccacccccatggctggggagtgtgtggccttaggaatcaatggggccagactggatcctccagtaaatatcttggttcaaggagaagtttacaagcactctcctgagcaagtgtgtcaaactttctatgatgaattaaatgtgccagtaccaaaaattccaggaaaaacaagaaatttgtttttgcaattagccgagcatacagcctagtctctcaatgtcacttcatgttatatatatctttgagttcttttgccagttcacttttaaataacattttgattggaacacaataaacgttataattttacttacataagatatacatttaactttgattatttcaaaatacattttgttgttgtttatgataataaatgtgccaactttttaagatactgaacctgtgattagttctaataagacatagaatgaattttctcagattttctgggtatataacaatgtaatttacagataattaaataccttaaaaggaattgcaaattgttattacatgtatgtgtatattcatttgtttatttataggagctagagctcatatgttttaaaatagctgctgtgatactctacatctcttaatctcagctttctgtaaaattgtgagacagttacttaccacaaaaggtggttttgagcatcaaagaatcacattagttcttttagacaaaatgcttaaaacagtgcctatcacatagtaagcactataaagtgtttttgttgctgatatcattattaatattattttattggctgcaatttcaaaataaaagataaccgtggtgtgagtaaacatctttattttgctctttatcttatggatgatacactttagaggtttatttttatattatgaatcatttaaacttatttagacatttggacattttgacattgtgtaacttaagtttgatatgcatattagtctgttctcatgctgctaataaagatataaccaagactgtttaatttataaaggaaataggtttcattgactcccagttcagcatggctgcaaaagccccaggaaacttaaaaatcataacagaagaggaagcaaacacatccttcttcacatggcagcaggaagaaaaatgagtgttgtgttagtccattttcatgctgctgacaaaggcatacctgagcctggacaattttactat

SEQ ID NO: 480361 - DNA, 1008 bp, Homo sapiens
ctttagcgagagccaccagcatgaaggaagttggatttttttcccctatttccatgaagcaaggtgatcaatggatgatcgaggcagcccttcaggtggcttaggcctgacctgtggagtatccttgtggggaacgcaggccagcttgaatgagagcagatcatgagagtgctcctgggcaggcaattgccccagtggaatgtctcaccagagcagtgcatggcaggcccccgtagaggatcaaggcagtggctgaacactgggaaagaaatggcaaagggatttaatggagactatggggttactatgacaccagggaaatgtagaacttattttgaaatagattggtcaaaattagaagtgggttggccatcagaaggaaacctggagaggtcccttgtttctaaggtatggcacaaggtaactggtaagtcaggacactcagaccagtttccatacatagccacttggttacagctggtgctagaccccccacagtggctaagagggcaggcagcagcagtgctagtagcaaagggacagattgccaaggaaggatcctactccacccgccgagggaaatcaactcctgaagttctgtttgacccaacatcagaagatcccttgcaggagatggaaccagtgatcccagtggtgccctccccttaccagggaaagatgctccccactcttgagcccacagtccttgtgcctccacaagacaaacatatccctaggccacccggagtagacaagagaggaggtgaagcctcgagagaaacccctacattggcagctcgtttaagacccaaaactgggatacaaatgcccctgagagagcagtggtatactgggatagatgaggatggtcacatggtggagaggtatgtttttgtgtaccagcccttcacctctgccaaccttctcaactggaaagacaataccccatcctatactgaaaagctacaagctctaatttatttgctccaaactattatctagacccat

SEQ ID NO: 480362 - DNA, 501 bp, Homo sapiens
tccccaggcattacattcaggccaccgacagaacaatggtagaagcagattgtcctgggaagctttcattggtggcctcaatagagaagccagtgaaaaagatgctgaaagaagtgtttgcgaaacatggtccccttttggaagatgatgatggatacactcttgatctcaacatgagttcttctaggggagccattccagttaaaagaggtccatcttcacgaagtggaggtcttcctcctaaaaaatctgctccttctgctatggcaagaagcaatagttggatgggaggccaagtgatcgtgatggctacaatgacgcccgtggtagagatcattctgaacgtccatgtggaagttcttatagacatgtatttcagagataaggcagaggaccctgcagccttctgcagtgtttgtgtccctgggtacttgagattagggagtggtgatgactcttaacgagcatgctgccttcaagcatctgtttaacaaagcacat

SEQ ID NO: 480363 - DNA, 2209 bp, Homo sapiens
ccaacacctggaccaccgccatgatgtcatccatcaccagcaccttctcctcccacgagggcacctccacactctgtgccctggctggcctctcctgcagagcctccaaattcaacggggtgcctcctttggagaagaaaactcatgcctctgctttattggctgacatgttcctaaggagatgtgacagcaacctcatttcagataatggtgcacattactgcaagtatcacacgtacaggtccaaagttggggggcagggcaggaggaggaggatgagatggaagaggagaaggagaaggagaagaagaaggagaagaagaaggaggaggaggaggaggaggaagaggaagaaagaaggaagaaggaaggaaggaaggaaggaagaagaagaagaagaagaagaagaagaacaagaagaagaaaaagaagaaaacagcaagcttttaagtctgtatatttgtaacactagatcagaaactcagtactcatagtgaaatccaaaaatgatcacagtcaattccatctcatacctagactgaaataagaaccttcgaaagaaaagaaagttgagagcttcaggcttgtcaaaattttcctgtataggtaaaattattggtgactttctctcactagaaaacataaacaaaaattcatgcttcatatatttgtaaatagaatatatttatttctatcagttatgacatgcaagcaagtaataaagtgaaagtataataataaaatgatataaggaaatgtctctgtgtcaaaaaactctattgaggctattaattttataaaaaccatagagaatatttcatgaaactacattatacagtacattttactattttactgatattttaatactcaataaattaaagaaaattcttaatcattatttattaccaataacattattctacttgagtaatcattttgagattaaatattttaaataaaacattaaaaacaaattgtgttgactgatatcagctttcaatgaaataatacttctgtatttgtagtcatgtgaagtataactttctcctcacaatggttcttttataacaccagtggtatttttttctctgatatacatcctttttgatctcacagttttactgtaaccatacattacatgactccagagggtagccttcaaataaatggaaaaattatatttgtgacaaaattctaggaaagggaatggtaaaatgggagaataatttctgaatttctaactgttcattagtggatttggatgtattaagatatagacaaatatttgcaccctgcaagtttccatatgtgtatataaatttaaatgaggtacccataatgtatgggttgtgtaatctttcaattcatccttaattttccatgtgggaaatttgataagagtttatccttatcaaatactcaatttgaagtactatacccaatttcaagtactacactcaatttgataaaattttgttggtaaagccaacaaaatctgtgtcaacattcatttcaattaatccaataatgttaactgctgatagcttcattctccttcatccctgttggcagcctgaaagctaattcttactctaattcagtgctcaaggtgccatccacaagtggctgtcatcttgctgtggattgtgacctctgactccaccactttcatcctatagtagtcctacttttgcatatttaataaactttgtacatggttaaataataaaagtgcagtgaaatgtcagaccatgctgtgaaatgttccattgtttctatatctgtaattgacctttcatgttgtggaggacaagaaaaacaattcaatatgtttcttagtatccagtccaatgcaccctttcttattaatgtgccaaacctgtaccttcaaggcactgacatccaagcatggctagatgtatcaaaatatcttctgattaatcaccattatgttaatcactgttgcccagatctggactctgactgtgaaattgtagggtggaaattgctataattgctcaaactatgggaatgactatgttttgtcataattactactgtcaccttactgaaaaataccacattacatggcaacttttagttacataaatcctgttgattaatttttaatgtccagcatttatgatattgcacaagtaaagatctttgataacttaaatgattagctgagcaatgattaaaataa

SEQ ID NO: 480364 - DNA, 657 bp, Homo sapiens
cgtccagcaccagcaccttctccccgccaagggcgcctctgcactctataccctggctgctgtctcccgcagagcctccaatttgaaaggggttcctcctctggacttcccgctgaccatgacgcgcactgggccaagaggaacaggcccaaaaggaaaagcaagatcagagaaaggccacagccttagtcatggccctcggagagacaaacttttgtggttcagagaggacagaaaatgcagcaggccagtcagctggcaagcaccagcttatgtcatcaccctcactgagccccaggtacatttaaccattgaggaccaggaaattgatttcctcctagacactggcacagccttctcagtgttaatcttctgtcctggacgactgtcatcaaggtccgttaccatccaaggaatcctgggacagcctgtaaccaggcctgaatctcaaaaaggattacaggatattgctaaacatttaaaagctcaatcgagccttagtaaggaaatgcagcagtccctgcaacaccccaattctaggagtacaagaaaatgaatggtcattggagactagtgcaggatcttagactcatcaaggaggtagtaatctctctatatccagttgtacccaaactctataacctgctgcctcaaata

SEQ ID NO: 480365 - DNA, 588 bp, Homo sapiens
ctcgcctgagagaactaatgccacagccccctggttctgctggttttaacacactgtaaccaggtgcacctctgccatagattatctacattgataatggtctttccagaaagataactgaggaactcatatttagtcgttctgattcacatgtatcaacttgaactaaaggaggaccacatcattagaactaatggacagatcgaagatgaaaggaagaataaaggaaaagctgtttctttgcaagtggagctcctagctattaatgtaaagaaggaggaactcaatcaatctgtaaattgtatgaaagaatttaagatgaccttgactgtgggagccttctgccttctgcctggatcccaactgctgctgacagatgcacagatcatattggatcttggggctgtcatcaacaacaaaaaacaaacaacaacaaaaaaaacccaggataatagcagcatttcagatggaatttccaaaatgatggtgctgaacaatctgaagtctgcttttatttggtgccttaggccagtcaggagagaatgcatagctgccccaccatgaccacctgggtcctgcagttctgcc

SEQ ID NO: 480366 - DNA, 703 bp, Homo sapiens
ggtgatgggttgacaggcagcccccaagcaataactgagcatgaccggtctagggcctaggcagaggagcctcccgctgtggccagcaccacaactgattcacagagggtacttccagtccactgctgatgttcacttaaatcccaaagactctcagtcaccttttgatgaatactaccaagcctggaatttacccttcagggcagtgggctcccctctggcccaggtaatgtccataaacattgatgaagagagtctaggcctggactcagggacaccaagagtggtggtgctctactactatagctcaagtggtacccaaggttcctgctcgcatgatttaatcatctccaaaaggcctcacttcctcactttgggaattagatttcaagatttttggggagacacaaaattcatgccaaatcaaacagtaagaatgaccaaagtggagaaatacatcagaccttatctctatacctatgtttaacaggtagctcttgactttctgatcctctctggtttttctgacccatgatgacttccatatttttcttgcctttctcatatttgagttccagtgaggcaacttctttccataccatttggaaagctgatgcaagagtcacttatatggattcctcaagctctcacttctgctacttatgaaaacctaaacctaagcttcttgcattcactttttact

SEQ ID NO: 480367 - DNA, 539 bp, Homo sapiens
cccaagatttctttcgttggaatccgtgaggccaagaaccccatgtcagagaacacgaggcttgctaccatcttggaagtggcccgtggccattttggaagtgacccaccgccatcttgggagctctgggagcaaggacctcctggtaacactttgactccatgtctcacatacagggcatactggtgcaaagggtgtgctcccaaggccttggacagccccacacttgtgaatttccaggttcagcccccacagctgcttcttacaggctctgcagcttttccagaagcacagtgcaagctgccagcatatcaaccattctgggatctggaggatgctggtcctcttttgacatctctgctaggcaatgcctcagtggggactccaggaccacctccactcagagttccttccgttggtcaccaaatacaaactgaaaatatgtgagacaggtctcagtcaacttacaaagtttattttgccaaaattaaggatgcatgcccatgatgcagcctcaggaggttgtgaggagaattgcc

SEQ ID NO: 480368 - DNA, 748 bp, Homo sapiens
agctccgggaagcggagcttgcaatttacagtcatgggccacataacagtatttcagccaatgatggacctcatatgcaaaggtgagcttgagcgctgttctgggagatccactgctctcttcagagccagcaggcagggacgtttaagtctgctgaagctgcgcccacagccgccccttaccccaggtgctctgtcccagggagatgggagttttatctataagccactgactggggctgctgcctttctttcagagatgccctgtccagagaggaggaatctagagagacagtctggctacagcagctttgctgagctgtggttgcctcctctcagttcaaacttccaggcagctttgattacactctgtgtacctcatttggaaattcagaaatcaccctcttctgcattgatcttgtcggaagctgcagaccggaggtgttcctattcagccattttgccagctcagaaagatgtttcttattaggattcattgaaactacctgaagaaagcctccagatttaatttgaataagagtttttgtgaaaataatttgaactcgttattttttgtctttttaataatagccaacctaacaggagtgagatcatacctcattgtgctcctgacttgcaacttcctgatgattagtgatgctgagaatcttttcatatattttctagcctttcatacatcttcccctgggaaacatctgttcagattatttgtccattttttaatcaga

SEQ ID NO: 480369 - DNA, 722 bp, Homo sapiens
ggtgggctgaaggactcctcaaacatggctagagcagacgccgaggccgaggaggtgctgagagcctctctgctgcaggtctgctggagtttgctggagttccactccagaccctgtttgcctgggtatcaccagtggcagctgcagaacagcaaagattgctgcctcttccttcctctggaagcttcatcccagagggccacctgccagatgccagctagcactctcttgtatgaggtgtctgttgacccctgctgggtggtgtctcccagtcaggaggcatggcggcaggaaagtttaagtctgctgaagctgcacccacagccaccacttcctccagatgctctgtctcagggagatgtgagtttcatctataaggccctgactggggctgctgcctttctttcagagataccctgcccagagaggaggaatctagagaggcagtgtgactacagcagctttgtggagctgcaattggaagtgccctgcccagagaggtggaatctagagaggcagtctggctacagcagctttgctgaactgcagcgggctccactcagtttgacctgcttggcggctttggttacattacaaaaacgttgataattttaaaaagtttagttgcatgttggtgacattttaccacatttcatatgcatcaattgtgcattacatttttagaaattttaaaactgcctttttagtatgataagttctct

SEQ ID NO: 480370 - DNA, 624 bp, Homo sapiens
gttgaggaaaaatacccctaaggatggcctatcagtggccctggaagttcagctatagccacagtcttcagatggggacagggtgggtgcactgggagactgttactgtagacctagaagaagcagtacccgttcatcacctggaaacaggaaaaccatctgcagattttgaagtagatccttattccagtgccagatctgctgaccaaagacctggagtcaaaagaaaatcaaatttactggtgaatggaaaagttccaaatggaaaactgagagaagagacccagggcctattggagagcctacaggaagaagcccagatgcagaaaagggaagcagcaagaactctaaagtacttaggctctgggcacaaggtgcataaggtgaacctgaaataccttgtcattccagaaaccatagaaatgatcaaaaaccactagagttatgttagaaaaggtcttaagagccaacctggataaattcccactggaaaaatatgagaagttctcttaactaccaaaaagagtaataattgaaagcgatttaagtatgtcaaatattgtcaagactattagctcataatatattttttaaaagcctcattgttcacttgtgaaggatttt

SEQ ID NO: 480371 - DNA, 567 bp, Homo sapiens
cgccacatccttgccagcatgtattattgcctgtcttttggatattagccattttaactaggatgctccagccatggctaaatggggccaaggtacagcttaggctgtggcttcagaaggtgaaagacccacacctgggcagcttcaacatggtgttgagcctgcaggtgcacagaagtcaattaattgaggtttgggaacctccacctagatttcagaggatgtatgcaaaggcctggatatccaggcagaaatttgctgcaaaggtggaaccctcatggagaacctctgctaggacagttcagaaggaaaatgtgggtttggagcccccaaacagagtccccactgggtcactgcctagtggagctgcgaaaagaggcccaccatcctccagaccccagaatggtagatcctcggtcagcttgcaccatgtgcctagaaaagccatagacactcagtgccagcctgtgaaagcagccaaaaggggggatgtatcttgcaaagccacagaggcagaactgcccaaggccatggcctcttgcatcagtgtgatctggttgtgagaca

SEQ ID NO: 480372 - DNA, 556 bp, Homo sapiens
actttgtcaaagatcagttggcttataatgttggctgtgggtttgtcagagatggcctctactaccttaagcaactatgcctatattatgtttttaagaatacattctgcaaataagcctaaccgttatctgcatctgtttcagctgaaacactatgcagatgcaattggtgcacactgcaaggtgtcaatggagctaccattctggggtctggaggattgtggccttcttctcacagctccactaagcaattaccagccccagctgaccctgaaccaggagaaagcagggccaactttgctgcaggactggggcatgtctgcactgcatattctcctgcttgccagcctttcccagtgcccctgcctggccaccccacaggaatgtgtggatagtgtggcttccactgcccagcctgggtgctgtgcttcacccaattatcttccctgtagcctgggaacactttggattccccagcacacctggtacctgactctgttggtacagaggatagagctgagagccagtcctggcaccctagggttgcagtgagcag

SEQ ID NO: 480373 - DNA, 564 bp, Homo sapiens
ctccaccatgctgttctcttgatatgataattcccacaatttctgcactctccctcactaaagcacagagattctttctccataccatgcatcccctgccatcatatgagagagtggtgttggcaattccaaactatctttcctaccttgttaatgcctctttcagtgataagaagttaaagccaggtactgtgatcactcaacgaatttttggttcttatgatgacgtttaccatcatgagaatacacagaagtataaaagcagtaacaaaaaagaggaaaataaaggactcacattttatcacgacagaaatccaactgaccacaatgacaatcttgttacagcttttttaaaacaccgagggtctgagagttccatacccctctcagagacacaagggaaatcctgagacccagcattctggtgctgattcttcctcatctttgtggtctaatctaccttcaatctttgaggttgctgacctttggatggactttttttttccttttattctgtttgatgaccttgagcatttgattgtggtttaaggtggattcagctaa

SEQ ID NO: 480374 - DNA, 3853 bp, Homo sapiens
tgggaacccacttcttgcattagcatgacctggatggatttccacttttgcatcttcctcctctctttgcctgctgccatccatgtaagataagacttgctcctccttgccttctgccatgattgtgaggcttccccagccacatggaactgtgagtccaattaaatctctttcttttgtaaactgcctagtctcgggcacaggagcctctcccagtggccatcaccaccaccagcacacggggaatttgccaggcaaccactactgctcacttaacattccaagggctcttcagtcagcttgtggtgaatgccgccaggcctgggattcactctacagtgaaataatcacccctgagtcccagggaatgattattcacactgaagaacctgtaaagggagtaagaggaaatagccataatgatagaggaaaacaaggagaaaggagtatcatagaaattgagaaaggacaatctcatgaagacagtgggccacagtgcaaaatatcaaagagagatgaaattcccactgaatgagtctttaatgcgttggaataaaattatattcaatacaaaatctacctttcaaaatcaggtaagaaaacatacaaaactattcaagtgaccaaagttaagataaatgcaggaatgaataattaaaatcaagattttatcacaatgttttagagttaatcaatattcacagaaatgtgacactagtgatacatcacaagcatatcatgagagctgagactttcttcaaataataatgactaacactgtatttttactatgtatcagttcaccagagaagcaatgtaatgaattactttgtttaatgaagatgaaattatttttcacattttgccaatgaggaaactgagaaacggttggtacggacaaagggcagtactctcgtccatgtctaccttcagctcaagcttttgttcttaactactttgctctaatacatactgcattaatgctggtaagtttggatggcccatttaaaattttgtctgattctatagttatcagtaacacagaatactaaattcctttatctcagttatagttacattcaacaaatataatataactaaaatatattttaagtagattgaacttatattgaaaattaaaactgttgtggggtgggggaggggggagggatagcattaggagatatacctaatgctaaatgacgagttaatgggtgcagctcaccagcatggcacatgtatacatatgtaactaacctgcacattgtgcacatgtaccctaaaacttaaagtataataaaataaaataatctgaaaaaaaacaaaaaaaaagaaaagaaacttaaaaatattgaaaaatgttgattgttgatagcaatagtaataaaaacatccacaatattgaggatgaaagcctgaaaattaacttatttcagtgataatttttactctgtaaaggctgtgtagtatagttagggatcaaaaaattaactttaagcatattacaattaaccatagcaatccaattttatcaatcaaaatcaaatccatgtatgttaattaacaatctgaatactatcatttttctttcattcagtagcatcctgtttgtatcttggtgaaacagaataaaagcttctggcaagatatattagattttaaaatatttggataattaacatgctttcatataaagagtatacattaattagtgttttacttccctaaaacacattgatagaatagtttatcattgtatttaatactgttattattttcattactaacattcattgaatgtttactaagaactagtgattgtgataggcattttattcacattatctcatttattgcacacagccctaacataaataccactattacctccattttgaagataactatagctagtatttactgtggaccaccattagcaatctcagttccagtgctccaaagaaatattttaaaatgagtggaacattgtccttgttcttatgcaggttgtagtctggtaaatttatcaaaattttcttgaaaaaatcctgtgcatcattatatgccatgttgaattgaatctttgctctacttttctagctaaaatatatcaggtagaattatctgagtgtaattatttatatcagaatatgtcacagcatttagagattttctaatttgtacttaattgctatgataagaaaaatattaatacgtaaccaaagcaattattttggtctcaaatattaaaaatgtgatggtattccgctgaagtgttggaacttttcttgttattttgaataaatatttctgttattcaaagaaattctaacagttgttttctgacttctaatgaatatgttgcaaatgttcttagtgatatacatcaaatgattaaaggtatagttttccagaaagcagagttcattactgtatatctcttatcctggtaagacaaatctgtacttgattttggtgttaacaaaaagaagcaaatattttttactctttaatgatgttttatgcttaaactacatagagattttcttggtattcatttggaacattgtttccttgtctcattaatacttgtagttttcaattggtagataagaggaatttttgtagttaattttactcagatggagagacaaaagctcaaagaaggtagaatcatacaaatctgagaccaagtctattaaataaaagtgaagattattgccaggaaaaatattttaataataataatttacctagaatgaaaaatttggaatcaaaggtagaactcagcattcatttatccttttgtatatggaacaattttagaagtggggtagggaagaggttcagagtagattttcagaagaaacaaaagatgcacacttattatcttgtcacttctttataatacattattatccctaatttataaaaacataaagaaaataaaatgaagaagaggtttaaaaagaagaggaagaatttgccttcaaagtaggacaaagaaactaagcataagagaaactacttttcagtacactatgtctgaaacaaatttgttacaactaaaagaggacaccaatattttaattttaatgtatccagatggataagagaaactcagtaaaattgctttcaacaaacaaattaaaaaaaaaaacccaaaggtatccagcatttctacactatttataagtgcaatggctgctgcttctgaaaagacttacagaatctgcttttatgttattttttgatgtcatttatagtgtagccattgttagacaatgactgattcaattaaagctaatgcttttgatttcttaaagctctgaatagtatttttaattgcaattgattacatacttatttaataaaagggaaactgttgaactgaccgaataatggtatcccagaatgaggatttacatcagttattggttgaaacatttaaaacttcagagtaatattataattttcctattattcaaacttataaatgaaacaaaaagtgatttttttctatgctttcagaaacaggaattcaccagaactactttactgaataggtgagtgaattattcattaagatgatcagtaggactgggtcttttttaactctaaggagatatgtatattacttcacacagaagcaattattaatttactgatagcatagataacttcatactttaatttttgcaattttaatatacatgtttatactattttatttaattttaataaaagcaaataaagtattgaatatgtaatcattttgagataactctggagtagtaaattactataatttcacttttctttgccttttatttctttattagtttgttttcac

SEQ ID NO: 480375 - DNA, 544 bp, Homo sapiens
aactcccaactctccactacccttcccagcctctgggaagtgggctcctctctggcccagagcaggctttgtgatgccatccaagaggcaagtcctgaaatcagggatccaaaggcctcacttgtgtgctatccctttgatagaaaacccatttcgatgcagctcagagacagggaagccaggggaagcccagcagactctcacagttgaggagatatgcctgggactttcttttcacggggaactctctcccctgtctctttccctttcccaacttgggaccctcagcagacagcgtctaagcacgagccaattgcaggtcactgattggagctacacacagcctgaccatgcaatagaaaagaaaaatccatttttatggggagaaattcaagcaggccacagaatttgtataagtaacgagaagctgaacattatttcccaagctaatgggaaaaatgtctccagggtgtgtcagagacctccatgccagccctctcccatcaaaggcccagaggcctaggaggaatacatggtttcatgg

SEQ ID NO: 480376 - DNA, 1070 bp, Homo sapiens
tcccacaagatctagaaaatttgacaaaagaagacaggaagatgtgggaaagtttagaacttcttagagacttgataaatggctttgatcaaaatgctgataataatatggacaataaagtccaggctgaggtggttttagagcgagatgggaaacttgttgggaactggagtaaaggtcactgttgctatgcaaagagactggtggcattttgctcctgccccagagatctgtggaacattgaatttgtgagacctgatttagggtatctggccaaagaaatttctaagcagcaaaggattcaagaggaagcagagaataaaagtttggaaaatttgcagcctgaccatgggataggaaagaaaatcccattttctgaagagaaattcaagcccactgcagaaatttgcataagtaatgaggagctggatgttaatcaccaagacaatggggtaaatgtctccagggcatgtcagagaccatcacaacagcccctcccatcacagactccaaggcctaggaaggaaaagtggtttcctgggccaggtccagggacccactactctatacagccttgggacttggtgccctacatcccagccactccaggcatggctataaggggccaacggacagctcaggccattgcttcagagagtgtaagacccaacccttggcagctttcacatggtgttgggcctgtgggtgcatacaagtcaagaattgaggttaagaaacctctgcctagatttcagatgaaaggcttctctcataactcagaaagctggctaaaaagctctaacggcaaactttcattccaggagcctcacaatggaaacatttaaaaagcttacacaaatcaactaatgtgggggccaaagccctccaaaacttagtaagtccactgtttattggtaaaggaataacccaatcttcagcgagccatcttgcaggcttgtgccacatgctgcgaaaatgaatcctgaagggacccacaaatctcctcctctcctctactccattcgaagatgagggaccctaccaggagaagattggcagctagattttac

SEQ ID NO: 480377 - DNA, 656 bp, Homo sapiens
tcctgcaatatcccagtggtcctaatgtcatcaaaaatatccctaaaagagtcaaaaagatgtgacaacagaaacacacagagaaaaaaatgggagaaagatgctaatattgctggttttgtagatggaggaaagactcagaaaccaaggaatccaggcataatccaccagtgcagaagctatgatgcagaaaccctgggcacccaaggctgccctgcaagcaggcattaccaagctggggcctcagtagcagccagtataacaagggatgctcaggccagactcgttctgtctaatgggcaagactgctcgacagaatttaggtttgacagctctcccagtgctaaagtcttctatggaaacaagttgagcctaataactggtagtggacttgccctcctttcagaaaaaattacaaaactggaaaatacagataaaatactgtctgcagacgttggcaaacatgtagcatagaaccgtaatcagtgaagggataaaagaagcatggcatatgtttatccatcattttatgggtcataatttttggcttctttgcatatctaataatttttcactgtatagtaggtgtctgtgaatattatggtattgagtgtctatatttgttgtcctacattagcaagatttgaattatattt

SEQ ID NO: 480378 - DNA, 731 bp, Homo sapiens
cctgacagtaggctccggagggaacgcatgcaaagtggcaccggtgcccacctaaaggcagagacatctggagaatgctccagggttgcacagcggcggccgggcaacggcgctcctcacttctcagacggtggggcggccagggagaggcgctccttacttcccagacggtggcgcagtggtgcagaggcattagtcaagtgtggccgccaggcagaggcgcatctcacttcccaggcaggaccgccacagggcagaggcgcatctcacttcccaggcaggaccgccacagggcagaggcgctcctcacttcccagaaggtgtggcagccaggcagaggcgctcctcacttcacagacggtagggcatccaggcagaggcgcttctcacgtcccagtcggggcggcggccgggcagagggtcacctcacttcccagatggtgggacggccgggcagatgtgctccccacttcccagacagtggggcagccgggcagaggggctcctcactttccagacgatggggcggccgggcagagaggctcctcacttcccagatggtggggcgtctgggcagaggcgctcctcacttctcagatggatgccacaattgctatagaggaagaagagccagagggataaatagaatattaaattcccaggaaatgtgtagaaagaaagaagttaaatggattagagaaatttgtaagaattgttaagtttagtctaaa

SEQ ID NO: 480379 - DNA, 3008 bp, Homo sapiens
cctgacaatgcgatagaagagaaaaacccattttctgaggagaaattcaagcgggctgcagaaatttgcgaaagtaatgaggagccaaatgttaatccccaagacaacagggaaaatgtctccagggcatgtcacagttcttcgtgacagcctgtcccattacaggcctgtaggcctaggaggaaaaagtggtttcattggctgggcccagggtccccatgctgtgtgcagcctatggacttggtaccctgcatcccagccactccagccatggctgaaaggggccaacatagagcttggactgtggcttcagaaggtgcaaaccccaagccttggcagcttccacctggtgttgagcctggtccctactgtggctccacctagtggagctgtgagcaaagggccacagtcctccagaacccagaattgtagatccactgacagcttgcacagtgtggctggaaaagctgcatacactcaacaccagcccatgaaaacagccaggagggaggctgtaccctgtaaagccacaggggtggagctgcccaagaccatgggaacccacctcttgcatgcaagacatggaatcaaaagagataattttggagctttaagatttgactgccctggtggatttcagacttttatggggcctgtagcccctttgttttggccaatttctcccgtttggaaaggctgcatttacccaatgcctgtacccccattgtagctaggaaggcttacaactctaagggggtccgcatgagagggtcgtgattgattgagcaagcagtggggatgccaatgggtcataaattcaatctcttaattccatgtttcttggagattttgtttgtttcttgtcattttttaaattcttgtctgactgtcttatttcacaaagccaatcctcaggatttatgtgataacttatttgaaaaagacaagattttagagtttttccagagacacaatgctgagagcaatgctgtccagtggaacatcctgcaatgatggcactgttctttattggtactgacaatagagtagctactacttacatgtggttgttaagcaactgaaatgcagccagtgtgactgagaaagtaaatttttaatcttattttattttgactattttctatttaagtaaatacatgtgtctgtgttgcatggagcggatatagagatcaattttaagcaggataaattcataaagaagcctagtatgtccctggtagaagttaaattatcttccaagccctcagatttttcaccttccactaattaaacaaaatattatgaaatcctaaagtttcccagagttggccattggatttcagaggaaggagaaaacaggataaatcgactttttaataggcaatctttattatactgtttgattttttttaacagccaggagaaagttccagctaaaatatttcacctgtggccatattgattattttgcaatagcctatcatttcttaccatatttttaaaagctatgccttgtggttattaagaggtgattctacaatacttttctgagtgatagctttcatctgacaatgcatcatatttaatgagtagtaaaactgtaattcagtctttgatcactgtcaacaaacaacttgggttggcaaggagctattaagtgtatgctgcattgacaatttattttcttttaggctattttatagtaaaaaaaaatcacctggtataaagtgttgtgttaattgtttataactaactagtagaatttgactgcagagttaatcttaggcaataatttcttcaactaccagtggaattttgcactcaaagttgttaaagatttctttcattcaaatccctgaagtgtggtgcagttctagtcattgtaaagattttttcaggagatgggagaaagatctaataaggtcatttttcacagtgttatactgagagttgtcttggatggaatggctctgcagttcatcagttttgatatttatattcagtacctctgagtagttaaagatcaatgacaccataaaatgcatttatctcatacatactttaaaacatctcacaacaaagcatttagagaactgtgtcaaaaacatgactagatcttgtaacttacaaaaagggacacattttgcctttttatattttccatttttaaaatttttttaaagagtgtgtttattacaaagatattttaggagcaaagataaaaaaatgtattccaaaaatgagcctgtacattctaggacttctgatattgtgactaaagtgagatatattctattaaccttttccaaataggattgtacttgtttataaatgatgtccagcatttggtcccaaatgcaaattttaacttcataatcatataaaaaacttgaactgatatatcaaacccacatactatctaacttttaaatgtatatctatttttatttcataatcacaataacagtaaaatgcaatatttctctgacttcttataataatttccccctatccttctacaagaattcagggagtttccagaccctttctcttgtgggcttatgcgtaggagattcttatgttatcttctctcagtgtcagcatcagtatgtcacatgctccttaaatctgggtttctgtagtgacatgttctgctacttcactgtgcctgagaaatgatgtgctatgatccaatgataattatattgcatcggctcagttgtcctgcacactttatgataagcttgtgaaacagagctgtcttctgttttttgtttcttttgtatatttccatgatgatgatctatgttagttactcacttctaaatgagtaaaaataaaaggcagtacaacacagtggttaacaatatggactctgacacttcagtacttgggtttgattgtcaactctactactactagctatgtagcattcaaaaaactacttgattcccctttgccaccatagccttatttactaaatgtgggtaatgacaatcagatctgcc

SEQ ID NO: 480380 - DNA, 660 bp, Homo sapiens
ctgacatgccctggagacattttcccttctctggcacttgccctttctttctctctctctctctctccttctgccacgtgaagatgtgtttgctacctcttcacacttctgccatgactgctaaatttgaaaacaaacaaacacaaacacctcttctgtgttttctatcaggaagttctggaattctgcaaaaagggcacctgagcaaccaacaagtcagcccttgtgcccaattgtgccccaagctgaatgaattcactttttgtgtagaggccaagacagctgttggggaggctggcttctctgcttctaaagatgccttgacttttatctccactcccacttccatttggccacacttcatctctctgccacagcctcagagtaaggctcaaaaccttggtaggcaaagccaaagaagaagctacaatcatggatatataaatgttgcaatgggggagaaagctgggatgactcccaatattttgattaaagaaatttaagctatgacataaagaaactatgaactcagaaagatagtaagaggaacacttcttttcaagaaaaatgcatgaacacaaaagacgtagaagtttgtctttgctggtcatatttaacaatgctaatttggttagcacaaataggagggatttaaaactt

SEQ ID NO: 480381 - DNA, 1642 bp, Homo sapiens
aaatccaacatgcagctttgaaggactttctcatgcaacttctatcttctatcatggaagccaaggttatttggaccaaacctcctgtcttagttcattttcacgctgctgaagaagacatacctgaaactgggaataaaaggaggtttaattggactgacagttccacatggctgtggaggcctcagaatcatggtatacgaataaaggcacttcttacatggcaatgccaagagagaatgaggaagaacctgaggcagaaacccctgaaaaacccatcagatcccaaagactccagtcaaggcctagggactactcatgaaaagagtttaatagccgactctctcccagtggatctggattccaccggactgtatcttcacagtaagggtgaaacagaagcaaacccattcctatttccaagctcaaggaactttggtcaaagttctcttggagctgagcagaacaaggaggcaaacagaaaagatttgtgtccctgagaagtcatggccacaggctggctatcacacagattgtcaagccagttccatattgcatgggtattacagaaaatctcaaaacataaatttgtgtgtgggttgtcccagagcagcaggatctggcagaaggaaatttccttctaaccctcaaagaatccacataaatcttgttacatttgggattttacgatttgcttcaggaatgagaatggccttaattttcatatctttttctacactcagtttatgtcttgttggcgtcaaagttctgcttgcttcacacaatgagtttaggattttcccttttttattctatagaattcttcatatatattgaaatgctctgcctggggaaaaaaatctgagcctagcgttttatctctaggaagaatcctttatttccttgaacatttatgagactatacagattatatatgtcttcttgtatcaattttactaagctatatacatagcttatgtttatatattatatatataaatgtaagatacaaatataaaaattatgtataaatatgaaaatatatatagaaagcgatatatatgtctatatatatagacagattataaatatctgtctatttgatctaagttttcaaatttgtaggttaaggtgttaatgatatttccttattagcttcttaatctatgctgtatctatggttgtgtaccttttaaattcttagttttatctatgttttctccctttttttctaaacttgactgacggttgcatcatttattatatttctccaacaagcaaaggttagctttgtatgttttactaattttgtctacatcattattcccacactttagtttttcagaattgattctgttgtttcttttctaattctttattgaaatatctagtacattaattttcaagttattagagaaatatttgtctgtaaactcctattgtaatatcacttttcttgctactcacagatttaatctttaatattggcggtatcattgagttctaagtacatttcaattcctagtatgataatctatgaattgctgagaaatagtgtttacaattttgttgttctatttccacttaagtttatttttacttctgctaactcaattgaaaattctttactaatttttaaaat

SEQ ID NO: 480382 - DNA, 547 bp, Homo sapiens
ctgcaatactacatgaagatgaagccacctgaagagggaacagagatttcagatgagccgttaaattccctgtgcagtggcctgcctgtttggggggtggggagttgctgggtgaatgaggatggcggaggggaccaagcatgtcaggggagcgtggtgtcatccaaacgggacgtagcaggcctgggagagccattctgggaggacgcagacctagagaggcctcagggttcccccatcatgaaatgtgggtactacagttccctgatgggcctttctccaccagcccatgatggcctgagtttgtttactgcagtctcctccctgagccttggcttctctatgtgtgtcctaactccaggacccacaggcctgtcaacccccagccctgggctgcttccctggcctcttctctgttctctctctgagggcctaactcccttgcatagtgctgcagaatattgagccacaggccctggctgatgatctgggggactgggcaaagtgttcatcacaggtcaggttctggttcaaagccagttcttcc

SEQ ID NO: 480383 - DNA, 6914 bp, Homo sapiens
cgcgccggcctggacccactttccccaggccactcccgctgccctcgccccagcagccagagaattctccggatctgcaatattccgtaccatctacctggcttgcgtaatgaagtgagacgtttcatgtgttccttgtgggtcaatggcttgccacactcaggatgtcagttagggcacagggctcacatgccaacatttccaaaggtcacgcagcccgcgtgtgcctggatgcagcgctacctggcactagctctgagggcttctcagagtaggcttaccccgggaggctgggactgcaggccagccttggttggtgccgcccagggagatgcgcaccgcctcgcactgattggccgcagggggaggctggcggtcttggcgcggctccaggtgccctttgagtgcagtccgttaggtggcgcctggaagccaggtgcatgcgccctgaggcccgcccacccacaggctacagaaagggcagcgcagggttcctgtgctatgggtcgggctgcacaggcggtggtctatgggagtccggagaaggacaccgtcttcagggtgcaccgtcttcactctgcccgaggcgcagagggaggaggcaaccttgaagcaggagacagtgctggtgttggatgacataatggcggagaactccagctgttctgtagagaaactgacacgaattgaaaaaaaaaaggatgattgaaggttgtttaggggccagtcattatttactgagactatataattctcagaggggacacacaacctgtgaagagttggatgtgaatgatgaagagtcattgagaaaaggctgcctgaagaatcatcctctacatttctagcttgaaacacagggtatttggtgctgtgaatttctgaaatagtggaatactgtaggaggaaacatgtttggaggatgaaatgaagatctggctttggtatgtggagatgtaaggcatgcagttggatatgccaagtctgaaggtcagaacaaagatctggcctgaaactgggaatttgttaatggtcagcataaaaagggtgttttagccttgagaaaacccaagaggatccatgactgagacctgaacaatgtcaccacctacagatttagtaaagatgtcaacaaaatacagaccaaagttcatattaaaattaatgggaacagtcaaactacttagtgagcggtattcagtcaactagcatttagctagctattggctagcaaatttgggggaaaagtgtataaagaatctttgattaggtttccaaatatacgaaataaaagccactcacatgttagaagtcaatatacaaaattatattatgttaatggtactatttaatgctaatagagaaaaatgaaaattattctgaattaaatcaatagacaatgtattttctatcgttgtctttgttttcttctcaatttatttgtgtgtcattttaactcactaagcaatgactcctcttaatcccattactttttatttaacactgcatttgtttttcatgtgcgcaatatcatactgcccaatagagaggaaatgcagaatttagactattatatcagaaacatctttgcttttcagatttggacttctggagtgtggttaatttaagtgttctcatcaggccttgatatttcagatttccgtaatcacttctccaaaataaagtctgaaggtgatgactacaataaaattaaaattatactggcttttaagataattatgtttatgtaaatgtgacgcctttttttggggggtggggtgtcgtaaaataccaatgtatatgttatattcgtaggtgccgtaaaataccgacgtatatgttatattcgtcggtgtcgtaaaataccgacgtatctgttataatcgtcggtgtcgtaaaataccgatgtatatgttatattcttccgtgtcgtaaaataccgacgtatctgttatattcgtcagtgtcgtaaaataccgacgtatatgttatattcgtcggtgtcgtaaaataccgacgtatctgttataatcgtcggtgtcgtaaaataccgacgtatatgttatagtcttccgtgtcgtaaaataccgacgtatttgttataatcgtcggtgtcgaaaaataccgacgtatatgttatattcatcggtgtcataaaataacgacgcatatgttacattcgttggtgtagtaaaataacgacgtacatgttactttcgtcgtcgtgaaatacccacgtatatcttatattagttggtgtcgtgaaataccgacgtatatattatattcgtaggtgttgtgaaataccaacgtatatcttatattcgtaggtgtcgtgaaattccatcgtatatgttatattcgtaggtgtcgtaaaataccgacgtatatgttatattcactggtgtcataaaataaggacgtatatgttacattcgtcagtgtcgtaaaataccgacgtatatgttacattcgtcgttgtcgtgaaatacctacgtatatcttatattagttggtgtcgtgaaataccgacgtatatattatattcgtaggtgttgtaaaataacgtcatctatattatatttgtaggtgtcgtaaaataccgacgtatatagtataggtgtcgtgaaataccgacgtattatattcgtaggtgtcgtgaaattccgtcgtatatgttatattcgtcggtgtcataaaacaccgacgtatatgttatattcgtcggtgtcataaaataccgacatatatgttatattcgtcggtgtcgtaaaataccgacgtatatagtataggtgttgtgaaataccgacgtatatattatattcgtaggtgtcgtgaaataccaacgtatatcttatattcgtaggtgtcgcgaaattccgtcgtatatgttatattcgtcggtgtcgtaaaataccgacgtatatgttatattcatcgctgttataaaataccgacctatatcttagatttgacggtgtcgtaaaataccgaagtatatcttatattcgacggtgtcgtaaaataccgacgtatatcttatattcactggtgtcgtaaaatactgacgtgtatcttacattcgcaggtgtcataaagtacaggtgtataacttataattgcaggtgtcgtaaaataccgacgtaaatcttatattcgcttgtgtcataaaataccgaaatatatgttatattcacaggtgtcataaaatactgatgtatatgttatattcgtcggtgtcgtaaaataccaatgtatatgttatattcgtacgtgccgtaaaataccgacgtatatgttatattcttccgtgtcgtaaaataccgacgtatttgttataatcgtcggtgtcgtaaaataccgacgtatatgttatattcgtcggggtcataaaataacgacgcatatgttacattcgttggtgtcgtaaaataccgacgtatatgttactttcgtcgttgtcgtgaaataccgacgtatatcttatgttagtcggtgtcgtgaaataccgacgtatatattatattcgtaggtgtcgtaaaataacgacatatatattatatttgtaggtgtcgtaaaataccgacgtatatagtataggtgtcgtgaaataccaacgtatatcttatattcgtaggtgttgtgaaataccaacgtatatcttatattcgtaggtgtcgtgaaattccatcgtatatgttatattcgtcggtgtcataaaataccgacgtatatgttatattcgtcagtgtcataaaataaggacgtacatgttgcattcgtcagtgtcgtaaaataccgatgtatatgttacattcgtcgttgtcgtgaaatacctacgtatatcttatattagttggtgtcgtgaaataccgacgtatatattatattcgtaggtgtcgtaaaataacgtcatatatattatatttgtaggtgtcgtaaaataccgacgtatatagtataggtgtcgtgaaataccgatgtatatattatattcctaggtgtcgtaaaataacgtcatatatattatatttgtacgtgttgtaaaataccgacgtatatagtataggtgtcgtgaaataccgacgtatgtattatattcgtaggtgtcgtgaaattccgtcgtatatgttatattcgtcggtgtcgtaaaataccgacgtatatgttatattcgtcggtgtcgtaaaatactgacgtatatcttagattcgtcggtatcataaaataaggacgtatatgttacattcgtcagtgtcgtaaaataccgacctatatgttacattcgtcgttgttgtgaaataccgacgtataacttatattagttggtgtcgtgaaataccgacgtatatattatattcgtaggtgtcgtaaaataacggcatatatattatatttgtaggtgtcataaaataccgacgtatatagtataggtgtgaaataccgacgtatatattatattcgtaggtgtcgtgaaataccaacatatatcttatattcgtaggtgtgaaattccgtcgtataagttatattcgtcggtgtcgtaaaataccgacgtatatgttatattcgtcggtgtcataaaataccgacgtatatcttagattcgtcagtgtcgtaaaataccgacgtatatgttatattcgtcactgtcgtaaaataccgacgtatatcttagattcgagggtgtcgtaaaatactgacgtatttcttatattcgacgatgtcgtaaaataccgactatatattatatttatgggtgtcataaaataccgactatatattatatttgtaggtgtcataaaataccgacttatacattatattcatagctgttgtaaaataccgacgtatatattatatttataggtgtcataaaataccaacgtatatattatatttatgggcatcgtaaaataccgacgtatatattatatttataggtatcgtaaaatacccacctatatattatatttataggtatcgtaaaataccgacatatatattatatttataggtatcgtaaaatactgacgtatatattatatttatagttatcgtaaaaaatcgatgtatatattataggtatcataaaataccgacacatatattatatttataggtatcgtaaaatactgacgtatacagtatatttatcggtattgtaaaataccgatgtatatattatgtttataggtatcgtaaaatagcgatgtatatattatagatatcgtaaagtactgacgtatatattatatttataggtatcataaaataccaacgtatatatttatagatatcgcaaaataccgacgtacatattataggtatcgtaaaataccgacatatattttatatttataggtatcgtaaaataccgaaatatatattatatttataggtatcgtaaaataccgatgtatatattatatttataggtatcgtaaaatatcgaagtatatatattatatttataggtatcgtaaaataccgacctatttataacatttatgggtatcgtaaaataccgacatatatattatatttatacgtgtcgtaaaataccgaagtatatattatatttataggtatcataacataccgacgtatatattatatttgtcggtgtcgtaaaataccgacctttatattatatttgtaggtatcataaaataccgacttatatattatgtttataggtatcgtaaattaccgacgtatatattatatttataggtgtcataaaataccaacgcatatattatatttatcggtatcgtaaaatactgacgtatatattatatttatgggtgtcataaaataccgacgtatatgttatattcgtaggtgttgtaaaataccgacgtatatgttatattcgtcagtgtcgtcaaataccgacgtacatgttatattcgtcggtgtcataaaataacgacgtatatcttatattcgttggtgtcataaaataccaatgtatatgttacattcgtcggtgtcgtaaaataccgacatatacgtcatattctttactgtcgtaaaaataccgacgtatatgttatattcgtcggtgtcgtaaaataccaacttatatcttttattcgtcggtgttgtgaaatactgacctatatcttatattcgtaggtgtcgtgaaacaccgacgtatatattatattcgtatgtgtcgtgaaataccgacgtatatcttatattcatgggtgtcatcaaatgccgacatatatattatattcgtaggtgttgtaaaataccgacgtatatattatattcgtaggtgtcgtaaaataacgacgtatatattatgtttgtaggtgttgtaaagtaacgacgtatatattataggtgtcgtaaaataccgacctacatattttatttataggtgtcgtaaaataccaatgtatatattataggtgtcttaaaatactgacgtatatattatatttataggtgtcataaaataccgacgtatatattatatttataggtattgtaaaataccgacgtatttattataggtatcgtaaaatactgacgtatatattatatttataggtatcgtaaaatacctacatatatattatatttataggtatcgtaaaataccgacgtatatatttataggtatcgtaaaataccgacatacatattataggtgtcataaaataccgacgtatagattatatttgtaggtgttgtaaaacaccgatgtgtatattatatttataggtgtcgtaaaataacgacgtatatatttataggtgtctttaaataccgacgtatatattatatttatatttatcgttaaataccgacgtatatattatatttatatttatcattaaatatatatttatatatttaataaatgtttattgaatttcatggaaatttta

SEQ ID NO: 480384 - DNA, 1096 bp, Homo sapiens
tctaaaatcatgaggaaaataatgattaatctaccaaaaaagttaatgtataattggtttttgcaacaatgcagggacaagtttaagtggaaatggcatagaaatggagagcaaagaagaaaccaaatcgcatttcaaggaaagaattattttactcaggccaaaagaactacttccagagaggaggtgaacaagttctactgtgaaaagcccaggggccatagaaccatagttaatcattcacttaaccaaacaactcttcagcaaaaggcaaaggagaagcaaatacatggctttacagggcagctggcacaagcacatgcaggggaactaccctttataaaaccatcagatctcatgagacttattcagcatcacaagaacagcacaggaaaaatctactcccatgattcaattacctcctactgggtccctcccatgacacatggggattatgggagctacaactcaagatgagatttgggtggggacacagtcaagccatatcatatagggaggacttctttcaagtgggaatttcatcttctgcttttaagaaacaaaagggagaaggaagatcagagcatttttcttgaatctgctgttttttaagtgcctttaactgaaattgccaatatgcgagagtggaatattttgggatgttgtattctgtcatgaagtaggttgtacctgtattattaactatattttatacattttataaagttctaaattgaatacattgaacatttaagagattaatgacttggccaatgttaaaaacatagaaagtcaaagagcttgaaatttgaatgatcagaattagaaataactgaccctaaattgtgtgctatttccaataatgccaaaaaatgtgattgtattatttgtctaaatgaaggaagtgtataactagctaaactacttcttaaacacttatttaatttatattcaaatcattaaataaaactgtcagtgtatttatccagagaatttttctccctttgcactgtctgagagaaatgaagggatttttccttattttattccttcagcctttcaatacagaaaggaagtttttatagaaaacaatttg

SEQ ID NO: 480385 - DNA, 537 bp, Homo sapiens
cttttccttagttcagaaagatcaaaattacaaatgagtggccatgatttgaatggaaagctgaagaaagaaggcctggatctctttgagagcccaggggaaacagctggtgtgcctaaaaggcaaacagcaaatatattaagtatattgcaaaaactaatcccccaaagaactcggagctccatgaaaaggacagttaccctgggcaatgcttttggtggctgtttgggaaattgccagggacagagcactgtgcggtcagttcacacagatgcacccacattcttctcagggctgaaccgagatgaggagactgccgagtttctgcgaagctgcataatccctgaagatctagccttcagcaggggccacccctatggaacagggagaacacagaccatcaaagccaccttgggacaaaggaaatgtaaacaaagcaccaatcactgagggtggtagcaccagtgactgggaacagacgtggagaaggggtaatcttgtgctgccccatcgactgtcacagacacagtagaggct

SEQ ID NO: 480386 - DNA, 932 bp, Homo sapiens
gatgggctctggtgtcaatgatgtgtcaatgccggttcatcagctgctacagacagcaggggaggtgatgcatgttcagggctcctgtgatgctgggaccattaggtgcatgctatcaagcctggccaattttaaaaacttttctgtagagctgggatctcactatgttgccctaggttcagggtatcctcccacctctacctcccaaagtgctgggatgacaggtgtgagctaccatgcttgggactcttgtttctttttaaagttatatttcaatatcctcttcatgattaaaaaaaaaagaagaaaggaaagctggatgcaaagtcagacaagaaagcctataggaatcagaatgttactgtttctggggaatttccagggtaattgctggctacaaatgctgcatcttccctatattagttcagatttcatgtggatttaaagttgcactgtggcagaaatcagagaactggagagaccaagtggggttcaggagggtttattttaggtgtacactggctcaggggacacgtcttgaaagtctgagcagtaaacgaagaaaacaagtgccttttatgcatcttcaggcgggaattatgtgatccaggaagcaggcttacagaagtgagaacaaaggcagttaatcatcatgtgacattcttcggaaaacatgtcttgcagcttatgtttatctattttgtgaccttgcagctgcacagctagaaaattaagaacttacagaacttacaaaatatgttgaggagagatatggttaatgcttcacagactccacagaaagtcagtttatagtcttacttaactctcacttcttgggggggcatttcatacctattctgcctaactttatacagtaagttcttaatttcttttaattttccactttattcccccctttggtgctgtatata

SEQ ID NO: 480387 - DNA, 392 bp, Homo sapiens
  misc_feature (49)..(50): n is a, c, g, or t
  misc_feature (109)..(110): n is a, c, g, or t
  misc_feature (112)..(112): n is a, c, g, or t
  misc_feature (135)..(135): n is a, c, g, or t
  misc_feature (155)..(155): n is a, c, g, or t
  misc_feature (218)..(218): n is a, c, g, or t
  misc_feature (220)..(220): n is a, c, g, or t
  misc_feature (329)..(331): n is a, c, g, or t
  misc_feature (338)..(339): n is a, c, g, or t
  misc_feature (342)..(347): n is a, c, g, or t
  misc_feature (353)..(353): n is a, c, g, or t
caggcatcaggctgagaatgaagttttagcataaaagcttacatcattnnaaaaaaagtaataaaataagcactcaaagtaattaacataagaaaaagtaaatataagnnanacagaccgggtgtggtgactcangcctgtaatcccagcacttngggaggctgcggcaggtggatcatgaggtcgggagtttgagaccagcctgaccaacatggtgnanccccgtctctactaaaaatacaaaaattagcctggcgaggtggcacatgcctgtagtcccagctactcaggagcctgaggcagaagaatcactgcaacctccatctccnnngttcaanngannnnnntcctcnacctcctgtgtagctggcattacaggaacatgtcaccac

SEQ ID NO: 480388 - DNA, 366 bp, Homo sapiens
  misc_feature (104)..(104): n is a, c, g, or t
tccggctcattcagtcactaattgttattctctgattcattgtactagagatcatcagtacagatattccatgtgttgtatagttttagggttcctttggagtnagattctatttttatccactgtgatctgagagagtgcttaatataattttgattttcttaaatttatttagacttggtttgtggcctatcatagggtctatcttgaagaatgttccatatgctgatgaaaagaatgtatgttctgcagttgttgggtagaatgttctgtaaatatttgttaagtccatttgttctagaatatagtttaagtccattgtttcttggttgacttccttgatgacttctctagtgctgtcagtgg

SEQ ID NO: 480389 - DNA, 135 bp, Homo sapiens
acggcgaccccccttctgcgagtgctgtcagaggggatgggggtgacatctaatccgcccgatcttcataccgagcggcaagggctctgagggcgcatggccaggtcaggtctgtctattctctgtgccgagttg

SEQ ID NO: 480390 - DNA, 432 bp, Homo sapiens
agcgggtgtcttcgaggctgcggctcggtggtgtccggcgctgtgagcgcgccgtctgggcgcccggcgcagaggctcccgagagcggacccggggctcatccccgtcggtgctcccgcgctcccctgtgcgtgcggtgtgcgccttcgagctagctcgtctcgctcgctctgcttctcctgtctgccggtctgcgccatgtgcgtcggctgttggcggtcgctgagctggcggtcgagccggcctgcggcagccggtaccagcagttgcagaatgcaagaacagtctggagaacctgaacaggctgcaggctgatgctccatccaccttacagcagcatttctgcagagagcgcagcatattttgactacaaggatgagtctgggttttccaaagcccccatcttacaatgtagctacaacactgcccaga

SEQ ID NO: 480391 - DNA, 324 bp, Homo sapiens
  misc_feature (32)..(32): n is a, c, g, or t
tgagcttcttcaaacacttgttcactactttntattcttccgtgctttatatcttcacgagccaaagctaccgaacgaatgtcttcctctgttacctcataaggattatgaggctccaatacttcaacccctatattttctaaagcctttacagccaattggtagtgttggaaatctaagttatgttttaatatgatggtattcataataaacctttatttttcgtaaaggtacaaagtaattacaaaacagcaaattggcaaatcgccaattttttattacctttgtcggcaataaaaaacatttgaatgacaacagaaaata

SEQ ID NO: 480392 - DNA, 771 bp, Homo sapiens
ggtcggtaccttagacggacgcattcatactaagcatccaagtaaggagaagacaagtgcaaaaagttggtcgggatgagtgacggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaatcaatgaatccaggagctggtttttggaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaatggtggcaataatcaatagtttaccaaccaaaaagagtccaggaccagatggatcacagccgaatctaccagaggtacaggaggactggtacattcttcggaactattcatcatagaaagaggatctcctatcattatgagccctcttcgtacaagcggcgaacacaaaaagattgc

SEQ ID NO: 480393 - DNA, 204 bp, Homo sapiens
ggggccccgggcccaaaaaaaacccagggttaatacccccccttctttgggttttttttctaaaaagggggaaaaccgggtctggggccccccccccaagaaaaagggggggggggggttttgaaaaccgcctaaaattttttaaaagggtaccccccaaaagggcttttccgggtcttaaaaaaaaatttttttttttaggga

SEQ ID NO: 480394 - DNA, 223 bp, Homo sapiens
gctctaacacagtagccactagccacatgtggctattgaaagattgaaatgtggttattccaaatcaggatgtacagtaaatataaaatacacaccagatttcaaaggcttacatgtaaaaaagtaatgtgaaatatctcactagtagtttttatagtgattacatgttgaaattttacacattgtgaacatattagtttaaataaaatgtattgtgaaaatt

SEQ ID NO: 480395 - DNA, 166 bp, Homo sapiens
gggctgttggtggagacggattacaccttcccacttgctgaaaaggtcaaggccttcttggctgatccatctgcccttgtggctgctgcccctgtggctgctgccaccacagctgctcctgttgctgctgcagccccagctaaggttgaagccaaggaagagtcgg

SEQ ID NO: 480396 - DNA, 194 bp, Homo sapiens
cggcgcgttttacggaaacagagggactcggaatcaggcagcagaagcagaaaaaggcaacgagaagaaggaggaacccaagtagctttgtggcttcagatgtccaacacctcattgcccttcgacctgtgtgcctggtcgccagtcccacacacgctcagcgtttcctacctgtagatgctcacagagtccca

SEQ ID NO: 480397 - DNA, 1156 bp, Homo sapiens
  misc_feature (74)..(74): n is a, c, g, or t
  misc_feature (261)..(261): n is a, c, g, or t
  misc_feature (276)..(276): n is a, c, g, or t
gattgccagacccttgaaacacacggaataactgcagatcataagcatatactcgcagatgtataactatggtngttacttatcattccaatggtgaacaatacctacaaagcctgtagcgtacacctcgataggaagattctccgttgagaggagaagagaagtggtgggagagctagctagaacacatcattaaactccatgagttgcgaaacaaggaacttccgtaaagtagacgtcctagtaacacctagcacaagnttttgtcctcgacanagaatagtggaagagttagtcgtcgcacataccacgttccatcgagctacagcatagcccaaggtcatgcgagcgccaatgaacctcaaaaaaccaactttaccttgctatccgtggtgcgcctccgtaattcgcgtggttactctgtcgaacctagtgaacagagtctgccccaacccgctccgagccgaatcgggctcactctagctcgagctactctaaacaccgtgaagttttccccacacctttgtgatacaaaattcttgagctagcgatccgttcgctaagggcccttgcaccataggcgtgataatcgatcgagaccatccgcgatccctggttggataaatatcctatgtacgagtctcgaagagaagctataagacggtgcccaatgagctgtgtttccggtccccatgccactctcatacactatgcaccatacgcaactgcagtgtctttccgtacgtgcacgcaatggtaactatacgaaagccggcaaaagggtggaacactttgtaagcccaacccctaaaggattgtctatacctggacccattacccatggggaaccccacttccattgcgttcccctttacttaaaatcctttggcaaaaggccaagcctaaattcggcgaattagaacccttttccccagttccccctatgagactaaggcggtccccgaaaccccaaaacttaataagggcgactttcccaccgacatgaccccttgtcgtaggatcgttaccgcagcggtaaagcccaaaaggcacgcggaatagagagcagagaccccggcaacgattccttagtggatcgaaccaggacctgcgtgcacagaaagtagatcatttggaggatccttcgccccaggtt

SEQ ID NO: 480398 - DNA, 167 bp, Homo sapiens
  misc_feature (111)..(111): n is a, c, g, or t
  misc_feature (131)..(131): n is a, c, g, or t
  misc_feature (162)..(162): n is a, c, g, or t
aggatcccctcaagggaggggagagagaaacccacacataaacaatgccatcactgaactgtttaaacatttccacttgcagtttaatttcttgaagactgttgcctggtnggaatgtttcttgtcactgnattttaacggttgcattctggaaaagactanaaggc

SEQ ID NO: 480399 - DNA, 206 bp, Homo sapiens
ctcgattcggtaccctggtggtgcttctggagaagagcagagatacacgtgccatgtgcagcacgaggggctgtcggagcccctcaccctgagatgggagccatcttcccagcccaccatcccctatctgtgggcatctgttgctggcctggctgtcctggctgtcctagctgtcctaggagctgtggtggctgttgttatgtgta

SEQ ID NO: 480400 - DNA, 426 bp, Homo sapiens
aattgtaaattagttaatttttatgtggaatttgctgagaaaagaatatagactactgaaatgtcatcttagttatttttcttatgaccacattgtacaaatgaatctgtgtaaaaagactattttaaatgtatttcctgcttttgtaagcattaaagatttaaaaggaaatttttccaacttttttttataaaatggaaggtttggatttttaaacttatggatccctctgcccccaaccccctcgttttgggaagataatttggatccctaataaaccttttacccctaggctttatatatgtttttctgtcacaaatgcttcctggcacacaggaaccaagcccaaatgggaggggatcaaattcagtgttgtatgtatgtttatggcaacattttgaaaataaaaattaaatgtttttcttc

SEQ ID NO: 480401 - DNA, 689 bp, Homo sapiens
cccaatacctccttttaaaataaattacccagtcttgagtagttctttatagcaatgtgagaacagactaatacaatggtctatgtatttaactgtgtttttgtggtggccaataattatctttggtttctatgtttagcactcccttaaggacctcctttaaggcaggtctggtgataacaaattcccttagcatttgcttttctgaaaagaaatttatttcttcttatcttacgaagtttagtttggctggatacaaaaattcttggttggaatttcttttctttatgaatgctgaatataggctcccaatctcttctggcttgtagggtttctgttgaaaggtctgtggttagcctggtggagttcctgtaaaggtgacatgccctttctctctgcctttactattttttctttcactttgatctgggagaatctgatgaccatatgacttagggatggtcatcttatatggaatctcacaggggttctttgaatttcctgcatttgaatgttgacctctctagcaaggatggggaaattttcatggacaatatccttgaatatgttttccaagttgcttgctctctctccctctgtttcagggatgccaatgagtagtaggtttggtttctttatataatctcatatgtcctaaggggatttggtaggttcattccttttttttc

SEQ ID NO: 480402 - DNA, 403 bp, Homo sapiens
aggttgcagtgagccgagatcatgccaccacattccagcttgggcagcaagagcaagacttcgtctcaaaaaaaaaaatgcccggtgaggttgactcacgcctgtaatcctagcactttgggaggccaaggcggatagatcaccaggtcaagagattgagaccatcctagccaacatggtgaaaccctgtctccactaaaaatacaaaaattagctgggcgtggtgacacgcgcctgtagtcccagcaactcaggatgcttcttgactcaagaagcatcctgagtttactctgtacgaatcacgggtgttggacatctcggtatcaccgttgatgaactcattggtttacaagtcatttgtgctgtactgtttatgattggccagccatgacagccgtgggaa

SEQ ID NO: 480403 - DNA, 290 bp, Homo sapiens
tggagcacccaagcgggacaagccctctcacagtgtaatggagagcacggtctgaatctgcgcgagagcaagatgctgagtggagtctgttcctttgtgctgggcctgctctttcttggggccgggctgatcatctacttcaggaatcagaaagcacactctgtacttcagccaagaggattcctgttcttaagtacagaatcatctatttaaatcattttttcttcagtctacacatcttctctggagagaaaaaataacatgctatttcaacacctctagtgtaagtg

SEQ ID NO: 480404 - DNA, 879 bp, Homo sapiens
  misc_feature (11)..(11): n is a, c, g, or t
  misc_feature (62)..(62): n is a, c, g, or t
  misc_feature (67)..(69): n is a, c, g, or t
  misc_feature (72)..(72): n is a, c, g, or t
  misc_feature (74)..(74): n is a, c, g, or t
  misc_feature (81)..(81): n is a, c, g, or t
  misc_feature (94)..(94): n is a, c, g, or t
  misc_feature (100)..(103): n is a, c, g, or t
  misc_feature (112)..(112): n is a, c, g, or t
  misc_feature (116)..(117): n is a, c, g, or t
  misc_feature (136)..(137): n is a, c, g, or t
  misc_feature (149)..(149): n is a, c, g, or t
  misc_feature (220)..(220): n is a, c, g, or t
  misc_feature (398)..(398): n is a, c, g, or t
  misc_feature (482)..(482): n is a, c, g, or t
  misc_feature (518)..(518): n is a, c, g, or t
  misc_feature (522)..(522): n is a, c, g, or t
  misc_feature (877)..(877): n is a, c, g, or t
gtccatatgtnttggcctacactgttctggtttgttaattttcttcttctgtgttctttttntttcnnnttntngttcttngttgttttggtcncttctnnnnttgcttggntttnntctggtggttccattttgnnagcccaccggcntgcaaacctagggtgttttctccacccctgggtcacagatcttcgttctccccggctctgttacccaaggnccctacagcctctggggcctaacacccaagctcttccttgcagaagagctgagatgctaaggagaccatctggggtgtcataataggcccttggggtttgctgagctcccacatggctttcttcaaccacctggcccactttcttcaaccacattccactttggaatgcgtgtctttnaggcaccaagtgatcttaagaatgggctctgtttttgaattcagcaatccaagttcctttctatctcggtggggcctccaaaangagaaaaaggattggcttggcttctaatgttaggcntgcnttttacacaccagttgtgtgtttgttagtggctgctggatgccagtccacaccctcaaacacctcacagtcccaaacggggtgctcctacaggtcccagggtcctgttagtggaagaaaggcagttccaggaagtcttcctctagccttcatgacaggaagtagttaatcctctgggaaatagacttgcagccctgggaagaaaagagttgttcctccttggggacatacaccatcatctgggctatttcatccagtgtctcttctttatacaggagctcctggctcaggaaggcatcccgtgcacacagcctcacgtgacggtactccaaaggcagggagggggtgaagtagtnta

SEQ ID NO: 480405 - DNA, 113 bp, Homo sapiens
tgtgcagtggactgcgatacaatcatctgcatcatacaccagcaaagcatggtgcaaaacactgccctatcatcaataactctataccgggtccctcccaaacatgtggggct

SEQ ID NO: 480406 - DNA, 1533 bp, Homo sapiens
  misc_feature (408)..(408): n is a, c, g, or t
  misc_feature (429)..(429): n is a, c, g, or t
  misc_feature (625)..(625): n is a, c, g, or t
  misc_feature (627)..(628): n is a, c, g, or t
  misc_feature (634)..(634): n is a, c, g, or t
  misc_feature (641)..(641): n is a, c, g, or t
  misc_feature (652)..(652): n is a, c, g, or t
  misc_feature (656)..(658): n is a, c, g, or t
  misc_feature (662)..(662): n is a, c, g, or t
  misc_feature (971)..(971): n is a, c, g, or t
actgtaaacatctatatgatctgggattttgtttttattttgaaacgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttcttttttttttttttttttttattgacttgtggagggcacaattattcttagttacgtgcaactgtgccagaaacttgggtattgtgtagcntgtgtgcccgcttgacttagnagctgtggactggattttggacattaaaaatgtgaaagcatttaaggggttcccctacaaaacatttttcttaacaatactttggaaagggctataagcagttgattttcaccctgggagagcatcacacggtgtggaggtccaggtgatggtggaccctcccaagccctccgtgttcttaaagtttatcgggggngnngcgctncctctanatcttttgggnggcnnnattnctttttctctgacccagtgggaaaggcaaccttctggtgaatcattctcaacacagggtactaattcccctttatagacgtgcgggaaactaaagaacttggcgggcaaagtggcgggaccaatggtgaaagtcgggtctgggcacaacggtgagtggaagagcggttgggacaggtggagaacgggggggaattttgagaatcaatgggacatggagagagagcacgcgaaaaattaagaggagggtgacacggttgtggttattccgattattttattgatttatagctttcttattttcttttcgnccaccccaccaccccccaccaccacacacacgaccgaccgaccagcaccaccaccacacacccaagcacagcccaccaacacccacccgacaccaaacccacacgacgcaccgaccccaccaccacaccccagaaacaacaccaccacccaccgcccccacaacaacaccaccacacccaatggaagcgggagcacagaatggaggagtaagacgaagacaggaacgagagaaaaacgaacgagaagcgaaaggcagacaagaaggggagatgacgcgaggagggagcgagagaggcagaagcggagagcgagaggcagagaggacaacgacgagaagagacacagcggagagacaggagacaaaggaacaaacgagaggagaaaccagcaccacacaaagcgcacagaacggacaaggaaaggcaaacaaagacagaagagggccagcgaaagagaacgaacaaggaacaccacaggctaatcacacaccacacagcagaggacccacccacgacacacacacacgcagacaaacccacacaaacacacgacaccacacac

SEQ ID NO: 480407 - DNA, 212 bp, Homo sapiens
tgaactactgcttcatcgtcacttattcatagtgcagcgccccatgcttcgtagcgcgcttgccatactattatccacatcagtctcagtgatgtactctggtcactccgttcaggtcattgtggtaagtaccgtagcacactgatgatttccccgctaccgtccactccatgctacgcgggtcttagctgttccctgaatatagatagagg

SEQ ID NO: 480408 - DNA, 115 bp, Homo sapiens
tataatcgagtaagtcggtgcttccatgtatgaaggtcacatccgtagcattcgtgggaagtataagctcatactctcattcacatatgggaggttagatttttttttaagtttc

SEQ ID NO: 480409 - DNA, 145 bp, Homo sapiens
gaccccgcctgaaaaaagggttttttaccctcccagccctgggtcaactttgaaaaaggattttggtacagaaggagcccttgggctcccttttttttgatagcagttataaagcccttgttcccaataaaactgggcagatgga

SEQ ID NO: 480410 - DNA, 97 bp, Homo sapiens
aggtcttctcgtttctacgtaacctttcgttaatacacagacttgtggaagtgctcacctaactagattataaaccgatgtttgtttttccctcact

SEQ ID NO: 480411 - DNA, 1156 bp, Homo sapiens
  misc_feature (389)..(389): n is a, c, g, or t
taatttcttccagggattcattaagggctttgacccccgggtaatttctacccacattgaaatgaatccaaggaaatatttcagggacctggaggggatgtgtttttataacatgctcctggcgaacagggatcgatcagacgctgagaaacgccctgttgtacaggccaccgccttgtagccgcaggcgcccactctgtgtggcaataacactattgttctgcgccctattgtccctcaagtcagggaggttacaggggctccccggagaaaggccctctggagggtgttcccctatccatcttttgtgtgttgcgccccaaaacacagcatatatgtgccccccaaactctgtgtgtgcgccacaagaggcacagagatatgtgacnccccctataaacccactataaagtctgtgcaggaaagagctctatctccagcggagtagtgagagagagcgacactctcacagctgtgcgcctgtgtgcgcccgcacagtgtgtgtgcgtgaccgcccccaagagagagctataatgcagagggcacacaaccccagaggtggcccagactatcttgtgagagcaacgacctgtgtgacaaaactcgctctagagcagcgacgacgacgtgtgcacaacgcccgtgtgttgtgcgcgacgagacgaggcggaggagaattctaccccacccaaccacgagtagtcgttgtcttaagacgacgaacaaaggagggttgccgtgacagccccccgaacaagagcatcgcccttacctcatccgccgtgatggcgtgcccccccagaagaatgagcccaactcaccgcgcgcgtgcacaccaccagggcagacaaaacatgacagaaagacgcaccacacagaggggggactacacacatccctgtggagctctaaatacgagtgaggggccacgcgcgtgggccgatcaccagatggagcaccaccacacgccaccatctacacgatacttcacacacaacactacgtactacacaacaaacaaacatctaccaacagacagtatgaagaaccccccccgtggcggcagaaagagcccaacgcatcgagaggaggagaagggtgggggacaacaccacaccacgctgttatataacaagacagacagcagaaaccaacc

SEQ ID NO: 480412 - DNA, 226 bp, Homo sapiens
actcttatgggcccatctggaaatatgataaatagccataaaacaacagcggaactgcgaaacacttaacataccttacaggactaaggcaggacaaggaaacacggtcacatctcctgagaacgaaaaggaccttcgatgccaagtggtgagaaaagctccaattcgccaggggttggaatggcaggctcgagaaccaccgcccagaccggaacctattctgtca

SEQ ID NO: 480413 - DNA, 812 bp, Homo sapiens
ggcgaaacactatgctaatggcatggtgccgcggtcctgtcttgctgtgcctgcggagggggctcggaaccaattcattcctgcacggctggggcaggacgccctttcgagggagctcggtccctgtgttgcaggtcctcgcttagagacctgcgagatggagaaagagagcacgaggcggcacaaaggaaagccccaggagcaagagtcttgcccatctctccctcttgagcatcttcggacatggggactggatgtctttcgtcactggaaaacctcagattgccgaggctgcgggaagagtcatcacctcgagaagctcgaggactcgagcggagaaccaggggccggtgcggtcccacacaaccaggatccgaggatccttacgatgctctcgccaggcccagtccggtaccgaggtcgaagagcgtcaacgtctccccttcttgttcaatttccagagagagaccctttcaggctgggagctgatttaagcgtgagacttggggaggggagaaacaaaagtttaagaaatcattcaggttgaacaacttccggacttcttaaatagttacttggggggcagtccccgttcgggcaaagaatcgtggggaaacgtccccggcgccaagaatactgaggagtgcctttcggcaaaggaagtaaatgcttgagggagggcagctttgggaagactattgtacgtattgatgaaaaacgagggatgccatacatttccaaaaggatataatattgttctctccaatgatggtattaacacagggatactgtttggaagcgggctaggttgg

SEQ ID NO: 480414 - DNA, 162 bp, Homo sapiens
atacagtggtccgacaacaagaaaagaaactgctgctgcattctctgatcttctccattttgctagtcagtactctactctggcatataaggacggaggtatcctctatggtgccaactgcccagtgggtgagctgtccctgtggcaggtagaggcagatgc

SEQ ID NO: 480415 - DNA, 211 bp, Homo sapiens
cttcccgatgccccccggctggactttcccaagcctcttggagcccctcatctcaaatccctgtgttgaacatgacacttactgtcccttatttgttaaaatttgcaatatctctcaaggaaataatagccaacatttttttgaatgctttcatgactcccgggctaaggcctttatgaggcgttgtctcaagggggcccaacagccatcc

SEQ ID NO: 480416 - DNA, 220 bp, Homo sapiens
aaacaactgcgccctggggttgtctgtgggcctcgtgggcattgtggtggacactgtactatacatcatccgaggacctgcgttcaaatgagtgcttccagacaaccaagggccctagataaatcacaatcctggaatgaaaggtagcatcgccatctaaaggaacagacaagtgaacttgctacataaactaacataatatactggccccatagcgata

SEQ ID NO: 480417 - DNA, 293 bp, Homo sapiens
agtgagcaacggcaggtgagaagcacattgtttacattgtctctgatgggtcagtcactggtgttgaatgcctaagtgctgtgtaaattcagtggtctcatggcccttctaagtgaaaggggagggacttaatgagcttctgaactttttaaagtctcaatccatccttcgatattttttattaaaagccacgttgttaggtaaatgcagtcttgatgtctcaaaataaatgccggtgacctgcaatcatcattaagacgatactggcgttcttcaagaagtggctacagggt

SEQ ID NO: 480418 - DNA, 149 bp, Homo sapiens
ataccaagcgaaggttggctcatgtcatgctcgtatacagatgcagaaactgaagaacagagaacttagatgctcatgcaagatgacaacacagcaggaggtgacagacacatttatttcgttaccgtgagataatatttcaaataagt

SEQ ID NO: 480419 - DNA, 184 bp, Homo sapiens
cacgtagagatagggtctcaccatgttgcccaattaggtctcgacactccatgagctcgagtgatccgggcgccttgagccacccaaagtgctgggattacaggcatgagccaccgatgccatggccagacaatagtaaacacacacaaactctcaagtggcctaattccctctcaccaaacca

SEQ ID NO: 480420 - DNA, 498 bp, Homo sapiens
atgccaaaccacagaatgagagaaaatatttgcaaaccttatattcactaatggcttaatatgggaggtctatgggctccatagaacttaatagcaaaaaacagataacccagttcaaatatgggcaaaagacccgaatagacatttttcaaaaaaagacatacaaatgaccaagaagtatatgaaaaggtgctcaacatcattaatcatcagagagctgcaaatcaaaacagcattgacatatcaccttacatcagtaagaatagccattaacaaaaagacaagagataatcagtgttggtaaactgtagagaaagggaacccttatacatggttggtaggaatgtgaattggtaaaagcataatggaatacaatatagatgttcttcaaaaaattaaaaacataactaccatatgatacagtaatcctacttctgggcatatataaaaaatgaaatcagtcaagaaatttctttacccccatattaattgcagcac

SEQ ID NO: 480421 - DNA, 169 bp, Homo sapiens
gcatacatatacgactcgagttggtaccctcgatagccgagagacattgatttggaaaatccggtccccacccgctaatgagctgttgacacctgttgttcctgtgcgtgaagtgggattgttgacttgtatgttcagaggcgtacgaacgtaattggcccttatcgag

SEQ ID NO: 480422 - DNA, 181 bp, Homo sapiens
cgtccctgacattgcagtgctgtggtgcaggtccagacatggtcagatcccacatggctgtgtctgtggcataggctggcagctgcagcttgtttctgacccttagcccgggaacttgcatgtcgcacaggtacagccctaaaaagaaaataaaaagaaagaaatggactataatcgtatc

SEQ ID NO: 480423 - DNA, 374 bp, Homo sapiens
  misc_feature (82)..(82): n is a, c, g, or t
aggatccctgtgttcttgtttggggagaggggaagcctggggcctgagaaggcagagcccccgagctcggagtgatctgcgnggtcttcttgtctgggggtcctggctgctgcatggaggcgcgaagtcacggaaagtgggccattgccaggctcggttgcctccatagcgaaaaaaatcacgggaacaacagaaacaaggggtgccctagttccctctctgcaggcgggtggggactgggtgagagcccgggggcctccaaaacgcaggcggcaaaagactgttgagcagtgcttgggctctgtctcccgtagacaacgggccatcagggaccaggacaggacattgagccgttacaggggaaagagcggggg

SEQ ID NO: 480424 - DNA, 871 bp, Homo sapiens
ttatcgggggttttcacttttgcttccttctcattttctcttgctgctgccatgtaagaagtgccttttgcctcccaccgtgattctgaggcctccccagccatgtggaactgtaagtccaattaaacctctttttcttcccagtctcgggtatgtcttatatcagcagcgtgaaaacggactaatatactaaattggtaccagtgagagtggagcactgctgaaaagacacccgaaatatgtggaagcgacttgtggaagtgggtaacaggcagagggttggaacagtttggagggctcagacagaagacaggcaacaatgtgggaaagtgtggaacttcctagaaccttattgaatggctttgccaaaatgctgataacaatatgaacagtaaggtccaggctgaggtggtctcagatggagatgaggaacttgctgggaactggagcaaaggtgactcttgttatgctttagcaaagagactggtgacattttgcccccgccccagagattgtggaattttgaacttgacagtcatgatttagggtatctggtggaagaaatttctaagcagcaaagcacgcaagaggtgacttggatactataaaaggcattcagttttataagggaaacagcataaaagttcagaaaatttgcagccgatgatgcagtagaaaagaaaaacccattttttgaggaacaattcagccagctgcgaaatttgcgaagtagcagagcctatgttaatccccaagcccttcggggacaattctgcgggcctgttgagacctcacaggaggccctccataaaggccagaggccgggaaaagggttcttggccgcccggcccctgcggtgaccaggaatggc

SEQ ID NO: 480425 - DNA, 176 bp, Homo sapiens
atagtttaaaaggcattcaaaccaccacaaggggagacaggctagttaccacctcggtacaacagatctaaaaattgaccttcctgattatcaaccccaggagtcagcagagaaagcagaggtcatgtactccttagtactttgaagatgagctcttgttcaagtgccgtcgacgc

SEQ ID NO: 480426 - DNA, 522 bp, Homo sapiens
gaagctctgggaagtgggatgcccccgagggtgccagtccagctagctgccccaaccctcaggccacagacatggaccccaagctcacccactctgtgtgcccctgagcagccctgatgggcaagcagctgcctgccatggccagatgacaccatggagctgctggcagagatgcccatggtggagcaggatgagcacacagctgagcggctgaagcatgcccagaagacggcgacgcccagacaggtgaagatgtgggcccaggctgagaagtgaggcccagggacaagaagtggtcctgagggagacgatacccgcgaacggaggcaagacagaacaaggagctcccttgaagcagagtcctctataccacatcccagatagtagtcctatctggacggccgcatgacccgaacatgacctggcaacaagatcgcccagataacctgaagaaaatggagggtccagaccctgaacctggaacaaagaaggacggacctgacgggacctgaaaacagaagc

SEQ ID NO: 480427 - DNA, 872 bp, Homo sapiens
tgtggtggtgggcacctgtaatcccaacaactcgggaaggtgaggcaggagaatcgcttgaacccaggaggcagaggttgcagtgagccaagatcgcaccattgcactccagcctgggcaacagagtgaggctatctcaaaaaaaaaaaaaaaggtcccatgagggtttaaaaggccaaaaatagccaaggaagagaaaatagggtttgagacctttaattaccataaaaaagggtggttttataaaggcagtggtgacgctatatagggagggaataaggtcctagtggtctacaggcacttgtagaattggacaataatttaacaattaaaatcctatataggttccaaataagtctaagggagaaattttggaagtggttccccaaatgacaacaagaaaatataacattggatctggaaatactataccgacttaatagttgactaaatcctggatccccctaatattggtttcccacaaattatccagagaatattatagccccaataatctttttgtcccgccttgtattatagtgtgtcacagattttcgaagaagtatgtgaaattttttgttgtacaaaagatgtgagcagacgagagattgtggggcacgcaaagagaaaaagaggctaaattgagtgcactttgagggagattagtatgaggggcacgcgtgtgtaacttatagcatagtcaaatgttggtagccgaattgagaaaaagcgaagaaggggggatgcttcccagaagaagctgggatatcaaagggccagggtggttagatggacaccgtgtggaacttagagggaaaggcggaaagaaataaacaacagtgtgccaatccatttgtgcaatggggagaaaa

SEQ ID NO: 480428 - DNA, 123 bp, Homo sapiens
cagtgtggcggagcaccgcaagcgcaagggcctgaaagaaggcatcctgccctggacaacttcctggacaaattgtaggcatgcccttcctgcagcgcctgccgccccggggactcgcagcac

SEQ ID NO: 480429 - DNA, 849 bp, Homo sapiens
cgcctggcgccccgcccgcgccttaggacccgcggggccgcgcggtgcatcctgcgggcggcggcggcgggcgaggctgcctgcagcctgggcgcacgatgatgaagtcgcggttccggcggcagggcgccgacccgagcgcgagaagctcaagcaggagctttgcgccttcgaagcaagactgtggagcatggcttcccgaatcagcccagggcccttggccttcgacccggaacttcgcatcatggccatcgcgaccaggtctggggctgtagaagatctatggtgcacctggcggtggagttcacaggccttgcaccgtggatgcaggccactgtcacagcgagatgcaccttcttgagctggccagggccgcctcctgttcccctgctttgatgacagcatgttcttgcattctctggggagatggtcccaccagtaaatggctgtgcccatcctggaagaacgcacgtcggtcttccagcttgcccagccggcccggccttgactggtgccagtgcatccgctcaggcttagccgagtcacagtggtcctgctggtggctgccggcgactttagcagcgcttggccactgaggggcagccatgtgcctccttcctggagtgttacccgcgctgaatccttgctcgagggggcagacggtttgccccagggcgaggttctcgcgcggctgtgcccgagaaggacttacggctgttgggaagggcaccttggggcgcacagtgagagtaccatccagggaacaccttgtcgtggaccccacaagagattcctcatgcgctacatgccgggcgcctgttgctcatctggaaccaggcctcgagtgtg

SEQ ID NO: 480430 - DNA, 345 bp, Homo sapiens
agcggagagcgccgccgccgccgctgctgcagcagcagctgctctgcagagtggtggccggggccaggccggggtgccctccctcccaccttctcacgccatgagccaggaagtccgggggactgggccccctagatccgacgcagcggagaccagcagcgagtccaccaaatgcaaacgagggagcatgaagtaaggagagataagacgcacagagggagagggggcaaaaggagcgggcatcgagggaggagcgggagatgggacgacaacagaagtagagcagagcttgaacgagagcaacgacacggagacaagagcaggcagaagaagggccagagaagg

SEQ ID NO: 480431 - DNA, 483 bp, Homo sapiens
  misc_feature (13)..(13): n is a, c, g, or t
  misc_feature (25)..(25): n is a, c, g, or t
  misc_feature (54)..(54): n is a, c, g, or t
  misc_feature (98)..(98): n is a, c, g, or t
cccaatgcccccnattgaaaaatgncaatttgccccctgaaatttaaaggggtnaaaactaaatgtgttcccaaaacaatttgaaaagtttaaaaaanattttgtccctttatttcctctgttaaatggcttttgaaaactatgctatccctttgcttttaacttaaaaacactttcttttgaaaacttttatggctgggtgcaagtggctcaggcctgtaattccagcactttgggaggctgaggtgggaggatcacttgaggcaaggagtttgagatcagcctgggcaacatagtaagaccctgtctgatccagcaccagccccccgcccccagcccccccaaaattagccaggtggtgtggtgcccacctgtagtcccagctactcgtgaggctgaggcaggtgggtcccctgagcccaggaagttaaggctgcagtgagttgtgatcatgcttgggtgaaagaacaagaccccccctca

SEQ ID NO: 480432 - DNA, 81 bp, Homo sapiens
gccgaggacacggccatatattactgtgcgacagacccaaacggtgactacgtaggggcttttggctactggggccaggga

SEQ ID NO: 480433 - DNA, 213 bp, Homo sapiens
tattaccagtgtatcttgaatagtagaagatccgttgagtacataatatctgttgacccagtgatggagtgcagtgaagtgatcacggctcactgcagccacaagcttccagcttatgtgatcctcccagctcagggctccccaccctgagtagctgggactataggcatgtgccaccacaccaccatgctaggctaatggtctgtatttgtt

SEQ ID NO: 480434 - DNA, 158 bp, Homo sapiens
agcccccagcccgccaaacccccccccagccctacacagcagtttggcctgaaaggtccctggggatttatttgtggagcctggtgctccagaatgtggcttttcataaagctttggccaaaggaggggaactttttgggggagggggggtggagggg

SEQ ID NO: 480435 - DNA, 733 bp, Homo sapiens
ctggtgtcatgttgacaaaatatataatggtttacatgctgtcattgtccatgcctacagataattctattttgtatttttgaataaaacaagcatttgtacattcctgatactggcgtacaagagccatgtaccaggtgtactgcttacaacttaatatcactgaggcattttgtactactattctgttaaatatacagcgatttctatgtgcttgccaccaccagatgagaagttaagcagccttatactgtggagagtgagaataattgtgtacaaatgtagagaagtactccaatttactgtgacaatcctttgtgtaagtaaacaatttgtttaaagttaataattgtgttagcatttccatgattacgaagatactgacagattgaacagccagttgaagggcaggctggcatgtgctgtcaaaacattatcctatctatgactatctttcatgtttctctttgttgcacgactgaacgtactattattccgattgcataatggggaaagacagtttctattttccccggtgcaaggatgtaatctctcttggagctgtagaatctgggaggattggagggaactccagtgtacctcagcatgggcttttgggctgctgctgcaagcacaggcattgaggcaaactatttatagctgtccttaccttggcacagaagtagaggggagaaatacagtccatcattcacgaagcaagccaacaagaagg

SEQ ID NO: 480436 - DNA, 188 bp, Homo sapiens
ctccatgcctgtgtgcaacaacgagtgaacactctgtctcaaacaagaaatgaaatgaaatgaacagaatagctctagcagtctatgcttgtaatgctaacactgcccagtgcactggctgtgcctcacaaccatgctacatccctagccgccttctgtggcagtgcttgatgtgcatgctagtgctg

SEQ ID NO: 480437 - DNA, 529 bp, Homo sapiens
  misc_feature (180)..(180): n is a, c, g, or t
  misc_feature (221)..(221): n is a, c, g, or t
gttaatcccagctactcgggaggctgaggcaggagaaccgcttgaacctggaggcagagattatggtgagccgagatcgtaccactgcactccaacctgggcaccaagagcgagaccctatctcaaaaacaaaaaaaaagtttcccacaaagaaaactgcaagtcaatgtttttaccagntaatgataaaaactgttgacaaactagatagagaaaggaanttctttaatgtgaagagtaccaacgacaacaacaaaattctaaagcagacatcatacttaatggtgaaatattcaacacaaaaaacggacaacccagggtaaaaatgggtaaaagactcaggcacttcacaaaacaagacacccaaacagccaatcaacatgcaaagttgctcaacctcattgataatctggaaaatgtagatttaaatctcaaagaggccgggtgcggtggctcacgcctataattctagcagtttgggaggccaaagcaggaagatcgcttgaggtcaggagttcaagaccagcct

SEQ ID NO: 480438 - DNA, 1322 bp, Homo sapiens
gcaaggacccgccaatatgggccgcgttcgcaccaaaaaccgtgaagaaggcggcccggagctcatcatagcataagtactacacgcgcctggggcaatgagcgtgtccagacgaagcaagcgcgtgtgcgaggagatcgccattatccccatgctggatagtctccgtcagacaaggatagcaggttatgtcacgcatctgtatgaagcgaattcagaccaggcccagtaaagcagcgtattctccatcacagctgctaggaggcaggagcatggagaacaggcgagatgaattgatgctacctgagtgtctcagacctctgcgaatccggcagacttattggctaggtcaagatcgcttgtaccagcatatgggcaccactagctgaaaggcgcctggggggacgttcctggacaggttcgtgtcccataggcgtacagggatgcatcgtgcagtcctttacaagctctggaggattgcatcttctccacatataccgaccgtcgagtggcaccctcgttcctgacattttatcaactctgggttagggtgctagtacttgattcccaacaaattatagagtactgggggaaccaagcgaaaacacaaagcaaaaagatcccaaacatataaagaccaaatcgtaacaagaacattaacacacacaaccgataaagaagaccgaaaatataaagaaggggaagaacaagcataccgggcgaaagactgcgcgacacagcgcaaaaaatagaacaatcacggaaccccatgacagggaacagatagaacccaaatctccagccccaaaggtcccgaagagagccacccaaagacagaagaaaacggactacacatggatcccccggcaccaagaggcccagcacaatcacaccggaaaacaccccagaagagcccacataagaaattcaaagctcgaaccaaagcaaccgcggccgggaaaggaaacgaccggggagggccccagagaccaagcaagaagacggcaccggcgcaggccaccaaacaaaaataacacggccccgtgtgtgagacaccagacaacacagaaaatacgaacagggccggacacgggcacacagaacgcggcaccccgaaaacaaccgggaccaccgcagtaacacacacaccgagacagagacacaacaaagacaaaatgaaacacaacggaccgacggaagacacaccaacgagcgcacgcaaaggacacagagagcacacaagaccgagaacaacaagacgagcaacaacacagcacagaacaacaggaaacagcaaagcagaacaacagaacacacacaac

SEQ ID NO: 480439 - DNA, 415 bp, Homo sapiens
gacacttgaaagcgtaagatcattttagtcgggattagaatagcggacacatttttagcatgggactggaccggcgttagacaggttctccaagatgtatgattttaagtccttactccataaatcttcattaaacacatctcagttttggcctgactcactggggtgtcaagcagctactcaccctgcctcaactacgtaagctgcaccttggcaggaaagggctcacaggttacagatagagcttgatgagctcatcgctgactgctgagggtgtcagcacgcccaggtctgtaaacagcagagtgattaaggaaggggcagtgtagtcgacccacggatgctcctctttgaggtcttgtccagtctgcgcgaccttgagagtgtctgccttatacttaaacttatctgggac

SEQ ID NO: 480440 - DNA, 2422 bp, Homo sapiens
acattaaagctatttaattaattattattattattattttgagacagggtcttgctctgttgcccagactggactgcagtggcgtgatcatggctcactgcagcctcgacctccagggctcaagcgatcctcccacctcagcttcccaagtagcggggactgcaggcacatgccaccacacccagctatttttttttattgtttgttgagacagggtctcactatgttgcccaggctggtcttgaacttctgggctcaagcggtccacttgcctcggcctcccagagtgctaggattacaggcaggaggcactgcacctggccagaaaaaactattcttgacttcacattttccgccagcttcacccctgcccctttgcttctctttgcagcaaaacttcaaaaagcatagtccacgctctcccccaggcattcttgggtctctctacccaggattttgctcccccatcgccacatctccttttgccaagggcaccagaggcctccgtgttgttggatccagcggtcggctctcagcctcctcttaactgctcagtggcactggtgccgccaagcaacccttcctccaagagagccacaggctctgggatacttcactctggggttcctcctacctcacagactctcctggctggtcctcctcttctccccaacatcttatggccaggtctccaggctcttttctgtctacaggcactctccatgagtccttattcagtctcctggcctcaaatgccagctgtgctgagacccccttatttgtagctccagcctagcctgctctcccctgaaccccagactcatgtttccagctacctctgccgatatctaatagacacctcaaactcaacctgccccggctgcactcccgatcggcccccacctcctacagtcatcctgcttcagagactatagctccgttttcaagggctcaggccacacccttggaaccacccttgcatcctctctttccctcaaaccaccgcatctctcacctggattatcgtaacagcttcctgtgtcccagctgcagtcccccgcccattacattttgttcctaacacagcagccagagtgagccttttgaaagggaagattatggggctctttggctcacatagtgcagtgtctccccatctgaccactaaggcctggctgtgaccatatcacccctgcgacctcaactcccctcacctccactccagacacacctgctgttctatggtgctgcctgcagttcaacaccaaagaatattcttcgctccaggaagaaaaacggttttctccacctccaatcacaatgtgttcttttggcctatcttttgctccccacccacccttttttttgagacggagtcttgctctgtcgcccaggctggaatgcagtggcacgatcttggctcactgcaacctccacctccacctcccgggttcaagcgattcccctgcctcagcctcctgagtagctgggactataaatgcgtgccaccacgcccagctcattttttgtattttagtagagatggggtttcaccatgttagccaggatagtttcgatctcttgacctcgtgatccacccgccttggcctcccaaagtgctgggattacagctgtgagccaccgcgcccggccttattttccccttttaggaaacactgggaactattttcttctcagagaaaaacaggacttgcccaatagtaacatggaaacttaacagggtcttaacctgtgaagactcaaggagcagaacccggagtaagggggagcaggggccggagtaaggggagcagggccccgtctaagatggggcagggcctgggctaagggagagcagggccgggctaaggggaggcagggcccagtctgaggtgggggcagggcctggtctaaggggagcagagcctgggctaaagggcagctgagcccagtctgaaggagagccgagctatctgaataggggctagcacctgttctaaaggaagtggctgctcccctgctttcgctgtgagagggaacacaggccttttaagaaaatgggaatcaagttttttgtttaatttcccaaaggttatatgttgacaattaacttcaaagtattagctgctttttgtaggccaaataaacacgtctgtgggccagatctggcccaggactagagttgccagtggcaacttctggcccaggctgaatggtgggcaggaaggaaatggagcccccaggagtgggagtgggagctgatgcctgggtacgggagctctgtgggtgggagtgagacaaaaaacagggtcttgagctctggggagcaagcagtgtcctccagtgaaggaaatcctggactcgcaggcagaagttttgcctcttactcgccatgtgctctgaataaagttacctgccctcc

SEQ ID NO: 480441 - DNA, 1142 bp, Homo sapiens
  misc_feature (81)..(81): n is a, c, g, or t
tgggatgcgtgctggtgagtgttctgctgctgcttctcagtggttcgtgtctgtgagtgcctggtgatgtgcctggatgcntgctgtggctgtagtgtgacctgtgctggctctctgaatgctgcactgctgggctgtggctgtgcagtgatggtgcctctcctgcttgctgtgcccctagttgttgggtgtcccccgtgtgtgctgctcctggccatctgccctgcacccatgctgctgtctggtgccccctgctgcctggtgactacttgctgttgcttggtgctgctgtgtgccctgctgtgtgcctgcatgattggccttacttccgtgcatgctgctggcttggagctgctgagcttactgcatgttgtttctgaatgctgtgtgctccgctggctgtgcgcctgtgcatgcgttccttcatcactgcttaccctgctggcacctgcaagctcatcatgcatcaaacaatgctggtacactgggcaaggctaactgcctgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaacgggccaggtgcatcagtgcagcgtcctctttgtagccactggtttatcagtccccaaccaggttgacttccctggctccgaatctgcggagggttacgagtccggtccgtgggacctaggcctttgttggccccactgttgctgtcctgggtcgtgggaactctggctttggacacgcgcgacactctgggttgccaggctttttcccgattgtccgccggcccgggtctgttgtctctgtggcccccactcgttggagccttaagcctctcactggcgtggggacttccggtacgtcctgggggtgtcagcattcgcggggctccctctgagcggagctgtctccaccttttgtgttgccgcgtgtgtgccccgggagaggttcgtgtacgtcggggggcaac

SEQ ID NO: 480442 - DNA, 812 bp, Homo sapiens
tgtgggaaaaaaaccccatcatttataaaaaaaatggcccccccccccctcccccccaaacaaccccctcgagaaaacagggggcccaaggggtgtgggagtgggttcgttgtgtacgcccacggcatgagtggggggcgccgcctattggtggtcggggtgggaggctgctttgccccgccgtttgtgcacggcgacgtcgtgtagagcaaaaacgatattgggtgtggcaacaagggctcttctctctcttcctgcgcccgtacccgcctggtggtgtcactccccctcacagggagagaaagcagaggtggtcgccccaagcggcccaccacacaaaagaaaacaggagagagtggagcctgcgggaggtggggagaaaaaaagtggcgagaacgaacaaaggaagccacgaggcgacgccaatcacaccatggaggcccctcaagagacacgccacaacggcaaaactcccaagcggggagccaggaggaggttggcacacaacacgcccagagagagaaaggacgagcagcaggcaagtacaaaccacaccacgggactatgccacctactattgggaccgcttttcttcaaaagacaaccacaaggagaccaaatgagagagggcattaacccgtatactccacgaaaccagatatgagcgagaccccagccagaaataaaaccgccatatgatgcgaaaaaactaaacaacaacagaagacaaagagggtaacataccaccggaaaaagaaacaaccaaccaaaagaggacacagaaacgagagcacccacatccccaccacgag

SEQ ID NO: 480443 - DNA, 656 bp, Homo sapiens
ctcgtgccgaattcggcacgagcgagattgcaccactgcactccagccggggcaacagagcgagactccgtctcaaaataaaataaaataaaataaaattggagtagagtagagtagagtagagtagagtagagtagaataaaataaaatataatatcgtgataggatgggaccgttgatcaccatgtcagggacatgataagcctactatagaaaccaaatcgtcattgcacagatctttatgatctgtacatatggactagactatttaattaattaatttagagacggaatctagttttgctgtgcaggctggcctgcaatgctgtgatcttagcttactgcaatgtacacttcacatgttaaagtgatgctagtgccgcggcctgtcatgtaactgggatgacatgccagtgccatgctgctaggctaagctaaatattataagtatagatgagatggtaccatgccgggcaggctaggctcgaagctatgacctgacgtgatgcgatcctcttggcttgccatagcgaagggattacaagtctgatcgcatgcactgaacccatattatatcccggtctgacataacatatataccctaccttcatacactttactgttcaaggtaggggacgtgaccgttcctacggggg

SEQ ID NO: 480444 - DNA, 524 bp, Homo sapiens
ctctgggtgtgtctgtgacgctgtttaccagagtgatcagcacctgaattgacagacagtacggaagatgtgcccttaccgctgtgggcaggcatcctatctgctgagggtctgaacagaacaaaaaggcagggaagggtgaatgtgttctctgtgtttgagctgggacacccatcttctcctgtgcttgagcatcagagctccaggttgtggggccttgagacttggatagaatctcatcaccagctttccggggtctccagcttacagatggcaaatggtcaaacttcttggtttctataattacacaaggccatccctataaaaaaaaatctctccccaccatacacacacacacacacacacacacacacacacacacacacaaaagacacacacataaatatctcctagagctgtgtatctctggagaagcctgacaaatcgagatcgcggcatatatatcccaagagggctacagagtagggagggtcaacatccgactcatttcaagaaaatctgat

SEQ ID NO: 480445 - DNA, 477 bp, Homo sapiens
  misc_feature (115)..(115): n is a, c, g, or t
  misc_feature (351)..(351): n is a, c, g, or t
  misc_feature (354)..(354): n is a, c, g, or t
ccaggtgtcgtccccgggcgggggcatgggcatggtcacagtggtcctgttgatgtccccgatgatgctgagcgcctccttcagcgcgtggtgcatgtgcagcatcttgttgtgntgctgtgcctgctttgccaactcctccatcagtgtgttttggttcccacatgagtacatattggccagcggctccgaaatgatgaactccggggtttgagagtgggcaaacagggaaaaaggttgggacctggtgcctgtccccccctggctgccttgttgggcccttttgggactgtgcgctggacttggagccccttggagtatggcttttcacacggggttttataccggttngantggaagatccccctcccccctgccttttttcactcaaatggggaccccgaggtccaaaggaaaaaacccctgtcaaatgtcccagatttgggaggggacttaaaacttttcatgcccaaagga

SEQ ID NO: 480446 - DNA, 356 bp, Homo sapiens
tacacggtcccctgcgattgtaatgttatattctgatcatcattttttttgttctcttgtttctgcgatattagattccacttcgttgagattgtacccgtctgtgttgtttagtttgatgtctcctctctacctctctcaggagttttcatagttcttttaccttcataatcttctagactgatattatgtatatgtaagttaactgtttgaagatctgaaccattaatccctaattctctcttactcacatttttatagactattcatctcctaatatcttttcagtacaatattatatcttatctttgagcatttaggtgattgaactagtatgcttgctctcaaatggtttg

SEQ ID NO: 480447 - DNA, 160 bp, Homo sapiens
aggagagggaagatcgtgtggaaatgtcagaggtaggagtcagtgtggtggtcttaggggatgtggctgttgaacgtggtgaatgtagtcgtgacctgtggctgtatgttgctagaggtggcatgaaggtgtttccatcgtttgtaaatgttgtgaatga

SEQ ID NO: 480448 - DNA, 417 bp, Homo sapiens
  misc_feature (34)..(34): n is a, c, g, or t
  misc_feature (109)..(109): n is a, c, g, or t
  misc_feature (118)..(119): n is a, c, g, or t
gctcgacacctgtgaagatcgccattatcggcancggcattgccggactgaccagtgcctacctgctcagccgccgtcacgacatcaccctgttcgaagcgggcgaccnatcggcggnnacacccatacggtgaatgtcacggtggatggtagaagctacgcagtggacaccggttttatcgtgttcaacaactggacgtaccctaacttcattaagttgctggggcagatcggtgtgacgttcaaacccaccgaaatgagtttttcggtgtgcgacccgaacgccgggtttgagtacaacggcaacaacctcaacagcctgttcgcccgcgccgcaatattctgtcaccggggttctggggcatgttgcgcgacatcctgcgcttcaaccgccaggcaccgctggacttgcaagag

SEQ ID NO: 480449 - DNA, 1012 bp, Homo sapiens
aacgaaggaccggtgacatactagttacacgctcaacagtcacttggacatgcgatagcagtgacgattcacttcaatagtgataatatgacaagcaacatctcagagaaatgtcaagagaactcatactagtcaaacgacagaggtgtctccaagtgcattcacgtcaggttactctcttagcatggtcagaggaataagctgcatacatcatactccagaaagaacactgggcaagtggcagggaatgcaagatgtgcactctgcccgtttctcactcaaggaagacgaccacgggtggcgagttcagtcccaaagcaggtacttagatctacttccacacacattgcgcaggggtcctgggaaccgagaaaatgaatagcaggaataatccaaggttagacagtgcaaacgcatgaaccagcataaagggttcgcaccacgtccaatgaccttaaatctacccaaaacgaactgcgctaacacgtgtacaggcaaacaaggcactatataaggaattctctattaacaacactcttttgtccacgaacagtatcaccagcgaaaaaagtatctaaatttacggccaagtaaaagctaaaactctaaacttaaaaccagcatattacgacattggccatcggacaccctttgaccattacaccaaatcagagaacaacaccatgtggctacatataatcagggctcgatacaactctgtggtcacctttctttcacgggcaccttgggcgaaaatattgggggcttcaccaccgttggggcccacttgggctcctgggtaacccaagctcgttccattcaacaggcactataacccacattaacgtgtgggtcagacaacacatctcattccgttacaatgcctctcagtcattgataatgacacttcggtatcacgcgaaaggacaggccaacatgggccataaaaaacatcaggcgcacaacttagggcttaacacttcccgggggaaacattggccccatgggcaaa

SEQ ID NO: 480450 - DNA, 225 bp, Homo sapiens
gtatagtgagaaccgtttgcaaagttaaataaaaaaaatagcaggtagagtatacctatagtctagctacttggaaggctaaggaagaagctcacttgagcttaagggcttcaaggttgcagagagctatgaccatgccattgcactccaacctgggtgacagagcaagacctcatctccaaataactaaagtacttaaacattaaaattaaacctaccccaaat

SEQ ID NO: 480451 - DNA, 831 bp, Homo sapiens
ggactagtctcgagtaatgatgattagtaattcctcagagaataattaataatagaattaccatactttgggcgcaaaggtgtccaacaccaaggtgacaagtacttatatcagaatcactcttacctcagaaaaatcacaccttccctgggctctgcctggggatccaaatcaagccggggtgtgtctgacaatcaccagggcacggttggcttcccggccctccatctctactgttgggctacagcttgagttcactaggacatcggctcccctctcaggccagccagcaagttgtaagctgccaacaaggacatggtgtatgcgggtctctgtgggtaggcactgccaatgtggggcagaatcacacagttctatcagggtacaggagagggtggttggtaggcaggggttctggggctacgtcacatccagtaccagaagctgcaatcttaccatcgggccaggcctggtacaggtcgtaccgggttaacgacgtcagcccctgctgatgttgataaacacagttggtttccttcatcttcgggaagaagtccttgtggcaaagtccctcggttgagggtgtaaaggagcaggccacgacgggatgacatccagattggggaggccagctacggggtaaacacacaatcatagcctgagaatccgaggagatcccaaaggcctgggagggcgctgggtaagaattctcgggacccagaaggacaaacgcaaaaagggcgagcatgacccagcagaagccaaaggacgggaagccagccagcggggcccaggtcgcattactcaccagacgaccacaagagacagaga

SEQ ID NO: 480452 - DNA, 530 bp, Homo sapiens
tatgtttataaatgatacagatctgtttaaaggttgtagatacttttttgttcctgttcatagatgggaagcttccttataagctgatgcagagaaaaattagtccttcaaatactgctgtattttcaggaaaaaaaaaaaagggggtgttgctatggaaacggtactagattttggcctacaatttacctggtcaaatatggtagataaatggctaatactaatagccaaatagataacacctaaggcttggtttaaaaaaacgaaaaagaacaaaacaaaacaaaaaaacatgagcaggggtggtctaatgaagttatgacatcggtcctaataagtttcttaaatacatttactacttaaatgggtttggaagcaacggtttacttttaaaattttggaaaactggctaataacctttgggtggcagaattagtagattggttaatggcgggacatcaactacatatgtgaaagatgttgaaatgctttgttatttcaggcaatcaaattaaatcagactatcagac

SEQ ID NO: 480453 - DNA, 106 bp, Homo sapiens
atgacatcattagtcagacttcacatcttaactagctgctaatatttgctgcctatctacatgatgtttgcgcactaaatctcatgttccagaatagaaggtttta

SEQ ID NO: 480454 - DNA, 151 bp, Homo sapiens
cacgaggtctatgattcactgtccaatcgccattgcactgtatcatgattacgctgtcatgacatatttctttgactcattaggccagacgttgacattttagatccactccacagggatcataagttgacgcttcatgtataacatgttt

SEQ ID NO: 480455 - DNA, 129 bp, Homo sapiens
agagctgttttgctccttagaaacttaagcctggaatgattcaaaaggctatgctctcagcgcatgagagctggcaaagcaaatgagaaccgtcgccgtatccagcgcagggccgtgcatcatctttat

SEQ ID NO: 480456 - DNA, 251 bp, Homo sapiens
agctttagattacacaagttatcctaacataccatatacttagtttagaatataagtacctaaaataaataaaccattctgggtcacccttactgaatattctactgaaaattccatcaactgcagtatgctgacttgcgactggattgcttcaattcaggtgctcattttttacatggctgttttgtgagcacaaaatagatgtcatatcacttccaggacatcctgactattggttcctcccagtctca

SEQ ID NO: 480457 - DNA, 260 bp, Homo sapiens
tgatacaacgcgtagggagcctcccatattgtacgactgcaggcggcgcgaatatcactagtgattccccaacaagactgttagagtaactaccacggacagtgcaaaacaggggcacgagggtatggatagccgatatccaccaattacctccaccggcaacaactctctatggcctgttgcccctcctataatatccgccacgacacccacgggctcctcctctgaaatttaccaccacgcatattgaatcctccacg

SEQ ID NO: 480458 - DNA, 263 bp, Homo sapiens
gttttttactttaacaaattttttttgcagaaaggaaaagggaatgataattagtttaaaaaaggggcccggccgtaaaagaagctaaaaaaactttatgcaattaaggggttacagaacatgttgaaacttttttttcttttattgggaaaaaggaaagtttgccccccccccttttattggttttggatgggaaatcaaggaattatttttggtgttaaaaaaagggcccaccttttaataaagggaaatggacatatgga

SEQ ID NO: 480459 - DNA, 241 bp, Homo sapiens
gatctacaggatctaagggtgatgatgtggtaaccaaggtatgatgctgagatacatgtagctttctttaatgagagggtagattattcaaagcaagcgaatagccaaaaataaggggggaaggcggggagttccatttctcggaggttcaaggcggccttcaagaagaaagaacatttaaatggccaagggtgaaacctcctggtctaagccctttatctcaggggaagggacttcttaa

SEQ ID NO: 480460 - DNA, 501 bp, Homo sapiens
acagaaacacttaaagaccacacatgatgccatttgcagtccagagaaatgtaaacaaatgtaaaggtatagtactgaatcataactacataaaattcactgttgtacatactgtactacttaatataataatttcatagccaattcttcttgctattgctgtgagctcaagtgttgcagatacacgcttaaaatgctatgtgatgctaatcatctccacataagcaatttgtctctctggtaagttggatgtagcagtaaaaagtgatcacttgtggttcttgtgtatttttcatcatgttaagtggaatactgtaaagtttgaataacaccatggcacccatatggagtgccactaatcatgccagaagtgctcccaagaagcagagagaagtcatgacattagaaaaaaaaagttcagttccttgatatgggtgtagattgaagtctgcaaatcagacgctcccgtttcaagataaaaggttctactttggatcttta

SEQ ID NO: 480461 - DNA, 943 bp, Homo sapiens
  misc_feature (1)..(1): n is a, c, g, or t
  misc_feature (3)..(3): n is a, c, g, or t
ngntcctcatgaagtaggaactgtagggagggggtcatcgggagaagacaggcagttctctttattgtgtaataagtgggtgctgggccgccttccgtgtcggtttgctgcgtttgccggccctgtagcttttgcccgcgtttggctgacaagtggcgccacacggctttgtccccaggggggatttcttattcccgaggccaaaacaatgttggtggcaagaaccatttgtttgggggagtcaaaaccacctgtgccgaaggcttgcgcacaccgcgtgtgtcccaggggaacgcctatttccgacggggaaaaatatgagggcacccccccccgcccccaggggccggaaagatcgggcaccacatcgggcccccccccagtgggagggtcccctggtgtgggagccccgcgaaggaggccacgtgggtggtaatgacgaagaacgaaccacaaaatggggcagagacgaacatgcgccaaaccagaatattgagcggcacttgcacggcccaaaaccaaatcccggggtcacccgctgccgcgctgaaaacatcgccctcagttagctctctgcgaccgacacagggcattgggtcccccaggtctcctgagaagtgctggagtgcagagaaaatgtctgcagccccacaagtgccccaaccacgcccgcgggcaacagatcacatcggacccccccctctttcgaaactcccgttttaaaaaatgagcccagcagggtgtgaactacccaccgcgcaggactggtctcaccaccgcgagcacggcgccacgcaaggagagggctgtccaccacacaagtgacgaggaaaggaggccttgcccgactaagcacggcaagttgacgccggctcaccagccccgccccccccccgggggccacccccagaagccctttcccacaaccccacccaacaaaaca

SEQ ID NO: 480462 - DNA, 130 bp, Homo sapiens
gggaggatgtagcctcacactatcgcaaaggtccagggacactgcaaactaacttcttcatctttgcaccaatgggggtgaggggggtctttcagtgaatatttttcataaactatactgtcgacaagta

SEQ ID NO: 480463 - DNA, 421 bp, Homo sapiens
tacgaatcgagctcgtgtacctgctagctctctctgatgccccgttgtcaccaacgtgactgtgaaggcaggagtgtggacaagcaccttcatcgagtattacagagactttgagcgagtccgggtaaatggttggggtaccctattcctccgaaccagcatccccaccatcaagatggagaacaagagcacgtggttctcatgtggacattgactacggagctgcgtggaggagctgccggccgaacatcgagctgtggatggtgctggtggccgtgggtgcagggttgctgctgctggggctgatcatcctcctgctgtggaagtgcggcttcttcaagcgagcccggattcgggcgctgtatgaagctaagaggcagaaggcggagatgcagagccaggcatcagagagagggtgagg

SEQ ID NO: 480464 - DNA, 1522 bp, Homo sapiens
gagatttaggtactcttatgaccagtcatctccgccagttccttccaactatctggatcatcgtggtatccacacacttctcatgatctgtgttctatagaactatgattgtttaagagttccactatggtattaggaggatgctagccattcagctcattctcatgtgggagtgcgctatcatttttcactttcagaccatcattggtcgctcattgtaccctatcatcatcagtttgtccacaaacatgcacgagcacagttctctctacctcttcaatcacacagtcatgcacatcaggtaatatccattgggtgtataatataaccataactgttagtccatttcgtgctaatatgaatggatatctcagagctatgatttccatgaatctatggaaataagttgataggaataagatgacgtgagaatatggacagcatgggaggagacaggcacgcgtaatctactacttggaccaatacctgactttttgacacactactatatattggcgtaacaaactaccactgagaaagctggcgaactttcctggtgaacttcattaagtggagtacgcgtacttctacttcttcaaccaatctgggtcgtgacggacacacttctgcaattcaacaatttgtttcccacttcacatctggggatattacttaaaatttttacttgatgcccctgaaatagttgataacaaacagtacataccaccacgattttgcattgcacattttcctggggacaaatcacattgatcaatatcaatccttgttccaatgctgtgaaatgaaataaagtaacccgctttctggacacaggggctgctgcggcacttgagatgtcctcccaattgcgcggccgttgctacaaatatgttatgagtctgtgcccctacattgaacttaacgagcaaggccttggcagcgcatttttcgacaacactacttactagtggtaggagccccatatatgtaatcgtgctctgttagggaaacaacatgggtatacaatctccagtgggatcctactgtggccacatccttctaaaatctgggctaacacaatacgtagaggcacaaatagacgaagcagtgtggcagacgaccccctcaagagaacaattccgtgcgcaagcgacacgggagtcggtcacagcgctcaacacactggggggaaacacaacaaaaaggaggacaaaacaacagcacgacgagaggggccgaaccaacagcagtggatcacaaacaacgaccggagcgagccgtagacaacacccgcaaacggagaacacaccgaccacaacaattctgtgggtgtaacccactgccacagacaacatcaagaacgagcagagcgcggatgaaagtaacagacacgacgcgagaccgaaacaaacgcagacgtctacacgaagccgtacaagcccacacgtacacatcagatagcacagtgcaccgacacactaaccagcgacgcaagaccgaacgtacccagcacaaggacagg

SEQ ID NO: 480465 - DNA, 633 bp, Homo sapiens
ctcccatacacaatagacttcaaagagaataaaatacctaggaatccaacttatgaagggatgtgaagcaactcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcctccccattaagggacccatgaatcttctctcacagagataggagaaaactctactaaagagtatcatatgagcacaccaaaggagggcttgcatcgccaagacaatcctaagccaaaagaacaaagctggaggcatcacactaccctgacttcaaactatactacaaggctacagtaaccaaaacagcatggtactggtaccaaaacagagatatagatcaatggaacagaacagagccctcagaaataacgccgcatacctacaactatctgatcttagacaaacctgagaaaaacaagcaaatggggaaaggaatccctatttaataaatggtgctgggaaaactggctagccatatgtaggaagctgaaactggatcccttccttacaccttatacaaaaatcaattcaagatg

SEQ ID NO: 480466 - DNA, 253 bp, Homo sapiens
gagatgcggacacctggaccgccgcgccgaggctcccggcgctcgctgctcccgcggcccgcgccatgccctcctacactgtttaccgtggccagtggcagccagtggttcgccggcactgacgactacatctacctcagcctcgtgggctcggcgggctgcagcgagaagcacctgctggacaagcccttctacaacgacttcgagcgtggcgcggtggattcatacgacgcgactgtggacgaggaactgc

SEQ ID NO: 480467 - DNA, 330 bp, Homo sapiens
  misc_feature (49)..(49): n is a, c, g, or t
  misc_feature (300)..(300): n is a, c, g, or t
  misc_feature (307)..(307): n is a, c, g, or t
gtttaaaaaattttaaaaaataccttatagagtggggtcttagtatgtngcccaggctggttttgaactcctgggcccaagcagtccgaaacctctgcctcctgggttcaagcgattctcctgcctcaacttcctgagtagctgggattacaggcatgtgccaccacatccagctaattttgtatttttagtagagagagggtttttccatgttggtaaggctggtctcgaactcccgacctcaggtgattcacccgactcggcctcccaaagtgctgggaatacaggcatgagccactncgcccgnccttttcttataatatagttttt

SEQ ID NO: 480468 - DNA, 650 bp, Homo sapiens
ggtgcatttgcaccgacggctgggacggggagctctgtgatagagatgttcgggcctgctcctcggccccctgtgccaacaacgggacctgcatgagtccaatagcgaaggaactctataaatgctcctgatgcccccgggtactcgaggaaagtgacatagccagataaaagagacggagcccgagctgtgatcaacagcgagtcgcccctgccaggccagggaagagcaccatgcagtcggcatgactgacgggcaacaggcaagatcacgagagcacaaccaagagacccgaagagacaccaaatcagcaccactagaaggaaatctgactaacggcaacgacaaccaaccaacgccgccatacaaccattaacacaacaccacacaaaacagtcgcaaatatcacacagactaaacaaaaaaagacagatcaatgcacacattgagccaaaccagtcacgcaacgcaacactagacctcatagacacaccaaagaaccacaaaaccaagtgaacatcacacaataaaaaagaaacaagcacctaactcaaaaaaaaataaggatgacataaagggactgaggacgaaggacatcaggacgcggagacgcagagcaagagacagccccacacaagtacaggaggaag

SEQ ID NO: 480469 - DNA, 129 bp, Homo sapiens
tttggctggccggactctctcctgctgtttccccaaagtggaatggaaggctttcaaaccagagtgtctcactacccctctgagctccagaacagatggggcatgagcaagcgagatcagccatggctc

SEQ ID NO: 480470 - DNA, 378 bp, Homo sapiens
cctttttttcccctttcaaggggggaaggactcccccccccctgtgttttaaaaaggcggggccctttgcggggccctttttttccccacgcgtttggaacgggggctcccccaagttcttgttctcagggttctttgcacttcccccttaaccccttgtcgttgggccacattttaagatccccatctctttggggggtggggcctctttttaaggcgttcccggacaggggtggggtggcccaaaaccactttacaagcagccatcccctggctgtttgtggggggggttggacaagagcttctccctttccacaagggagaaagagagagagagagtgagagtttcaataaagtttgtacactttcaaaaaaaaa

SEQ ID NO: 480471 - DNA, 151 bp, Homo sapiens
gggagtgcggtcataaaataaacggtcgtaataattatctgaacagccggggcataagcggcttattttcaggtcattattacgaccgtttttctttttccaccgcggctgaggttgcatttttttacaactgtgtccgccgctttcggaa

SEQ ID NO: 480472 - DNA, 687 bp, Homo sapiens
gggggaaaaaaaacaacgcaagtagagtttacaaaacactactaatttttaaaataaaaaagataaaaacaccttaaagagcacgccctaataaataataatccttatctgctatctagccctgtatgcccttttcctaacagtcacaacacaactaactaatactaacatttcagacgctcaggatatagaaactcgtctgaactatactgcccgacattatcctagccctcatcgccctgccatccctacgcatcctttacattacatacgaggtcaaccatccctcccttaccatcaaatcaattgcccaccaatggtactgaacctacgagtacgccgactacagtggactaatctttaactcctacatacttcctccattattcctagaaccaggcgacctgtgacttcttgacttgacaatttagcgtactccccgatgaagcccccattctataaaattacattacaagacgtctgcacttatgagctgtcccacattacgcttacaccagatgcatttcccgactttaactcaaccacttttaccgtcaccgatggggtttactaccggcatgctttgacactttgggctaaccactgcttattccccacggccttcatcccctagtcttttcctttggaccctttttacctagtgctcttatcttacctctgtgggcc

SEQ ID NO: 480473 - DNA, 509 bp, Homo sapiens
  misc_feature (274)..(274): n is a, c, g, or t
  misc_feature (405)..(405): n is a, c, g, or t
gggagtttccaagctcttgctccccctaacgtctcaacaggcgctcactgaagtgtatgaatattttttaaaaaggtttttgcagtacagctagtcgttcccgctctgctattctcagaaaggcttacgtgatgccctagggccccaaatgcacggtgccgtggcatagcatttcctacttccacaatgctgccgctatttctagggcaccttgagagcatcagtggcgtgaaattccaaactagatgtggcgcagggcgagtgttgcttaccntgccctgctggggccagggttccctgaaaactgggttaattctttatagaaatgtgaccactgaatttatttaacaaaataataataaaaatttaaaacatttacaaataaaaaaaagcacagaaaacaantttacatgtatataggtcttgaagtgagtgaagtggctgctttttttattatagaaagggggctatagggggctttgggtaaaagagttggggatgggtactct

SEQ ID NO: 480474 - DNA, 789 bp, Homo sapiens
  misc_feature (18)..(18): n is a, c, g, or t
  misc_feature (90)..(90): n is a, c, g, or t
  misc_feature (107)..(107): n is a, c, g, or t
  misc_feature (109)..(109): n is a, c, g, or t
  misc_feature (112)..(113): n is a, c, g, or t
  misc_feature (137)..(137): n is a, c, g, or t
  misc_feature (165)..(165): n is a, c, g, or t
  misc_feature (170)..(170): n is a, c, g, or t
  misc_feature (172)..(173): n is a, c, g, or t
  misc_feature (192)..(192): n is a, c, g, or t
  misc_feature (375)..(375): n is a, c, g, or t
  misc_feature (394)..(394): n is a, c, g, or t
  misc_feature (399)..(399): n is a, c, g, or t
  misc_feature (562)..(562): n is a, c, g, or t
  misc_feature (608)..(608): n is a, c, g, or t
  misc_feature (625)..(625): n is a, c, g, or t
  misc_feature (744)..(744): n is a, c, g, or t
ttgaaaattgaataattngcccccctgggctgggatgggccagctggctccccccgttgccccctccgcctctcgggggcctcggggttntggcgtccatcttatgntnttnnccaaaggggggcggtcttgggggngctgcttactgttgaccttccttttggnatgtncnngggggggcggggggggggntctttaggcgggctgccatccgggggctgctattctgttcactgggattcagctgtgaacatctgttctttcttcctcttctgtctactgcatgcgggcccgggggctgagcgttagtcaagggtacggggggggaaaaggggggggggcaaggcccatcccccaggggggggggggctctgntgcggggggggcgggggcnggggnggggacggccactgcctctctcaccctctgttccatccctctgctcaagaaaaccaggcttagcagagtgggacagccgctttttattggtctggctggcgtgcctagtgggaagctcaggcagagcttcctatcttgccctggctcccatcttccctctccngggggttcatcacacatcccgggaggggagagtgtcctgggcagangtggcaggcaaagcggngtaaaaactccagggctgggaagcaaatggggctcagggtgatgcagaaaatgtgatgttgccaggccatccaaataaagcatccatcggggcagaggagaagctgtttccctgcaganactcctctgcccccaccaggaatgggaggggcaggaggaagagct

SEQ ID NO: 480475 - DNA, 930 bp, Homo sapiens
gatctggtcgaattcgggtttgtatctaaaaaactaaagtgtcgctgaaagaactacctagtaagagaggcccacatcatgggaccgcgctaagtaatcattactgaacgtatttgtatgtgatttgtggacatctgctagatttcgtagcgacgttcctacactagcttagtggcgtcactcatgcactctcataacattgcgcggtgagtaactcagatcgaattgaggaacgcaatgttaaacaacgtagagaggaaaggatgagcctgcgtggagaaatgaggaaaaaggaggcttgctttcaaagatagtggccttgcggatcatctggggattaaatctcgtacatagatgagccgtgaaacagatggtatcactctattgatgatattccttgtaggcacaattagagactcagagaaagttaactatgttagactatacatttggagtggcccgcgcaaagggaagaaccaagaaaaaacattgagatatcaaagaacacgcagtagaatataacaagagaagaagaatcgatacagggactgactttggagactaggttccgtgaattagaattggcatagtctaaggagagatataggttagaaattttcgagaaggcttgggtactctttcgcaagaaattggagcaaggaaggcgcggaaagaagaccaattgagcacattttcagttgggcatataatcgacatgaagtatggggagatagagtgaaaaaaacaagagatataatattaggaatgtgggagtgattaaaatccagagtagagtggggcattttccacagaatgtaggctacaagacagcttataaaggcgtgtagaagaggaaaggatacgttgaagggggaaacattggtacgaagggacaaggtcaagggactagtagaattaaacgaaaagatt

SEQ ID NO: 480476 - DNA, 360 bp, Homo sapiens
  misc_feature (81)..(81): n is a, c, g, or t
cacgccgcaccgccggttcaaatcttaagatgaagatgatacttttggtcaaattgtttacagtttggagccactataacnaaatcccaagttatagatccaaaaacactttaaaattgcacagacacaagcctctcaatgttttgaagaggaaatagagctcagagagaaacaacctttctgaggtcagacaaaatcagggtcactcttcaaagaggcaaatacctgatctcaaacctgcattagtttaattatctctttttattcagctccttttgaatgatcttgatttgttttgaccttggcacagtggtttgatttggttaaatcaaggtttctttgaaccggcggtgcggcgtg

SEQ ID NO: 480477 - DNA, 173 bp, Homo sapiens
cggcgtcggtcattcagcagtggggcctcctggagcatcttattcccatgtgcagcatgtagatatgttaccatgagagaatatttaggtggcatggtttactttctggtagacccattgtagccttatggagaacaggtttcctattagacttcacacctagggtgggcccg

SEQ ID NO: 480478 - DNA, 435 bp, Homo sapiens
  misc_feature (293)..(293): n is a, c, g, or t
  misc_feature (311)..(311): n is a, c, g, or t
  misc_feature (313)..(313): n is a, c, g, or t
  misc_feature (384)..(384): n is a, c, g, or t
  misc_feature (429)..(429): n is a, c, g, or t
  misc_feature (434)..(434): n is a, c, g, or t
ccggactcctggagtgtgggacttcctggtgtgtgggacctctgggtgtagggattgtattagttggctgtgatggtaaacttgatgtgtcaacttggcttggccacagtacacaggtatttgttgaaacaccagactaggtgtctctgtgaaggtgtttttttaagatgagactaacattaaaatcagtagactttgagtaatgcaaattatactccatgatgtggctgggcctcattcaatcacttgaaagtcttaaagaaaaaaaaaaagactgggatccccccatgaanaaaaaattctgcctcganantgcccttggattcgagctacattacctcttccctgggtctccagcctgacattctgctctgcacaatttanacttgccagcccccacagcctctctctctctctctccctcaacanaccang

SEQ ID NO: 480479 - DNA, 501 bp, Homo sapiens
aatcgggaggtgtcttgagattatcatccgtgatgatggatagagcacacactcggaaggtgtcttgaggctcagggagttatcaattatagaatgtggttgagtaggaggaggtggctggtggcccatcctgtttttaaagtttcagctgtgaggtagggccagtagggcaatcctgaagaatgacgatgctccactgccgccattctgacccggttgcaaaagaggcttccttgcagaagggggtgattttgcatcggtagtagtcctcgtgcccgcggcgggaacgcttgcgcacgttgaaacatttccatgtaggtgtgtatttctttcatatccaatttcccattttcctctgcctctgacacctgcctctcctttgctccgtgctcgcgtcctttcatgcttagtttcctcagatgttcttgggcggtcttcctctttccattgatttggtcatgacggttgacttttgttgtcaccttcatcttacggacttta

SEQ ID NO: 480480 - DNA, 561 bp, Homo sapiens
  misc_feature (147)..(147): n is a, c, g, or t
agaaaacatgagatagaagctgctatagtgcggataatgaaatctagaaagaagatgcagcccaatgttttagtagcggaggtaactcagcagttgaaggcgcgatttttaccaagtccagttgttattaagaaacgtattgaaggncttattgaaagagaatatttggcccgaacccctgaggttcgcaaagtatacacatatgtagcataaaaggcgttcagaaatttgatttattcttgggcggcacttttggcaggggcggggaagtttttttaaatcattaaaaattaaggcgcccattttttttattaaattccaggacatgttttagaccattgagatcaagcctttactccctttgagagtttccaacatcagttgattgagcttcaggctttacaacgtttatccctggaaaagatcttctttacagttcctcgggaaaatgtgaatgggcggggttttgtttttttttctgtatgaaaacaaaaataaaagagaaatttagaaaaaccggctcattccaataaaattgttggatttcatttccccgggtca

SEQ ID NO: 480481 - DNA, 300 bp, Homo sapiens
  misc_feature (53)..(53): n is a, c, g, or t
gggttgattctgggtctgcgtttacgcggccaacgaaactgtgatcaattttnatataatcaatatgcaggtcatgaagataagaaagccctgagtagccagtaccgaaatcatccagcgcgatgacaaaaccattttcatgcagaatgttcaaccgctgaaccagactttcatcaacattcaatggctcacgctcggtgacttccagaacaaggtttaaatcgcggcgggtaaaactgtcacgggaatttaaacactcgtcgacaaacgtcggcgaaataatatgcgaagcttaaaatt

SEQ ID NO: 480482 - DNA, 260 bp, Homo sapiens
gactgaaaaatgctgcgatgatccatggcaggagcagcgtgcatcactttcttagtgcttttgagatggggtttcgctctgtctcccatgctggagtgccgtggcttgatctcagctcgatgcagcctcgacctcccaggctgaagtgatcttcccctctcagcctcccgagtcgctcgaactacaggcgtgcaccagtacacgtctactttttgtagaaacaggttctcacaatgttgcctaggctggcatcctgcacg

SEQ ID NO: 480483 - DNA, 1239 bp, Homo sapiens
taattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccaggcccaccccatccccgagcccctggcaaccactaatctatttctctctctgtagatttgcttattctggtcatttcatataaatggaattctacaatattcggtctttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgaaaaaaaaaa

SEQ ID NO: 480484 - DNA, 109 bp, Homo sapiens
tgttctccattttggtttcaacaactgcctcggattctttgatttcctgaacctcaatgccagccttcttaactgatcgatgttccattttttcggtcgaggtgaactt

SEQ ID NO: 480485 - DNA, 109 bp, Homo sapiens
ttatattaaggacggtggcgggagacacgctgatactctatccatataaataaagctttgatgtaacacagacccccacgaccaccactcagtaaaaaaaaataattgc

SEQ ID NO: 480486 - DNA, 1364 bp, Homo sapiens
  misc_feature (1229)..(1229): n is a, c, g, or t
  misc_feature (1231)..(1231): n is a, c, g, or t
  misc_feature (1249)..(1250): n is a, c, g, or t
  misc_feature (1252)..(1252): n is a, c, g, or t
  misc_feature (1255)..(1255): n is a, c, g, or t
  misc_feature (1260)..(1260): n is a, c, g, or t
  misc_feature (1272)..(1272): n is a, c, g, or t
  misc_feature (1276)..(1276): n is a, c, g, or t
taattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccaggcccaccccatccccgagcccctggcaaccactaatctatttctctctctgtagatttgcttattctggtcatttcatataaatggaattctacaatattcggtctttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgactgcctgtcaataataatgattgttcgaaaaaaaaaaananaaaaaaaatttgggggcnngnccnaaaantttaaacatgtngggngggccaagtgtatgtaggtgcaggtccaaaaccgggggatcggtgggtttccaaaaaccggggggggtggaaacaggggggggtggga

SEQ ID NO: 480487 - DNA, 1118 bp, Homo sapiens
cgtacgcggacgcgtgggccacaactgtacacctgaattccatggccaatgagagttcggaaagtgaagaaagtatgaacagggattcatcacagaccctggtggtccgtcagaccccaatggatctgcgtgctgtgtgatgtttattgagtgccgaacggcccgtgacatggtttctgctgtgtatcccagatcacagagcacaggtcctgtgatgtgggagccagcttgtgtgggcatcatctcctccagggacatttgattttcatcaaagaggaggaacatgacttgttatcattgtgaagagataatgacaaagatgggaagacttgtgtgtgtagacccttgcatggcatcaaactgaaggatgtgcaaatgaaattctgcagcgcagcaatgaagggaaagttgccacattgtaaatgaagatgatgagctatgtggacatcatatgcccggacaagaccctgacgaagaatcgggactaaccactagcctccaaagatgccaaagaaaaagctgatgagtggggcagccatatgaccactcactgaggattgacaaggaataggctggacttgatcgccacaaggctggacgtggatgtaagagcgaccggaaactacccaacggaaactcaccaacttccagatcaaacatgaacacgaaacatcacacgacaaaaaccccaaatactcccaaagatcaatctgcgaggccaactgatagcacaaggaagcgccaaagacaaaacaacaacaatacaagcacagcaagcatactagccaatcaaaagaccattgaaaaatgactacacaatagcactcaacaaacaagcgcggagcatgaaggagaacacaaacaaccaccaggacacacctgccacagacaccgcgcacagcggaccccccaatgcagagacgacgcccaacgcgcggcagccaccggaagggagagaggaaccaaaagcagaacggcaaccacgagagacacccacggaaatcaaagagaaggaaacaacacagagacacagccccaggcgacaagacaagaaagacaccccccgacgcgccagaaagagaggaaggaaaagagcaaagcacacgcaccacccccgc

SEQ ID NO: 480488 - DNA, 208 bp, Homo sapiens
gtacaatttatcctgagtccaactgttcttgctgcgaacctaggaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaat

SEQ ID NO: 480489 - DNA, 1787 bp, Homo sapiens
taattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccaggcccaccccatccccgagcccctggcaaccactaatctatttctctctctgtagatttgcttattctggtcatttcatataaatggaattctacaatattcggtctttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgaaaaaaaaaaaaaaaaaaaaaaaaaaaaaaaaaaaaaacaaacagaaaaagaaaaaacaaaaaaggggggggggcgcggcgctaaaaaaaaatactccccccgaggggggcgcgcccaaatgttcccgggaactacacccaggttgtttttcgaagacagaaggcggcgccccccaactgagggggcggctgtaataaatacacacgaggagggagagagcggcggcggtttaaacacacagcggcggacgagggcggagaaaaaaagcgcggcccctcggcgggggcccacctcttggtggagaacagcgaacccccttatctcggcggggggggggggacaaatactgggggggcacaaactctccctcccggaaaagtattttaaaacgcgccctcatgggggggacaatactattaaaaacttctatcgaccagggtgcttattaaacctggtggtgaacaaaaccaagccgggttcaaattgtctgtcggcggcgtatagagaaatcttggtgcactcagcggcaatatctcctcttcgaaaaacaaattttc

SEQ ID NO: 480490 - DNA, 1293 bp, Homo sapiens
  misc_feature (1266)..(1266): n is a, c, g, or t
taattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccaggcccaccccatccccgagcccctggcaaccactaatctatttctctctctgtagatttgcttattctggtcatttcatataaatggaattctacaatattcggtctttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgaaaaaaaaaattcacttggccgccgtttacaacgtcntgactgggccctggcgtaccccacttt

SEQ ID NO: 480491 - DNA, 510 bp, Homo sapiens
gatcacgtgcattgtgccagcctagaaatacgtgttaaaaccactgagagaacttggcataaacgtctgttgcctttgccgtctctggccgtggaattagtccagctggtcaacacaggggcactggaacctacctctgggggagcttcttcaaatatggcttgcaggagattccggctcagcagatgtaggtggagcccccaaatttgcatttctaactattgcagggaccccactttgagaatcactggtcaacgtcaaccctctctataagcctcataagagatggcacagacttagtgcccaagacaacagcattcttcctgtctatcacatgggggataagaatgtggacatgtttggggccatattattctgtctcccacatgggattaggacgtggacatctttggggccattatcctgtatacctcatggggactaggacgtggacatctttggggacattatactgactaccacatggggataaggacggtggaaatctat

SEQ ID NO: 480492 - DNA, 100 bp, Homo sapiens
acctagagttactcatcaacctacacaccgccgttaccatgggagtgggctttaccagaagtagttagcctaaccgcaaggagggttagggtttcgatga

SEQ ID NO: 480493 - DNA, 1437 bp, Homo sapiens
taattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccaggcccaccccatccccgagcccctggcaaccactaatctatttctctctctgtagatttgcttattctggtcatttcatataaatggaattctacaatattcggtctttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgaaaaaaaaaagttttttgggcttttttttttgggacttttaatctcatttcttctgcttttctgtccccagaaaaatgtaagagctaattttatgactgtatttttctactgtgatgctgttttactgaattcaatggataatttaattgtacatgtaaaatcttactgcagttttatgtttttaatagtcaaaatagaatgtataat

SEQ ID NO: 480494 - DNA, 201 bp, Homo sapiens
  misc_feature (86)..(86): n is a, c, g, or t
  misc_feature (99)..(99): n is a, c, g, or t
  misc_feature (108)..(108): n is a, c, g, or t
  misc_feature (113)..(113): n is a, c, g, or t
  misc_feature (115)..(115): n is a, c, g, or t
  misc_feature (121)..(121): n is a, c, g, or t
  misc_feature (134)..(135): n is a, c, g, or t
  misc_feature (142)..(142): n is a, c, g, or t
tgatgtcaggagagcagggatcccgcagtacatggcgccagcactggagttggtgagcatgtgctctctcttgagattaggagctnccttactgctccnctgggtganccaantntatttnttttttttttttnnggttagnaagtggacactaacatctgtgcaggtgttgacttgaaaaataaagtgttgattggctag

SEQ ID NO: 480495 - DNA, 1598 bp, Homo sapiens
  misc_feature (745)..(745): n is a, c, g, or t
ggaaaagtccattcataaaatcttttatcccacttacatgtgaattttaattacaggtgtgtttcttaacaatttagtgctgggattgtgtcatgaaaattttcaataagacattataaacaaaggctagccatcactcctcaagttatattctcccgtgtgttacactatttttatacaggcacatgtgccatgtgttatgaggacagagtttctcacaaaacaacaaaacaaaaacatatctccaaaaagagcgacaaaactctcctatacaaaagaagagttataaatctacgatgtgggtttatgtgtgtgttctccaggtggcgtgggcgcgtgtgaatatctctcacatgtgaaagtagataaatgtgatatctctcacaaggcacacatctctacattttctctcgctgtgcagcatctctttatactttgttaacacattgtgtgtgtctctataatggggtgtgtgcccataaaaacacattctaaatatatacacaaaaatataaaagtgtgagtgtgttgtgttgcgcacacaaaatatatatatgtacacacggcgccataaacacgagcgacggtgtataaacttatatacacacatatatatgtgtgggcatttttgtgtaacacgcgcgtgtattggcgtgcgcactttatatttcccaagagagattaaacagtgggggggtctacacacacactgtgtggtgttcatatacaagagggaaacaacacntattctgcgtgcagcaagggcgttgttgaatctacacacacgggggtggtgtattccacccctcttgttgtgcggcgtatttttcccccacgacgaagagtaaattatctacagcgatgggggcggtaacaaacaaatcgtgtgggggggggaaaatcacccaagaggggggaggggacaaatataaaatatatttatacataccgacaagaagggacctttatggagaaaaatggtgcttgtctcctcccaaaaaaaacctgctcttataaagaagtggatgatcccccccacaaaagaagaatatgtagtacatatacaacacccgcttgtggtggttgaccccgtgctggtggtacaaaccccaccatagagtgatgatctccctcgctttaatgatataaattaccgaccacgcaggagcatgaggaggatgatacacacacaacacccgcttgagttgttgtatgttgtagagcggcaagcaaggcattcactaacaatgagtgcggataatacaacactccttgcgtggagagaagcgacacgtatatataaacaagacgtgtgtggacacctttgttattaaaagcgcccccaccatagtgtgtgtgttcgccgcaaagagaggtgtcgtactaatgtgtggcacgaaaaactatttatattacagcttgtgggaagtatcaaaaaaaaatcttctcagcaagatgttccctcccaatatagtggtggggccacgcctcgtaacgtgagattagaagcaacgaggaggaaatatccccataacaatagtggtaaagaggggtgaataagaaatacgcccgccgattagttatttattagaagcatt

SEQ ID NO: 480496 - DNA, 1160 bp, Homo sapiens
taattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccaggcccaccccatccccgagcccctggcaaccactaatctatttctctctctgtagatttgcttattctggtcatttcatataaatggaattctacaatattcggtctttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgaaaaaaaaaa

SEQ ID NO: 480497 - DNA, 105 bp, Homo sapiens
tagccagacggggatgtaacgaaatggcttgtgcacaagataaggtgggagagtgttacccgaaaaaaatgaacaagtcataactatagaacaatactaacccaa

SEQ ID NO: 480498 - DNA, 212 bp, Homo sapiens
agggaggctgagggaaaatatggatcgagccgtaggaagtcgagacgagcctgaccaacatggggaaacccaatctctactaagaaatatttaaaaagtcagccggatgtggtggtacgtgcttgtaatcccagttacttgggcggctgaggtaggagaattccttggatgcagggtatcgcgagcatggcaggtgagtctgcagatcggtg

SEQ ID NO: 480499 - DNA, 174 bp, Homo sapiens
cgccagcctcagccaggtggggaggtatatagggtccatgtgcaatagggagggacgtcttctattttttgctgcccctccccgcccactgtctggggcaggggtgagaaggtacttttcgacgataaagcacaggcaccacccaataaatagtcgtgaagattgccactcaga

SEQ ID NO: 480500 - DNA, 538 bp, Homo sapiens
cccgaggattctgtcgctcggaccatcaccagatggttttatcatcagctgatccccacattcggcattaaaaatagaattcaaaacccggacgtttaatccatcctgctttcaccgttgacacgacctgtggtatactatgtgtcttgctctgcaatctgtgtagcaaagcacagtttcatgcccatcgtccgagcggagcgatcacttcaggacctgattccagccccatctctgaagccaggtcccctctgcagcagaacttccaggacaacaattccagggtcacagtggtatgtggtaggcctggccgggaatgcaattactcgagagaagacaaagaccggcaaaagatgtatgccaccatctatgagctgaaagaagacaagagctacaatgtcacctccgtcctgtttaggaaaaagaagtgtgactactggatcaggacttttgttccaggttgccaagcccggcgaagttcacgctgggcaacaattaagagtaaccctggattaacgagttacctcgtccgagcgga

SEQ ID NO: 480501 - DNA, 144 bp, Homo sapiens
attcattaagggaaaacgaggcgggggggatcgcttgggcccaggaattcaagaccagcctgggcaataaagcgaaagtccatctttactaaagaaaggcatactcagctgagtccacaggtgcgcgccaccacactcggctaa

SEQ ID NO: 480502 - DNA, 302 bp, Homo sapiens
cttctggatggcgcctccttgaaggcatgcaccgcttccgccatgcgccccatcccgtcttgcggccgaccgcgggcacatccaccgtattgtcgccccggcagggctcatggccggtcatggcgctcaccggcacggcgatcaggcggctcatcatccaggccatcacacaagcggcggccatggcgatcaaggtggccacgatcagggtgatctgcccgcgcatggtggcttcttgctcggccgtagtgcgtgaccaccgcattctcagccttcatgatcgcatcctggactcgcggacc

SEQ ID NO: 480503 - DNA, 466 bp, Homo sapiens
cgatccatatcgcagccttgccgccgatgttaccaaagcggacattaaatgcaggataaactccagaacctttatagacggctttgcagttcgtccatcctacaggtgagccgttgtagttgtaaccagccagtagtaagtcatacacccccgctgttccgtagtcgtacattcgcacatgaatcatcatcattgcgttcgtgtacaggactggtaattgaatctgtactgcgcccgtggaggctccggtagtaacctttgccgcaccaccatcagggcgagggatacgagtcaggtcattagtcattagcgcattaaacttagacacaccggagacttgagaattgccacctacttgaagcgcatcaacgtcgttatcagatgtatttacagtaacattgcctgtcgtctgcacgcgcaatgttgatttaccgtcgacgcggccgcgaatttagtagtagtaggc

SEQ ID NO: 480504 - DNA, 483 bp, Homo sapiens
ctctacctactataatatgtggcgaaactaccagttattaaccgacgtcagagattatcagagtcccaggcaaaattcatggtagaatatgacatacccctgataaaccctctatgaagtactggagaatgtaaaggttgtcgtatgcatgctggacctaccatcaagtaaaagacgttggtcctgttaaaaagaatattaaaaggctataattatatattccaataatgatgtggagataatggaatcgaataatgatgcagagcacattgaggcttataggagcgtgatataattacaatactggttttatgagcatcttttctctgcaacagttaaactgcctcagagtttgtgaattgctgcaattcctggaatggaaacaggaattagggtcactggttgattggaacaggatctttccatcgggtctggtcctgacctctctctcttgccttaccttcccccacacaccctcttggt

SEQ ID NO: 480505 - DNA, 143 bp, Homo sapiens
  misc_feature (35)..(35): n is a, c, g, or t
gcagcagagcgagtgtagagtcaggatcagagcgngagaggctgcggagttggtgcctgagctggcgcttttacttggtgacgtgcacagctctctctggggggctgcagctcatcttgttgggagcttgggtacggagctcg

SEQ ID NO: 480506 - DNA, 395 bp, Homo sapiens
ttacatatacgactcgagctcgtacctgtgggtagcagcaacctagggatcatttgcaggtggtaaagccatttaccaagatagttgtaggtaagaagggcagatttattagagaaattgtgaaaatatgttgcagtgggcggctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattc

SEQ ID NO: 480507 - DNA, 1079 bp, Homo sapiens
  misc_feature (493)..(493): n is a, c, g, or t
caccccaaagggggggctctttgtcctttgtctttggaagatttgtgggggggaatttttttccttggtggtgttttctttgttgagggtccctagtcccctcctctccggggcctttgctgcctaacccacgcccgggttctcctttcctccgtgggtgtgatgtatctcctcctgcgaccctcaccaacgttgggcgccaccccttccggtccgggcaccggtaatttgtccgcggaatgctcctcaccgttgtatgggtcccacccgcggagggatctattccggaagggccacacacccccaggaccaaggaagagttgtgtacacagcccccacacatactgcatgaaagatgttgtgtcgccaacaccaagtattctaggtggcgcacaccacagggctttttatgcgcgctctcggcgcccacaccgaggattctcactctcgtctgcccagaagactcgttctcacccaatgggaccgtaggtangtatccgggccgcttttgaggcgctccaagatggcccggcctttgctctcctcttgggcacaccctatctcacgccttgtcgcgcccaccccctcccgattgacgcgcttggagccagacgccatgggttggcccatgtacacgcttagtcacatctcggcccatccagacgagaggcccactgttgcattgcccccccgggccagggacacaagatggccacctgacaccaggcccacctgtgaacccaatggggtccatcacaggaggaccatcgagaatccctgggagccaagccaggcgagactggtctcatccgcctctccccggagggcccagcctggtaggtcgccagccggtctcatctgtcttagccatgaggtctttccggggtccatggcccggcgccagggcaccagggccagaggactcttgagccgccccctccccatgcctgcctggcctggtagagaagatggcaccggatggaggcccccccagacggaccagtgtacataagagatttcttgttgctcttaccaatctaaacctgagcaccctgtccctacaaaaataaataaataaa

SEQ ID NO: 480508 - DNA, 533 bp, Homo sapiens
tttttaaaaagctatgtggttagcacacagaacacttcatggtggttttggggggaaggggcatatgtcactaatagaaggtctccaaagcgggatggatgtggagaaaacacctttcccttctaagttttggagaagaacttccgtctgggctccccagggagggagggatatcccgtggacttgtgacacaacagtggccacctgggcgacaaaagcctggtgggtatagaaaacacaaattggttttaatgtcctcttctccctttccatctttctacagcatagaactataaactccctataagcccagaacattcgtggtgggagaaccgtggaccccttagttcagtggggttaccaggtggtgctcgaggcaactcgtgggacttttccagtgtgagtgcgcacgtgagaaagtggcaccgtggtcaaagagagccaggtggtctcccatttctagaatgggtggatcttcagaataaattcggccattttcatttcacttcctgaaagtcagggtcggctggtga

SEQ ID NO: 480509 - DNA, 499 bp, Homo sapiens
ttcggaacgaggtaggaccttgggctgaagagggatgagtgctggtgcagagcagggtggtgtgtgggggggctctgtgactgcccccagtgcacggggagctgctcaggaactggattcttgactgtctgccccctgagagtggctggggtcggtggtgctgctggggcgggtccaaaccctgccacccatgttgtattggacctgccatggagagggggttccaatgccctgcccacccacaccggtgtggacctgccaaagaggacaggctcgctcaggggttggctcccttccggggacgctggcacagaggcacggtcgccacagtcccttggatccccgaagggctggaaactctttgtccttcgcagtggggtttggatcaatacaatcaccccaggttgcagtttgtgagtcctcgtacagcaaatttcaagaaagggagcagatggtgtgggagtacttgatctgtaggtgttggtgctctgaaattcgt

SEQ ID NO: 480510 - DNA, 154 bp, Homo sapiens
ctaacgggaaaaaaatggggatggagttccaaggccagggcccccaaccttgggccccaaaaccccccttccccttttccctgggcagccaaggaacctggattttccaaaaccccaaaaaggtccctgctaataaaaatttttgaccctttaa

SEQ ID NO: 480511 - DNA, 156 bp, Homo sapiens
ggtggggggcccccccttttttgcccccttggggggggggggggggggggtttccccatgcccccccccccccccccggggggtttgggccccccaaagccccccccctgggggggggggtgaaggggggtttttttttttgttttttttttttta

SEQ ID NO: 480512 - DNA, 81 bp, Homo sapiens
cacaggtggtctggactggcaagggctccaaggcccatcactcttgatcctcaaaggactgtggccaaggcctctgcgcgc

SEQ ID NO: 480513 - DNA, 131 bp, Homo sapiens
tttttttttcagtcctcacactgcttgacctatgtataaccctcctatacttccctcttatgaaatactcctctaggaacttctgtggtagtcaagattccctccctgagatttatttcccatgagtctcg

SEQ ID NO: 480514 - DNA, 235 bp, Homo sapiens
  misc_feature (37)..(37): n is a, c, g, or t
  misc_feature (39)..(39): n is a, c, g, or t
  misc_feature (51)..(51): n is a, c, g, or t
  misc_feature (78)..(78): n is a, c, g, or t
  misc_feature (144)..(144): n is a, c, g, or t
  misc_feature (189)..(189): n is a, c, g, or t
  misc_feature (194)..(194): n is a, c, g, or t
acgcgtttgtagctccggccccgccgttccgaccccngncgccgtcgccgncatgacggggctagcactgctctactncggggtcttcgtggccttctgggcctgcgcgctggccgtgggttcctgacggagacttcgcccttnatgtggtccaacctgggcattggcctagctatctccctgtctgtngtttngggcagcctggggcatctatattaccggctccttccatcat

SEQ ID NO: 480515 - DNA, 855 bp, Homo sapiens
ccgtgggcctcggggaagcgggcaatgttttgtgccccctctctgcttggccgggtggtctcgcctcccgccggggagtgttgcgagcaccatagttattggcgaacgccctccagtattgagccctttcgttggtggtacccacgcggatgggagcagcgttggggcccctggaccccccgcccctggtgtggtgttatccccggccgccgcccgctttggagttaaggcaaccacacggcgggtccttcaggtggtgcatctcctggcggtcgtctgccctccccccttctgtccccgcggcgaggtttgcccacagggggccgcagcgtgcccacgtgagcagccctgcggtgccctgctgattgccccccagcggccccccatctcgggagccgcccgtgcgccccaaagccaacggggcccccttggctcttgtatgttctcagaagagcgggccccgcccctagccattcccctggctactccggggcccaaagggtgggtacgtccttcaagaagggcccccgccgctcccttggtgatgatcctggctgcccgccccgtggttcgatcgccgcacccagccccctggggggacaccctggtcgtgtcctgatgttattgggcaaccaacactgtgcacttccccgttgcacctgtggagaccccgggcgctaccgcgtcctcctcgccaccgcccgctctcgtctcccgctcccccgcccgcggggagccccgcttgtcttgtcaggaccactcctcgggacacctgcgcagacaccccccttttgggtcccctcggcaggaccacgggcccctcaaataatcttttgtttgaaagcccacataaca

SEQ ID NO: 480516 - DNA, 851 bp, Homo sapiens
tctttttatttcacacaaccacaatatatataacaaaatataaaattattctagcacattttacatatgggataagctattcggaaagatctcggaaaatggtaactagaagatcaaagtataccaacagaggaatgtacatctacctaataactgtctaaaatttaaatatgtataataaaataaatgttttaaatattaaaaaaaaaacaataaataaacaaaacaataaaaaaacaaccaaaaaaaataacaataacacatatccaataccctccccctcttgccctcaagggcgaatcttttgattcaattatccttttaattagggttaacactataccttcactatattaactcaatacgttatttctataatatgaattaaacttataactcaaaccaaaatatttttactatccattatccacacactcatagataaacccatcaaatacatatacgctaaacatccatattaggccatctccctttaataggtctactcgcataaactcaacaataacaactgcctcccctcatatcattccaaaaatatttcattacaacaataagttacaaaaacacaacttgttatacattttctcacttattaccatatcaattacaccttatactctttctgataacctcatattttaaatgtgatattattaatacgtatatttaatacttcctttcgacacacaatattatttctcattataaacaaacactatatattcaatcacctactccccggacatcttctcaccattgtactcgctctacattaaatttccccttaacaccctatccaatttttttatttttatattattataccatac

SEQ ID NO: 480517 - DNA, 311 bp, Homo sapiens
actgaacaagaaaagtcagaatccaaagggtccatcctctccagaatgccagaattcaaagaaagctccaactcaacacattcaaacacatacagagaaggaatgaggtcacatcctggaatcccagagactattctgatgtgtggtcatcattctacaaccccttctaacacgaacacagtgatacaagcattccagatacagtagcgatcactaagaatataggggacacagggtaagcagagtacagaacacgcatcataaccatagttatcattcagaccgcagagatgcatgggacaaaggaacca

SEQ ID NO: 480518 - DNA, 326 bp, Homo sapiens
tgtttcccaggctggaatgcaatagcacgatctcagctcactgcaatctgcacctcccaggttcaagtgattctcctgcctcagcctcccaagtagctgggatcacaggtgcccaccaccatgcctggctaattttttttgtatttttagtagagacggtgtttcaccatgttggccaggctggtctcttaactcctgacctcaggtgatccacccacctcagtctcctaaagtgctgggattgcaggcgtgagcactgcacccggcctgaattttaatctttaacttcataaggaaaggatggattgcattagtactcaatacag

SEQ ID NO: 480519 - DNA, 185 bp, Homo sapiens
cgcacaggaccttgggtcgggtaacacgagagctgcatcaaagagaacaaaggacagaggaatgtctgcgtatatgaacgccttattcgtgcgacgacttatataccattgatggataatgctgactcaagtcctgtggtagataagagagaggttattgattagcttaaacctgaccaagtaga

SEQ ID NO: 480520 - DNA, 389 bp, Homo sapiens
  misc_feature (1)..(1): n is a, c, g, or t
  misc_feature (5)..(5): n is a, c, g, or t
ntcgngggtatcataaactccaaccccgttcaagatctacattattttatttatttatttatttatttatttatttattttgagacagtttctcccttgttgcccaggctggagtgcaatggggcaatatcagctcaccgcaacctctgcttcccaggttcgagcgattctcctgcctcagcctcccgggtggctgggattacagacatgtggcaccactcccagctaactttgtatttttagtggagatggggtttctccatgttggtcaggctggttttgaactcccgacctcaggtgatccgcccgcctcggcctcccaaagcgttgggattacaggcgtgaaccaccgtgcccagccaagatctacactattatgataccgcgaa

SEQ ID NO: 480521 - DNA, 285 bp, Homo sapiens
atcgtgccgttactctccaacctggacaacaagagttaaactccgtcttagaagtggaccaggacaggaccacatcgtggtgtggtagggtctgattcacattgaggcagaggtgaggctccttccttctcctcctgatgggttggtggagctacaagccaggtaaggaaggaaagggtcccagatccagacttgctctttctgaaatccagggcttcccccagggactgggtcagccacctggtgaatgagagtgggggtcctgagctcaaacatggtgtagtg

SEQ ID NO: 480522 - DNA, 321 bp, Homo sapiens
accgctgcagaagtgaggggctgggtcatcaaccccctgtgatataagggtcccttctcctgtgcttgatatggttgccagacatgacatgcctcggcattcctggtcttcacttctcagtcgttcatgcgagacatatcatcaccacgcatcatcattctccaagcaaggagcgcatgctgcagaacgacatccggcttccaccatggatcatgctgatcagtcagttgccattcgagacggcattctgtgccctcgttctagtcctggacctctggttggatcgctgacacattccacgttcgctagggcggttaccag

SEQ ID NO: 480523 - DNA, 478 bp, Homo sapiens
  misc_feature (6)..(6): n is a, c, g, or t
ttttcnttgtcacatataaatttcacctgtcattgtcacagaatattattttgattttttttattcattaaaaaaagtaaaaaccactctcacagcccttacattaaaaagggggtgggggagatttgggtgggggtgggggtttgcagaccccagttctagaggggtaaactaatggtttaatgaccacagctggtggtcacacattaagggagacagacatggggggggggtggtgggtgatgggtgtgatttgggggctttgggggggtggggggggtgggtgagttggggtggggggttgggggggggggtggggaagatggtgtaaccggtgggtattgggaatagaaaattttgggtgggggtggtggggtgtgggtgggatgtggggtattggggggggtgggggggggggggtggttgggggtggggggtgggggttggggtgggggggggtggggggattggggtgggg

SEQ ID NO: 480524 - DNA, 340 bp, Homo sapiens
tcggccgcctactactactaaattcgcggtcgcgtcgacaccacattgactataagaagaaatttttggctgggcatgatggctcatacctgtaacctcagcacttttggaggccaaagcagacaaatcacttgagcccaggagttcaagaccaacctggagaacatggcaaaaccccatcttttcaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttc

SEQ ID NO: 480525 - DNA, 998 bp, Homo sapiens
gctctgtcactctgctgcaccgagctcgagtcttgcctgtttccgacttgttcgcgaggctatagagctactgtgagcactggggtgtcagttgtttggtccgacccagaactgcttcagttctgctctgccaccacggagtatataatagactgatctcgtgtgtgcgcccgtcttacatgatacatagtaatatgcgtaacatctgatgctagacaggaaggaagaccttacctcaacgagctgcagagacccaatgagtgaattcggtgacacgccctgcaggaaggatatggacagaggaagcgagagccagtttagaagaatctaggaagaacactgagtgaggaatggctgtgacctgcagcagggcatgtgctgattttcacggaggcaaaggagagttgcgtggaggggtaagggagaaagttggaggaagacagtggatatggaaattgagagtgtgttaagagggggaggcctcgggggagaggcagatatagtgtaagaaaaccggacccgaggagaagtattagtacgaagttccgcgagaaaacacagggagaggactggcgccgcgcgcggcaaagaggacaaataattccaaggacggttggagtcgatgatgaacgatgaactacgtaaagacaaaagtccagagtaggatgaggaaaaaacctacataggaaactgcaagagcagtacattccaccccttcaagatggtctgagacaccagcgaatgatcagggctaggtccatcaataccttaaccatggcaacaggatttgacagcctatggggaccccgttgaacacacaactatcggaaggagacagtgacccccgtaatcgagctaatccgcagcgaaggtgcattaaacgccgtaaggaaagagcacacgtgtaagattatgcacggacgatcaaagtggaggttcccacgattggacagaaacgacatagtgaatgagcacagactgagcgggaacgcaaaacg

SEQ ID NO: 480526 - DNA, 875 bp, Homo sapiens
gtaaagcattcttcctttccacgttggcacgctgctgagtggctctcgtcatagaaggttgcctagaagatccttgggccgttgactgcctagtctataggatagtgatacactgagaatagacccatcggaaattcacaacgtgcttccatggatgtggactttcagttgatgcgtggcacttacgggcatctcatcagacgcagttcgtacaatctgcccatcgatgagtcgatgtgacgccccagattgttgcgcattgaccaccaggctcaacaaaagctgtctgggccaaaggaactaacaggcattgtgcccataccgaatccgtgtggcggttgtccagtacacactgtactgacggcactgacagatttcaccaaattaacgctataatactttggttccctatgtacctgttaccacttttcaaaaggccacgatgccggcagataccaagaccctgggagggacagtccagccggcgcctgccggaagaaggctttaacctcgcttgacctatgaacggccgtggtggtctcaaatatagggcattcttgattgggaaaacttgtgttgtctaccggtcacccgattgacttaagtctgacgggggggtctaaacaaccagacccacggcttcaagattgtacacacgaacgcattggcgcacattccaacagtccaataattgccgacttatatagcgtaggccaaagggaagcccgcactggttacccatgaaacttgagtgcatggggtctgacattgaagaccttcggtcgagtacttaggaagtaacatcatctttgcactcacgacactgttggccgacaactccttttttaactaagtgggtgatcaacacctacagg

SEQ ID NO: 480527 - DNA, 1431 bp, Homo sapiens
ttgtgttgtcgtcgttgtttgggtcggtgtcgtcgcgtacttggcgcgcgggggtgtgtcttgttgttgttctgttcgctctcctcactacgtatctggggtggcgtggtgtggtggccggggcggcggggcgtagctatcaggatggtgttgtctggtgtcggcggcgcactggctgtgtgccttggggtgggggggtggagagtgtgggtgggctcgcgatctgcgcgtggggcgaggttggctgtgttctgtttgtttctttctttcttttcttcgtgtggcgctcgtggggaggatcttggcttggtatgcgtgttgatgcgtctcattctcatttgttgttgttgtgttcgccctcgtagtgtgtgtttttcggtcggatctggttgcgtcgagttctactatgccccacctctgttcgtgtgtttgtgttgctagccacggtgcgttggttcgtgctggtgggaatagtgtgtctgtggtcaggtctgtgttcatggggcggtgtcgtcatttgtgttggtgtgggtgtgggtgtgggcgtcgctgtgcattggttgtctattcgcggtctgctgtcgtgttgtgcggtcctgtagggtcggtggtggggggggatcgtgctggtgcgtggtagtggtggggttcctccgtcgtgtgtggtggttcatggtgttcttcccgcgtcggggtgtgtttgtctgttgagtgcgagtagcgcgcagtgctgtgtggtgtctggtcgggcggaggtttctgtgtgttgtctcccgtgcgtcagtgttttgggggcggtccactttgcgtgtccctcgtggatcggtgaggtggttgtcgtcgtttggggggcgcttgtggcctgtttgcgtcttttgcgttgcacattcgtttgtgggcggtgctgtcctgcgttgcggcacctcgctctccgcggctgtggagtggtatctcggagtctttcttcttgttgtgtccatggcgagcgcctggcattcgcgggtcctgtctgctggtgagggttttgttgggtccctcattcggttcgctgtgggttggcgtcgtaaggtgggcgctcccccgtctcgttttggccggttcgggctgtggtgagtgctaccaacaaggcgcttggtgtggcgtggtccacccccgtcagtgcgtggggttggttgtggtggtgtggcacagcgcttgccctgctcttggtacctccgctcccgtgctgttggttggtaggctgcccgcgtatgggccttgcgtagctagggtcgttgtgatgtatgtagcgcagctctgttggtggtgtgccgtccctcccctgtgctgccctactaatgtggttgcggggcgacctctcgtcggtcaacccccccccctcccccccccgtttctgtgttaatttttttttttttttctccctctacatta

SEQ ID NO: 480528 - DNA, 105 bp, Homo sapiens
ccaccggcaggtgtactgatgtgactaatggggaataacattatgtgtatgagcgcgaaccctatacaagtgcgactgcacagcgggggtttgctcctaggctcc

SEQ ID NO: 480529 - DNA, 971 bp, Homo sapiens
ccggcccggagcggtcatgtcccacgggcccaagcagcccggcgcgggcggcgtgccgggggggcgggaaggctccgggccagcatgggggcttcgtggtgactgtcaagcaagagcgcggcgagggtccacgcgcgggcgagaaggggtcccatcgaggaggagccggatgaagaaacgcggcatggcccatgggcaagaagcggaagaagattctgccgaattgggccctagaggctaccgggtcacgggctacgtgcagccttccgtgaacgagcggcgcgagcagagtccgcacgcgccagccggatctgtcctttcccgagatcaccaaggatgctgggcgcccgagtggagcaagcgtgcaggcaacggaaggagcagcggtacctggatgagggcgaggagagagaagcagtcaagtacatgagaggagctgggagcgtaccagcagtctgaaagcctagtaagatgtgcacggagaaagatccaggcagaagaagatcaagaaagaagagtcgagctctggtgctcatgaacacgtctcctgaatggacacccagggtgtggactgcgatgggttctccacttcgatgttccatcttcactgaagagttcttggacccaaaaaagccgcgtgtgaggggagactctgcggcgctgggaaagaatgagtgtgcgctttcgagggaggcagaacgggggtactgcagaggcacacgcagagcatgagcgaggcgcgcgagcgttgagcaggagctggggctggaagagcggaggaagctgagctgaggaggccaggcgtgccggggtcaccccggttgcccatgcgggccgacggggaaccccgcgggcttggtatatggcggtcgggcctgggccgcaaaggaaatggggtagacggccggcggcatgggggcccattggcttggcccccgcagggccgcggagcatgtctattttcagagggg

SEQ ID NO: 480530 - DNA, 921 bp, Homo sapiens
  misc_feature (2)..(2): n is a, c, g, or t
  misc_feature (205)..(205): n is a, c, g, or t
  misc_feature (279)..(279): n is a, c, g, or t
  misc_feature (281)..(281): n is a, c, g, or t
  misc_feature (314)..(314): n is a, c, g, or t
  misc_feature (324)..(324): n is a, c, g, or t
  misc_feature (331)..(331): n is a, c, g, or t
  misc_feature (363)..(364): n is a, c, g, or t
  misc_feature (366)..(366): n is a, c, g, or t
  misc_feature (404)..(404): n is a, c, g, or t
  misc_feature (421)..(421): n is a, c, g, or t
  misc_feature (446)..(446): n is a, c, g, or t
  misc_feature (475)..(475): n is a, c, g, or t
  misc_feature (503)..(503): n is a, c, g, or t
  misc_feature (524)..(524): n is a, c, g, or t
  misc_feature (546)..(546): n is a, c, g, or t
  misc_feature (550)..(550): n is a, c, g, or t
  misc_feature (571)..(571): n is a, c, g, or t
  misc_feature (573)..(574): n is a, c, g, or t
  misc_feature (588)..(588): n is a, c, g, or t
  misc_feature (683)..(683): n is a, c, g, or t
  misc_feature (918)..(918): n is a, c, g, or t
cntttgtcattatttactattgtttattgatttaacaatatttccacagaccaaagtattttattacatatatagctgagcatgtaattcataattgtataatatagaaaataaacttcttggtattggcctcagcatttaataatgaaaaactagtgacaaacatctttagaaaaaaataataaaatagtccttcagtattaanatttcctagtaaaaagcattagatcaaagttaagaatatgacatgttaatgcatagatgacttaggcataaatnanatgaatcaaatcccagctcttatagtaaatcanaataggtganatctgcnggttcacagtttgtcataggtcaattgccaanncnatgcatcattcatatttttcatcattctgaggtttttnatgatacaacatttaanataatgcatacccaggatataagcnatgtgctgcatacttaccaggtgattttnatgccactttgctgaatgccggattaanatatttgggctttttattgcntgggtagaaagtgctcattacntatntcatgtttatcatatagaccntnnacccccccattttnttcatggcctccctcacccggttgtgggggttggcttcctcaagatcgtcttcgggggttttggggcagtgggaggaggccggtggcggggcggncaggggggggcggtgacggtggcgggccccactccccactgtcgcgtgggaaaggagggagatggggtgtaggagggaggggagggccttggtgaggtatctttcccggtgggtggacaggttcactgtgtaagtggacctccctgtttttttatgttataccgggtatcacagtcaggacaatagccatggtactgtactttttcattaaaccgtaactcgttctcgaggcccngcc

SEQ ID NO: 480531 - DNA, 469 bp, Homo sapiens
  misc_feature (1)..(1): n is a, c, g, or t
naattccccgcggctggtcttgaacttcccacctcaatgcaattctgctgcctcagcttcccaagtagctgagattataggagtgtgccacctgtgcttggtttattgtatattttcaaatagctagaagagtaaattttgaatgttttcaacacacacacaagataatattaataaatgtttgaggtgatggatattctcattaccctgatttaatgattatacattatatacatgcattgaaacatctatactgtaccccacaaatatttatgattatgtgtcaattaaatagtgaaagctaaataaatatagacaggagaacctatacattttcatggggtaggggggtttcatgctttggtaggtttgtcggttttcgagacagagtctcactctgttctccaggcaggagtgcaggggccccatctggggtcactgcaacctccgcttcccaggctcaagcgaa

SEQ ID NO: 480532 - DNA, 1174 bp, Homo sapiens
  misc_feature (251)..(251): n is a, c, g, or t
  misc_feature (1174)..(1174): n is a, c, g, or t
gggaaagtccaggggtacaggaggcctctgggtgaaggcagaggctaacatggggttcggagcgagccttgggccgttggacctgagccatctgtgtgtgctgtcgtgtcgtcacgtatcatcatctgcgtatcacctgctcctgactgctgcctttacaagacgtgccgccgacacacgtccggtttgtcagcaccaccacgagtccagccgacatgtggtgcatgccccgttagtcctcagcctccaangtgtgcctgcccagcataccctggaccaagctaccaggggctaccagagccatgccgcctcagccagggatgccagcagcgacccatacccaagtgcagatacccaccaccttacccagcccagcccatgggcccaccggcctaccacgagaccctggctggaggagcagccgcgccctaccccgccagccagccgtccttacaacccggcctacatggatgccccgaaggcggccctctgagcattacctggcctctctggctgccacttggttatgtagtgtgtgtgcgtgagtggtgtgcaggcgcggttccttacgccccattgtgtgctgtgtgtgtccaggcacggttccttacgccccatgtgtgctgtgtgtgtcctggctgtcttatgtggttcctctgatgctggcaaggttggggaacaatccttgggcgagtggggctgggacccagaacttggtctcttcctcacctgagatgatggcttccctaaaattctcaaggccgaactccaagaatggggtcgtgaggggcacctgtgagtggtcccttacagtggagccctctccagggcactttggagtcttctccagctaaccataggggggccccaagttagggcctgtcaacacaggggtgggccaccatatcgggcgtaaagccagaaaggatgtccgggcactggagacaaagcacagccaggtatgaagccgtggtcaccccaaaatgggaccccgattcagaccgaaacagcagagagagacgcgagacactcacaatggaataataagcaaacccaccactgacagttgaagagacaaaagcacaccaacgaaaccacacagtaagagatgacgacaacgagaaggagacaacaacgcacgacacaacccatccactcgagaatccttatccgn

SEQ ID NO: 480533 - DNA, 969 bp, Homo sapiens
  misc_feature (55)..(55): n is a, c, g, or t
tcagggcttgtgccggccgggcaggtagtactttggtctccacttgagagattcntgggatcagtcatcatgagacgacatcttcaaagaataaatcaacaagaaacgggtaggggtacctaatgaccttctaagtggtgattgtaaagggtaaaatgctaaattgtccgcaaggataggatctgaactaacgtgacattccttcaccttccctcctttaacaagcttgttagaattatgattttcaccctaacctggcattaaaaatggactccattattttcttttccattcttatgttaacatatttctgcattatacagtttgctgtgctgtggcttctatgttatatggctaacatggacctggagatagatttctgcagcacacaggagcactgcgcacaggatctggccttgcagagaatagcataccagtaattatttgccttctggagtgaccgtgcagggaggctgattttgactctgagtctttattgaaataaaataattggctgggtgtggtggcttatacctgtaatcccagcactttggaaggctgaggcaggaggatcactgagcccaagagttccagaccaccctaggcaatatagcaagaccctctctctacaaaaaatttaaaaaattagcaggcatgcacctgtagtcctagctacttgggaggttgaggcaggaggattgcttgagaccaggagttccaggttacagtgagctgtgatcatgctgctgcactctgtcctgggtgatcgagtgagaccctgtctctaaaaaaactaacaacacacccgctgaaaacaaaaacttttttggggccccgcgggcccccgaaaagttttaaaaccatcgcgttggggcgcgggcccacgggtagacaagtgggccacgcggcccaaggaaaacgggccacgcaaagggggggcttcccaaaaaagcccgggcccgcctgaca

SEQ ID NO: 480534 - DNA, 960 bp, Homo sapiens
  misc_feature (960)..(960): n is a, c, g, or t
tatatgtacgaccacgccggtcgactacattaccggggctagaaaatgaaaattctatgcccaacgacatgacattcttagctgctaagcttaactattaaggccttttccacacgcattactagtcccattggtctcttgccatttgtaactttgcccgattgtcttactggcacatggtgtggacacaggatcgtgcatgggacgtctgcgcttaaacgacacattgcagcttcaactttatctctttagtgttctgttggcagaactaatacttaccgagtcagactttgtgttcatttcatttcagggtcttggctgcctgtgggcttccccaggtggcctggaggtgggcaacagggaacgtaaccagacacacgactgttgtccaggatggttttgcggactagaggctcagtaggtgcggagagatccctgcagaacccacacaagccagaacgtggtttgcctgaggtccgtaactgtagagaacagattctggggctgtcttatgacgaatatagacatactcacataagcccagttcagtcaaccatttcctcctttacctttcagtgcagtttcgtataaacacataaggctgtaggttcaaacttccgggagcacggactgtcagttcctctgggaagcgtggccagcgcatcctgccagggtttactcctcctactgtcttttggagaaccaggggctcttctcaggggctctaggcgactgccaggctgtatcagccaggaaaaggccacaaactcccaagaaggtgaacactggtacgaacaaggtggtcacaaactaccaacacacagtgggcgctctgggcgaactcaggtcggttccatatcccctcaaccatctggactagattggtacattacgggattcaagcatcgttctcaccttccctacagccctccccctctcacctcttttacatcacggcan

SEQ ID NO: 480535 - DNA, 109 bp, Homo sapiens
ctgctctagaggacccagcactgtgcagctcctttctctgcttcatttagcttagaaaatcattccttttttttttttccctgggagaattgttggaatcagctgaaac

SEQ ID NO: 480536 - DNA, 219 bp, Homo sapiens
ttatcccctcatagtcgcaggaagatctaggtggggaaggaccgaagatgggtaacagcatcatctaaggcaatcagtcactgtcaaaacttgcgagactacaacacattatcaatatttaagaaaagacaaggagttcagagtgctagaacacagtgctatgatgggaaggctagggccacattataccgagtttcgacatgctcatctatttcatca

SEQ ID NO: 480537 - DNA, 838 bp, Homo sapiens
  misc_feature (725)..(725): n is a, c, g, or t
ggtgtccagcccctgttaggtgtgtagtaggggaagcttaggagccctgtgaggccttcattttcctattagaaggatttcccttgccctcttgctgtgagttcctagagatcgtgctttctctgtctcaggacctgggatccagttggaggacggcggtgatggcagggaggatgccccgattgagaactgtgagtggctagcccgagatgcctctcgttgcacgatgccaggggtcctgggcactccgtgtcctcaggtcttagagagtcccagacctcagtcatgggcgtctaggtcaggcctggatcattctgagaggcggtgcccctcaccaggaagacgggcttcccatggggctgacaagccagatacaccatgaccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagctggtcatccaccgaggacacacagcggggagcggcctatgcctgcacccagtgcgggaagcgcttcaacaacagctcgcacttcagcgcccaccgcggacgcacacaggtgagaagccctacacctgccggctgtggncggggcttccgccggggaccgacctgcacaagcaccagggaccacatggggcagggtcctgcgaaagtccagccggtgggtccgtgagggcccgggaaaagcctgatcaccag

SEQ ID NO: 480538 - DNA, 381 bp, Homo sapiens
  misc_feature (353)..(353): n is a, c, g, or t
ggtcctctggtctcaaccagttcagttcaggagagagatcatttcgctatgactggctgattttcagcctaggagctgcttcaaatgcacagtctagttgaagtttaaaccccagcattcctccctataaatataaaatcctgtctaccctcaccccatcctttgacttatttttcttttaagattagcatctctgcccccatttcctcctgccttccttctctgagcgggctgggaccttggactgcattgggtccctattctatgtgacagaggaaggaagaatcagccggctcagtgggtccacaactcatgaagcttacacaccaccttccataaaggagtgtgccaantgacctctgcaagagcacaggaaagagg

SEQ ID NO: 480539 - DNA, 287 bp, Homo sapiens
taaaatttaatatttaacaagggataataattaacaagggataatttaacatttaacaagggatactaagtgtggccgggtgcagtagctcatgcctgtaatcctagcactttgggaggctcaagtgaggtggatcacttgagctcaggagttcaggaccagcctgggcaatatggcggaacccagtctctactaaaaatataaacattggctggacgcggtggcttgttgccctgtggtcccggctgctcgggaggctgaggcaggagattttgcttgaatctggg

SEQ ID NO: 480540 - DNA, 135 bp, Homo sapiens
gtcggcgctcgccctcgctctcctcgccctccgacccggcccggccccggcccgccatggagaagactgagcatgatccagaagggcaagctggccgagcaggccgagcgctacgacgacatggccacctgcatg

SEQ ID NO: 480541 - DNA, 139 bp, Homo sapiens
acgtcgcgctcagcagctggattcgcttcatgctggcgccacgtgcggatctcgaagaatatgacgcgctggcactggtgctccagcaccagttccgcgatctgcgcgttgccccccagcggcccgctcagatagcgat

SEQ ID NO: 480542 - DNA, 296 bp, Homo sapiens
gtaaaggagttaggatgttggcaggaggaaggatgtgtccccggatgaggaaaagaaagaataggggaatttggatgcagagacccagagaaaatgccatgtgaagatggatcagagacaaaagtgatgggggtgcaagccaaggaatgtgaagaatggccagccccccccggaaggtaggggagacgccagcccagattttccctgagagtatccagaagaaaccaaccctcccacccctggatttcagacttttgcccttgagaagtgtgagccaataaaacaactgcagtgga

SEQ ID NO: 480543 - DNA, 487 bp, Homo sapiens
gtgatcataaatgatatcatcaaggaatagtacggtatttgtgtattaccatgaaacgtaactagccaaagccctaggcactacctgactaaaagtataccagagtttgcgatgttacttttggtggttttgattacaccttcaaattatgtcaaaactgtggttgtttcttactggaaaggtaaattttagatttggcctagcatacacacagcacctgttatacgtgctggtaacactagaggacataaccatagtctttgcactggacagagcttacaatgagatgtagaacgttacaacatgtaaaagtagttaaaacttacagaaatactaaaaattactaaataaaatactactgaatcacttggtatatggccaaacatgtgctaatcattttcatgacttaactcgttgaatttccccaacaatctgtgcagcaggttactatcatatccctcttttatagagaaggaaccaaaaagca

SEQ ID NO: 480544 - DNA, 103 bp, Homo sapiens
  misc_feature (88)..(88): n is a, c, g, or t
tttggtattttgggtagagacggggtttcaccaatgtggaccaggctggctctcaaactcctgaccccacgctgcgaagatcacccangaacacagctctgca

SEQ ID NO: 480545 - DNA, 180 bp, Homo sapiens
  misc_feature (56)..(56): n is a, c, g, or t
  misc_feature (65)..(65): n is a, c, g, or t
  misc_feature (69)..(69): n is a, c, g, or t
  misc_feature (98)..(98): n is a, c, g, or t
  misc_feature (110)..(110): n is a, c, g, or t
gaattgcttttgtcgaggttttgggaattgtatttgcctgctgactccgtgaagantatcagaantggntaccgaggtgatgtaggggtcctggtgtncctccagcctcntccatctgggggagtggaatagtatgcctcccaggtttttccaattaaacggattattttttaagaaaga

SEQ ID NO: 480546 - DNA, 840 bp, Homo sapiens
gatcttgttgattgatcctttcaagatgctgtcgaatgcagtcggctaaatatttggctgaggaatggtttgcatctatgatacatcagggaatatggcccatagtttacctctgtcaggttctgagtatcacgaggttagtgctaggccttgtgacgctgagttgaaagcatgcccgtcctcttcaaagtttgagaagagtagagaagtactggtacttagtggtcctgtagagatgtccaagtaccaattcagcaattgaagccatcaggccttgagcttggcttatgatagggagattttggattcctgattcaatctccttagttgtcatggggtctgtccagattttctgtctgcttcataattcagtctggtaggtctccatgtttctaggaatgtatgcattgcttccgaacgtgttccattcctcttgcaatattctttccccaatgacttttcacctaattattgtagcatctattgatgatccttacctaagttggttatttcactgggactggaaattgaggatcctaattttcacatctttttgtacacttattaggcagcattgctctatttgtttaaaaaaaaggcttggctcatccatctgggttgaccacacgtttctcctacagaggcagaaaatgcttattatttccctttaatgacagtttcagaagagacacttgtgctaataaggccccaagaatttaatggggtcgcccgacggggaaaatctcctctcccaccaaatggtttcacctatataacacagccttgtgcgccgttttttgggcccctataggccttctttgttagcgcactaacatcgtg

SEQ ID NO: 480547 - DNA, 978 bp, Homo sapiens
ctcctatgttctgcactggatgcattcagcttgaggatgtgcctgatagtgcaggcttgcgcctcaacagagatgaccagcagagtcctcgagcacctggcctgttgctccaacattgcaaagacacattatcagtccctatttctagagggattactttgaattgagccatctataaaactgcaaggtcttgcttttttttttaatcaaaactgttctgtttaattcatgaattgtatagttaagcattacctttctacattccagaagagcctttatttctctctctctctctctctctctctctcactctctctctctctctctctctctctctagtgagtctgtaacaaagcctctttaaatcggtgtatccttgttgaagcagtcctttctcatattgagatgtactgtgattatactgaggttttcatcacaagaagggagtgtttctgtgccattaaccatgtagtttgttaccatcactaaactgcttggaacagtacacatgctacaaaataaaggctcctcatacaggtaaagtctcgacggcatgcgagaacggatatctctcatagtgtgccgtgttggctcacaaccgaatcacactgacagctggctaacaggatacaagttcttatgagttacctctcacaaatatatggatactgctgaccggggtccttatgaaacatgtccttttctctaaaacctaccttctatgatatctcaacgttctgctgacagtaatcacataacatggctgtgctatgacatgaaacagaaagcagtattataatcatgcactatcactatattcagttcacacacggatttaaccagtgccacgcaacgaaaccattttaaccaacactttcgctcatcgtaaagtgtaacaactccaaagtgattacaaaaaaatataatatgaacttaccaccaaagccaatcatcggttaaacacaaaccaaccgcaca

SEQ ID NO: 480548 - DNA, 975 bp, Homo sapiens
acctggtccctggtctggtgccatgtctggctgtgatgctcgggagggagactgttgttcccggagatgcggcgcgcaggacaaggagcatccaagatacctgatcccagaacttatgcaaacagttttaccatttaggctgggtcactgggactggaggcggcattagcttgacgcatggcgatgaaatctacattgctccttcaggagtgcacgagcggaacgaattcagcctgacgacatgttgtatgtgatatcacatgaaaaggacatacagtggaccttacgccatcgaagaagctaacaccaagcccgtgtactcctcttttacatagaatgcttacacaatgagaggcgccggtgcacggattcataacccaatctaaaagctgctgtgatggacagaattactctttccaggagggagtttaaacattacacattcacagaggatgatcaaccggacataacagaaatgtacttccggagggtattatcgatatgcatgatatcgtagtggtagcgcattcatatgcgcaataccgcctgacggcgaacgacctcacaggatagaatggtaatgcatgaatgcataccagatactgtgtaagatacgtggacgacggtaatgagagtctatggtgtggggaggccaagagtggaggaaggcgaaaccgcagttgtgagcgtgatgccaatcattgatattgggtgactctcatgaacgaaagttaggcatgatcttacacgtaccagatggcaacatggacttgtttagacaaaagaggttaaaataatgaggaataacgtgccgtaagtatcaacgacggtatcacaggctggagtctgggatctagtgcggaaatgaagggcggatactgagaaggggacggataatagtgagagaaggaatcaaatgtatagactaaagagggagttcgaagaaacaggaacaaaagaaaggagagaagaagt

SEQ ID NO: 480549 - DNA, 756 bp, Homo sapiens
ccagtggcgagcagtgcccagtgagtgaatgaccatgtgctgattcatgaacttcccactgctgtccctgtggtcccctgtgctgagacctgtgtgagtgacatgccccagtgtgtcacccatgactgtgtgacaactgtgcacctggaacactggctgtggttgtattgatgtattgttgatgcactggcatgtgctgtccatgtgttgccgatgttgctatggatgaatgatctgttggatgcccctgctggctatgcttctgtgcctcacctgccaaaggatccgtctgatggcctattgcttgcctaagtgacatgcgtcttcgttggagaacttgcaggctggctacattgtgcccatgagcagtgccatactgtgaaccattgccccacattatgagttcctggcaacatcttgttgacaccaagcttggagacgcatttggccagaggatttgcctgctaccatgggaggttatgcgaggccaacgtgaagaagcagtgtcatgcgccagccttcaaacaaagccgccctgagagagagccgcaacgtcggcgttgtgattgtggcctgttacagttacatgccaccaaccaaaatgccacccttgaagaacccaagatgatcagacaaccacaaataaatgagataaacaagcaatagagtgctccatccttgggaaagatggcttgccatgcttgcagagaggggagatcgccaaaggagcagtgggtctccaatgaaggaggaaac

SEQ ID NO: 480550 - DNA, 490 bp, Homo sapiens
cttatagaactctagaatgtcattcatatgctccttatcaagtgaatactgtggtgttcaaaaaggctcattctcaggcaaatgcattctggatcttccgatggttcataagagcatgtgggtgccagagctgcttgcgatgatactgattatgttcttccctataggggcagatgtgttccttacaatgtcacagaagacataatactatagtcggggcatagaatatatacgcctgctatccttcaatatcccaccaccattagtcagcaggcgcaacagcgatctgccgagcagaaagcgcgcttgtgacgagcctttaggttactgtaagctcaagctgggcaagtaagataacataccgggaacgggagcctgaataccttccagattgcaccgttaatatgcccaagtttaactcttttccatataagttattacatttgagaaatctgctacatccatctagcaaatggatactgtgtcctca

SEQ ID NO: 480551 - DNA, 160 bp, Homo sapiens
tctccttttttctcttgctgcccacattgtgccttaatttaatgacccccagttttctggggcttagttaaaaaaaaaaatcaagtctaacactattgctattaaaaaagcttatggtcctgggataaaaagtcatacactttacaaaacaaaaaaaaag

SEQ ID NO: 480552 - DNA, 291 bp, Homo sapiens
  misc_feature (286)..(286): n is a, c, g, or t
gaggtgactctagcggatcccttcgtaatatgtaacgataatgccatggcacttggcaactcaaaagattagatagaagaaagctagagtgcacgcttggtgcaataaccctaagtgtttaggctggaggaagtccagaaaatagcttcaatatctcatatcatatgaaatgagacagattattaagaactactagaagcactatgaatcaacagtattggctgggaaaccagatggctagtcacagtaattttctcccagtaatcaaatgttagtttcatttacnaaaag

SEQ ID NO: 480553 - DNA, 296 bp, Homo sapiens
  misc_feature (23)..(23): n is a, c, g, or t
  misc_feature (162)..(162): n is a, c, g, or t
  misc_feature (181)..(181): n is a, c, g, or t
aaaaaaacagttatgtccctttnatcatactattagcataaaagactgatgccaggtgttgtggctcatatctgtaatcctaccactttggaggccgaggcaagcagatcacctgaggccatgagttcaagaccagcctggccaacatggtgaagccccgtntctactgaagatgcaaaanttggctgggcatggtggcatgtgcctgtaatcccagctacctggaaggcagaggctgcagtgagctgagatcccaccattgcactcaagcctgggtgacagagcaagacagtctc

SEQ ID NO: 480554 - DNA, 856 bp, Homo sapiens
gggtgatgacattttacacgctttggcaaatctgaaaaagtcagcattttctcctaaacttttaaatatattttcatgggatatggaattctaggtagactttttcttgcagtacttgaacgatattgttttgctctcttctggctagtattgtttctggaaagaaagctgcatcatttttggtctttgtcctctgcaataattgtgtcatttctcccgggctacatagcaagatttcatctttgtcactggttttaaacaattttattatcatgtgtttgtagtttgctttatgctttcttttgcttggggttcattgtgattctgggggcctatggtatacactcactattacgtcacactcttgacacacaacttcaacatactgctctcttctgttcttccacagttctttcttcttcagccgattcatacttacactgtactatgaacgtcgctcctaagcttaaacataattccctgcccatttcacttctgctcacttaacgtctctgtgcttaattcaggataactttctaatgctgtgtcttcaagttcactcatctttatattcctgcagtatcaaattctgccgtgaatcccatccattggtcttctgtaactcaacatcatacgttatcatctctacacagttctccaaacatctcttacatggtctttccattaattcatgtcatgactcttatcctgtagcctctctgacataacctgcgaatcacaattacggttaataaacctatttcaagtgctgaccatccattcacgcctaacatgcctcgctcactgctgcgaccagcttcgactggactgacctcaatgcccccacaccgacccc

SEQ ID NO: 480555 - DNA, 116 bp, Homo sapiens
ccggcttgcaactgttttggggggttgaaaagtggtttaaccctgagactaacttaaacacttccttgccctttttgtggcctgggtactcaagcaataaaatgattgtttaacta

SEQ ID NO: 480556 - DNA, 134 bp, Homo sapiens
cacgagggagaattcacattttacctgcattggccttcattgtccgggcatggccgctccattggtgggataaacccctaggtttcctaatgcacatgaaggaaagtttttgggagggcatatccccatacagc

SEQ ID NO: 480557 - DNA, 528 bp, Homo sapiens
cccgggctgtaggaatttggaccaagagctcacaagctagtgatggagggatataaatgtggccatgaccccaatgtgttaacgaggttcagtgctatcaaactataggtattgatgtgggaaccacaatggaatcatgggacttgacgatactctaaaatactttttgttgcagtttgagccacaaccttgcaaaggcaagccacatgttactggtggtacctcagactacttactgtggtgagaattttaaacttgtacagtgttgacatggaccatatatcggcctaatggaaatgggaagagcaacaattgctccaaagtgtgcaaaaatagttaacattcaacttggtttcacatggaccctttagaatgaaccacttcattgcatgctgaaacgacattgttggtcaagaaaccagtttatggcataacgctatttgaagagaccattgcgttatctgagagacagcagatattcagatgtgcacattaacacctcgagtacactatcttcatatagctatt

SEQ ID NO: 480558 - DNA, 1235 bp, Homo sapiens
taaaattttttttatataaccacaaattttcaccaaaaaaacccccaccaaaaaaatttcccctctctcccacacaccaaacacccacacaccaaaaaaaaattctctctctccaatctccccgcggagaaaaaaaaaaaaaaacaaaaaaaaaaaaaaaaaaaaaacatacaaaaaaacaacaacaagaagagagagagaaaagacggagacaggaagcaagcacggagcgacggccacgaggggcgagaggagggaacgggcagggagtcacgcgcgcgagggggttcgaggcagcggggggaattaaagaagggcaggagggggagagggggggggggagagaggagaggggaccggagcgggagggcagagcggagtgggcgagggagggaggaagggacagaagaggcgagaggagggtgggagcagagagaggcgagagaggagagggagacgcggcgagaagaagcacgaggaaagggagggcggcgggaggagacaagcgggggagggagcgggaggaacgaacgagcgtaagaagcgcgtggcaggcgaacaagccaggccgagagagggacgaagagggggggcggcgacagccctggcgcacccaacgcgcccgtcatccgtttcaataaagaaagaaaaagctaggccatacagaacaacgaagaacagaacagcaggcagacgataaaacccagcggcttatctcctcccgcgcctcataccgacagaaacgacatacatgcgcacagaagagagacaaaagatgagggaagcgggcacaaagcgcaaccgaccatgcgaaggcgggagcaggagggcgcagacacagggagaagaacagcacaacgacccccgacacaaaggagagcacgagcagcaaggcagagagaaggaagaacgcggacacacgacgagaggcggcgcgaaggcaccagaccgggcaggcgcgcacggcggcgagggaacgacgacgagaaggcagaagagagccggagggcccagaacgacagagcactaaacgcgagggcggacgggggggacgggaggggcggagacgagaacgacgacagcgacggaagacgcgggaaggcagagaagaggcgaccggcagggcacgcgaggaggcgaggcgaagacgagggagagagagagagagacaagaagcacgcgagacggaggacacagagcaggacagaccagaggcgagagcgggccgaggcggg

SEQ ID NO: 480559 - DNA, 389 bp, Homo sapiens
agagtaaacaccccgtctcataaagaaaaaaaaaacaggtatgatttcttacccaaacaaaacacttagattgtattatgccctatctcttaagatataatggtgggaatagggatatccacaagaagaaattcagaaatctctaagtaagatgaaatacgatgaattcacagctacatatttgtcaatgggggagaaaatcttcagaggtaagagtaatcagaaagagctgaaataccctgtatgtaatttttagttaataataaccggtttcctaagtctataatctattggaatatttgtaacatttgatacatcatttttaagattcacttgcaaattagcaaatctaaatcctatgaatattataagctattttaacttaaccc

SEQ ID NO: 480560 - DNA, 148 bp, Homo sapiens
tccgaccttgacaaacttgaatccatggactgcacatcataaaacgtctgcatcttgcagatacgctagtaagcggctatctacttgcttatccaaagtcctaccttgactagctcactcagatcctcaatgaatcgcgcacattcag

SEQ ID NO: 480561 - DNA, 922 bp, Homo sapiens
tcgggggattctgggccgagatggcagcatgtgaggaaggcgcttccgcggagactggtgggcttgggtccctccgggatgtcagacctcatctatggtgacttgaccatagtgcgggtgaacattgtggtcatgttgtggtccccgaggatgtgatcgtgacccacatatgaaagacgaatagtcgatatgtactccaggtgaaaatcaagctgatagacatgctttctgaaggcaggactctctgttatagaaaccaacagacttgtgtctcctaagtgggttccccagagtgggtgaccacactgaagtcttgaagggcattcagaagtttcctggcatcaactacccagtccgtgaccccaaatttggatagggcttcgaggctagcggttgctgatggagccaaggaagtagtcgattctatgggagctgctcagagatgattgatctaagaagaacatcaatgttccataggaggagagtgtgtcagaggttggacgcaatcctgaaaggagcgcagtcagggcaatatttctgtgcgggggtacagtctgctggtgatcttgggtggcgttatgaagggaagatttcccccaggaacgtagctgaggtcacgagaagtgcgaagcaggggctgtacagaaatcctggggacacaatggcgggggcaccccagggtgcggaagaactgtgcttggtgcgaagacgaatggcccggtggccggggcactgcatgggcgcaggcaacctggacaaactggggggcgaaagcggagctgtcgacaccgggacaaggaggaccaccccgggtgaaaggggacaaccggaaagacagggcacagaccgcacaggggacaaccaccacaaaatctgtaaatcagcgagggaacacgaacatggacgtgagccacgcaaccgg

SEQ ID NO: 480562 - DNA, 1398 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaacccagacaggctgacctatgctgaccctgggagccccgcctggagttcgaggctctcagtgggtgaggtggacattgcctgaggtttggtgccctcggtcctccccagcaagcgagcctgacgctgtccacgtcgtgctggaccgccacctggtcacaggccagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtgtcactgttgactagacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 480563 - DNA, 916 bp, Homo sapiens
cggttcctgttactcttttcctcttgtctatcttcttcttctgtgtttttgcttctttttattcttgtttttatcctgactatttcactattgtttctttaatagtgttgcgttcacctttttgattatgtctctgtttcattttgcatattctggattcttcagtcccaattgcacatttatatacgttgcttatattgattgttcgatgttctttttctctcacgattgattatatattctttttatttggctgggtcatctatgtcgtcttagtttacgcttttttatctacctttcttgtatttgttattcaagcatactgcattttatatcctctcatgttgttaattactatttacatttttattaatttgcgtttctctttttctatcttatttgtttatcttttttatttatatttagcctcaatttattttaaattaatgtcttattcctattttctttatgtatatcatatcatttccttatatttcgtgattggctctttccttcaaagtaaatttattagtctattattgtgatttttctatcataatttttttgctttccaaacagttgattgactatggctctcctacagctaatcatatgtagaagttatatataaggtcttatctagacttcgtataaatttattcgctattatagtaatatatcccctccttctaaatattataaagctctgattgtacaagaagttacctgtgctagtctagttgttgtttttccttgaacaactttggataaaatggatttgacagtacataatcagttctactaaccaccaagcttgtatttggaaatttactttttgtacaaattgaattatataatgcttgaaaatactgtggtcaacttataagcagatgcatagtaatcacttgttatactg

SEQ ID NO: 480564 - DNA, 270 bp, Homo sapiens
caagcaggcccccacctgcccttagtgatgtttggagtcgttttaccctcttctattgaattgccttgggatttccttctccctttccctgcccaccctgtcccctacaatttgtgcttttgagttgaggagccttcacccctgttgctgggggaattgttgaattcttcctttcacctcccgcccaatccccgcggaaaaggttttgaggccccccccttgttcttgaccaatcaggtttctaattaaccaactggcccatcaaaaaaa

SEQ ID NO: 480565 - DNA, 1247 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctgctcttcctctgtggcagccggagcagcagcctcctgccccaaggccgaccggcactggcagcactttcctgttgaagaaatcttcctggcgtgtggtttcaaagtggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaagttattttaaaaaaaatggtgatggctggtgagtggatttacagtgagtaggtcggagctttgatgctatggtctacactcgttcgaaaaggggcacctgcggtgggaaaccgcgtggaaccgcggggattaaggggaagggaagagcgaattgtcaagaattggacaaaaaggggt

SEQ ID NO: 480566 - DNA, 102 bp, Homo sapiens
catcttggagagagaaaacaatggagttactatatttagaaaaataagaacagaaacgttatctcttcccaggagaggctagaagtagcttctctgtctttt

SEQ ID NO: 480567 - DNA, 690 bp, Homo sapiens
gctggcccccattactttgtacaggcagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtgtcactgttgactagacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 480568 - DNA, 305 bp, Homo sapiens
ccagggccttatttgggcctgggggccctaaaacactcctcctcctgagcctactgccaaacgtcctcagtgttgtttgcccctggtcggaatcctttagccgccccttaaggggcccctccgttccagtgccccccctttggggccaagggggccgtccctttttactttgtgttttttcccccctttggggaatttggccctgtttgccagtcccagcccccccgttttttcctttttagttgcatgggtttttttttgttcatggaatgttttttcctttttaaatgttggggaaatcccca

SEQ ID NO: 480569 - DNA, 1327 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacaggggcctgggcctgtctcaggagcccccaccccgctcccgcagccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtgtcactgttgactagacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 480570 - DNA, 564 bp, Homo sapiens
gcttgtatataggttttatctctggttgaatccctcgaacaatagacagtacctttccccccctttcatggcccattttatgtctgcctttcagtactaagtatgaccgttcctatctcagatcttaataaagaagaaaaaaaaaaaggcattcaggttaaattgggccttaattaatatactggttagcaagcgtgtgtgacagagagtggggaaagctacgatcatggaatatttggataaacttgaccgacattgagttgggttgattgttcccttttcctaaattaatagacactgacggtaatttatgtccctgtttgcacgtctctccccttcacattctggccaggagtttaagctatctgagatcggggaccatcagttgtgcactttagagagtgtctctggatctaaacctgtttatcagaaaagtggtttatctggatcttagtgggaaaaatctggcaatttacacagaattacttggttagacccaaagaatatagccccgttgtgcaactgtcgattcaggaaatttagacaagacaagaaatactggag

SEQ ID NO: 480571 - DNA, 694 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcagctggggcagaggaggaaagcaagaggacagacctccagaagagcagcggagggcgggtgaggatttccccatataccagtgtgtgttcatctacccatgaggaataaaaccatgcagcagca

SEQ ID NO: 480572 - DNA, 346 bp, Homo sapiens
ccggtaaatgtagatactgtgacatttcctgagtacctactaggtgcctggcactgtccttaagtgctgaaggcacacgggaagggtgcagactctgtgaaggactgtttcacggcctagtgtggggatgtggaatgaaagcaggcagtgacaacgcagtgtggcctatgtcgtggaccgggggaacctgaggaggcagctaccgcagcaccagggatttctgatcgtgagtgatgtgaatgtactggacagtggtgatgagaacacaatagctgaagtgcatggcatatgatttacatctcattaaggaagtgataaaatagaaagagcctagtctcctggtgag

SEQ ID NO: 480573 - DNA, 1029 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcagctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaagttattttaaaaaaaatggtgatggctggtgagtggatttacagtgagtaggtcggagctttgatgctatggtctacactcgttcgaaaaggggcacctgcggtgggaaaccgcgtggaaccgcggggattaaggggaagggaagagcgaattgtcaagaattggacaaaaaggggt

SEQ ID NO: 480574 - DNA, 171 bp, Homo sapiens
cccggagtgcgtgacctggcctagtgctgggtaccgaggctctttgaaatggctttctttttcttataagctgctggatcattgacttttggccatctgggttccatgaacacagggaaccactgtcctctcagagtagctgaggcaagaggacattccagaggcacccac

SEQ ID NO: 480575 - DNA, 780 bp, Homo sapiens
  misc_feature (77)..(77): n is a, c, g, or t
tccacctcctgggttcaagcgactatcctgcctcagcctcccgagtagctgggattacaggcacccgccatcatgcncagctaactgttttatttttgtagagatgggatttcaccatgttggccaggctggtctggaactcctgacctcaggtgatccgcccgcctcagcctcccacagtgccgggattacaggcatgagccactgagcccagccagaaacatattaatactataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccaggctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaag

SEQ ID NO: 480576 - DNA, 176 bp, Homo sapiens
acatgtaaggagcactcttctcgctgtaaccgcacattgctgccagaccgtcatcgatgaatctctcctagctaacaattaagagttgcaggattgagattaaaaataacacattgggtaaatcacgctcttctatttcaatgtctaggttcactattgcattccacatttggcgc

SEQ ID NO: 480577 - DNA, 1135 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcagcagcagcctcctgccccaaggccgaccggcactggcagcactttcctgttgaagaaatcttcctggcgtgtggtttcaaagtggcagggtttgggcaggcaccaggctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaagttattttaaaaaaaatggtgatggctggtgagtggatttacagtgagtaggtcggagctttgatgctatggtctacactcgttcgaaaaggggcacctgcggtgggaaaccgcgtggaaccgcggggattaaggggaagggaagagcgaattgtcaagaattggacaaaaaggggt

SEQ ID NO: 480578 - DNA, 443 bp, Homo sapiens
ttctttattcttcaattttcaaatgctgaaaatagaataaattccattttcatgatgtattgcccttttcatatatccatgatgtattgcccttttcatatatcaatggatatagtttgctaatattttgcctaagatttttggatcataaggaggatagacctagactgggtgtggtatctcacgcctgtagtcccaacactttgggaggccaagaggaaggattgctttagcccaggagttggagaccagcctgggcaacgtggagagacctcatctctacaaaagattaattagccaaggatggtggtgcacacctgtggtaccaaatacctgggaggctgaggtgggagaatcacttgagtccgggaagcagaagttgcagtgaaccgagattgtaccactgtactcccacctgggcaacagagcaggagcctagcgtt

SEQ ID NO: 480579 - DNA, 1069 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacaggggcctgggcctgtctcaggagcccccaccccgctcccgcagccctctgtgtgtgagctcgtcagggcccccggcttcgcccgcctgccgctcgtggtggaggacttcgtgaaggattcgggcgcctgcttcagtgcagctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaagttattttaaaaaaaatggtgatggctggtgagtggatttacagtgagtaggtcggagctttgatgctatggtctacactcgttcgaaaaggggcacctgcggtgggaaaccgcgtggaaccgcggggattaaggggaagggaagagcgaattgtcaagaattggacaaaaaggggt

SEQ ID NO: 480580 - DNA, 348 bp, Homo sapiens
ccattggtccgagagaaattagatgcatcacctagtattttacaacagtagccattaatcttgttgcgttcatcaacattaactgtgtttgctttcattacgctgctgtaggaatcagttctttctgtagtggttcaatcgtaatgcttattgcgaaatgtgcaagttccttttgtacatttacaaaagctttatttactctgttaactttttcctcattcataatgtttatcttcttaagattagtggtaactggttttgctttgtttttagccttaaagtttttttggctggctatgtgaaatacattcctggacttcggccctcctaatttctctcggaccaatg

SEQ ID NO: 480581 - DNA, 651 bp, Homo sapiens
taaatgtgtgtcccataatagggggtcacagcccacactccatgagactcttcacagtcacacaatgggggttataagcgtggagaaaaagtgctttgtggtttttcgtgtgtataaccacagatcacattcctaaggcggaaaaagtgttttttttggtgtctgttgtgcttttaaaattaaggttaatttttaaaatcttaagttttccaccacttttctaagagggccaccctgagcacacaagtgccccgtaattctgagaggtttagcacttctccacggctgaattctggaaagtgtgctaagtattgctccctaagtggagtaaaccctaaatcttttaatacacgtgtccgtgcattcccctcttgtctttcagagagagagaaggtggcgtacagccacggcgataacactatcccctgtgtgcactaagagggtctcttcaagtgtgaagcttggcattccatcaggtttttctaaagtctttgctcaacaggtcaaccgttaaaatgatgttagacacacaggtcccagtcagttccctttattttcacccaattttggtcacaagccatattggcccgattagtggtagctgtttgaatcacgtgtgtgatcccaataaaggtaactgctgaccactta

SEQ ID NO: 480582 - DNA, 919 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgccgctcgtggtggaggacttcgtgaaggattcgggcgcctgcttcagtgcagctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaagttattttaaaaaaaatggtgatggctggtgagtggatttacagtgagtaggtcggagctttgatgctatggtctacactcgttcgaaaaggggcacctgcggtgggaaaccgcgtggaaccgcggggattaaggggaagggaagagcgaattgtcaagaattggacaaaaaggggt

SEQ ID NO: 480583 - DNA, 167 bp, Homo sapiens
atcgtgattgagtgagggacactggaagaggtagctgataggacacgatcgggtgctgcccgttatgagaatggtggatgcacgaaatggacatcgtggaggggcgcggtctttcctgacgcccagggcaacgcccgccgtagcacatataaaaactggagttttag

SEQ ID NO: 480584 - DNA, 434 bp, Homo sapiens
  misc_feature (23)..(23): n is a, c, g, or t
  misc_feature (30)..(30): n is a, c, g, or t
cgggttccaagtataagcctgcncccctgncacatctccccagtaccctcgaccctgccgagtatgacgtgtctccggagaccagaagggcgcaggtcgagcgcttgagcataagggcccggcttaaacgggagtatctgcttcagtacaacgaccccaaacgcgtgtcgacatcgaggatcctgccttgattcgctggacctatgcaagatcagcaaatatttatcctaatttcaggcccactcccaagaactcacttttaggagctgtggcagggtttgggcccctcatcttctggtattatgttttcaaaacagacagggacagaaaggaaagacttatccaggaaggaaaactggacagaaaatttaacatctcctactaagttcggcaaggatgactattcttgcataaataaatctcctattaattaa

SEQ ID NO: 480585 - DNA, 289 bp, Homo sapiens
gtcgctgcgagaatcggcatgtaccaccatgcttggctaatttctgagaggtatatatacctgtgagatcgaggtcttgctctgttgcccaggctggagtgcagtggcgccatctcggctcactgcaacctgcacctaccaggctcaagtgattcccctgcctcagccttccgagtagctgggattacaggtgcctgccaccatgcctggctaattttttatatttttagtagagatggggtttcacatattagccaggatggtcttgatctcctgaccttgtgatctg

SEQ ID NO: 480586 - DNA, 294 bp, Homo sapiens
  misc_feature (132)..(132): n is a, c, g, or t
  misc_feature (265)..(265): n is a, c, g, or t
agagactctgtcaaaaaaaaaaaaaaagaaaggaaggaaggtaggtaggtaggtgggtatttggggccagctggctgttaatcccagcacttggaggctgaggtgggtgaatcacttgaggtcaggagtttnagaccagcctggccaacatggtgaaaccctgtcactactaaaaatacaaaaattagctgggcgtggtagtgccacttgtaatcccaactactggggaggctggaacctcggaggcggagattgcagtgggctnaagatcgtgccactccagcctgagtgaga

SEQ ID NO: 480587 - DNA, 980 bp, Homo sapiens
  misc_feature (75)..(75): n is a, c, g, or t
  misc_feature (98)..(98): n is a, c, g, or t
  misc_feature (143)..(143): n is a, c, g, or t
  misc_feature (148)..(148): n is a, c, g, or t
  misc_feature (162)..(162): n is a, c, g, or t
  misc_feature (175)..(175): n is a, c, g, or t
  misc_feature (187)..(187): n is a, c, g, or t
  misc_feature (239)..(239): n is a, c, g, or t
  misc_feature (269)..(269): n is a, c, g, or t
  misc_feature (298)..(298): n is a, c, g, or t
  misc_feature (300)..(300): n is a, c, g, or t
  misc_feature (308)..(308): n is a, c, g, or t
  misc_feature (338)..(338): n is a, c, g, or t
  misc_feature (340)..(342): n is a, c, g, or t
  misc_feature (354)..(355): n is a, c, g, or t
  misc_feature (384)..(384): n is a, c, g, or t
  misc_feature (389)..(389): n is a, c, g, or t
  misc_feature (419)..(419): n is a, c, g, or t
  misc_feature (421)..(422): n is a, c, g, or t
  misc_feature (438)..(438): n is a, c, g, or t
  misc_feature (455)..(455): n is a, c, g, or t
  misc_feature (458)..(458): n is a, c, g, or t
  misc_feature (463)..(464): n is a, c, g, or t
  misc_feature (471)..(471): n is a, c, g, or t
  misc_feature (477)..(477): n is a, c, g, or t
  misc_feature (489)..(489): n is a, c, g, or t
  misc_feature (510)..(510): n is a, c, g, or t
  misc_feature (518)..(518): n is a, c, g, or t
  misc_feature (520)..(520): n is a, c, g, or t
  misc_feature (923)..(923): n is a, c, g, or t
gaacttcagtgcttttcagagctggataaatcttaattactaatgccacacagaaattatacaatcaaactaganctgaagcaaaatttaagaaaaanatcaacattttttgtgctttaaactgtagtagttggtctagaaanaaaanactccaagaaaaanaaaattttcaaanaaaacccaaaanaaaagctttgcttagccctgttagggatccattggagcattaaggagcacanatttttattaacttcttttgagctttcaangttgatgtaatttttgttctctgtgtaantnaggtaaantgcagtgtttaacaaaaaaaagtttaaaanannnagttgtcagtannaaaaaaacctggcattaaagggaaaaaanctccnagaagttagattatttgctactgtgagaananngtcaccactggaagtnactttagttcatttaanttnaaaannaaatttngtgaanattttaagaacngtagagctgctttcaaaatcnagaaaaantnaaatgagtgtaaacacaccaaacttaaagaaaaagaaccgcttgtatgattttcaaaagaacattaagaattcaaaagagtcaaaactatagcgaaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttgggatattccctcaaatccctcctcttactccatgctggaaggagaagtactctcagatgcattatgttaatggagagaaaagcacagtantgtagagacaccaatattagctaatgtaatttggagtgttttccattttacagttta

SEQ ID NO: 480588 - DNA, 1123 bp, Homo sapiens
gggcgaggggcgtgttgtggagccttggcaaggcgctgctcttcctcgcgcctcggtttgcggtctgtgaaatgggtgttggcagtgcctttgcagtgtacgcggcgaactcaagcaccagcaagcggactcgaactcaaagggtttcagtgatgtagacgaccagagcgcactgagtgggctccatggtcggcccgctccggagccgggagatgtaacctgcgtgcagggaaatggctgcacggcagcctcggtgcctcccttccctccaccggacgggtgactgactaggggtgaggtcctcacctccaggctgcgcagctgagttctggaagcttgcgtcaacgagatggcccatgggacaagcaatgagccaagctgtggccagagcccgtttcacttgacccatgaacacatggcccttcgggaaaccctggaggaactgcgaggggcttattaatgcggctgaggaagaaacgttgaagagccccgtactccatcctctctaccgttcgcaaatgagccgacacaggagccacttcaagcggtagtacgaccccagatggccgcccttctgaagcacggtgtcacgtggcccaggtctgacggttcagacggttagagagtacacattaccattgaacgttgggccataaagtaccgacagtgggcggaggcataattctaaaagaagaacaaggcgtgcccgatgggatccgtacgcctggaaacccttggccatcaagcctagacgcgcgaccaggcgtccggaggaatgggacaacaggcgcaaaggcccagcgtggcgggtcacttaaagatcccaaaaaaggcacgtgacacgagccgcgaccggtgagcgcccgatgaagcgagtagcgtggcacagccagggaaacagagcgggggcaagggcaggagcccgttgacacgccaagcccagcgcgtgtacagacccacggcagaaagccacagagcggaggacaccagaggagaggtccagaccaggagacaaacagactgagccgcacccagagaaaggcacggcatgaagggggaaacgcggccaacggaacacggagcgagagtcacgacaccgagagagggcggcagaggagcgccc

SEQ ID NO: 480589 - DNA, 431 bp, Homo sapiens
  misc_feature (107)..(107): n is a, c, g, or t
aagttggttaacagggtgttggagggccccctcaagggcatttgtggttcactgagccccaggtgtttttttttgatttaaacagggacccccattcctcccccttngaggttggggggggcattgccctcaaggacccttttgtcaagttcttttcttggtatgccaaagaatttggttacagcaaaagggtggtggcccttttggcccccatggcctccaggaggttaaacccttggccccccggccccagcaagggcccaagaggaaaaaaaagcccctccctgttggggggtccctgccacattcagtccccccccccattgattttcccctcttcccagtttccatgtagcccccttaaaaagggggggggcctagggacccgcccctttttatgtcccatcaataaagtcccctgtgttcaccca

SEQ ID NO: 480590 - DNA, 969 bp, Homo sapiens
  misc_feature (282)..(282): n is a, c, g, or t
  misc_feature (588)..(588): n is a, c, g, or t
tcgagaccacggtgaaaccccgtctctactaaaaaatacaaaaaaaattagccgggtgcggtggcaggcgcctgtagtcccagctactcgggaggctgaggcaggagaatggtgtgaacccgggaggcggagcttgcagtgagccgagagcgcgccactgcactccagcctgggtgacagagcgagactccgtctcaaaaaaaaaaaaaaaagaaaaatttctctttaggctgggtgcggttcctcatgcctataatcccagcattttagggaggctgaggntgagctggattgcaggagcctcaggaagtttcgagaaccagcctgggccaaggttggcaaaaccccgtctctactaaaaaaaattagctgggccttggtggccaggcgccctgttaattcccaggtactcgggaaactgaggcaggagaatttgcttgaaccctggacaggtggaggtttgcacgtgagtttgacgatcacacccaattgcactccagccagggtgcagagttgcagcagcacgtggtcctccaaaactaacaacaaaaaaacgcaagagaacaacacagtttcttctcttatgancctcggtgagaccgggcaagttcccagaagataatccctttcaaccaagaatttaccccggtggttcccaggtgtgacaactgtggtgacgatgtgaagcgcccgttgtgaaacccccttaaaaacagtgggaactagtgggcaacccaaggggggcaggggtcctattccgcgcaagcctttaaagcaaggttgaccttttcactcacaacccagggggaaactttcccctaacacgcggggttctacaaaacaagcaaaaccactagacgatctgccacagcaccaccacacagagcacgggggcgcgccgccctctatgaagaagaaactcccctcctactagggtgggccccaacgatcctcagacgcgaggaagcc

SEQ ID NO: 480591 - DNA, 199 bp, Homo sapiens
acggctcagtcataacgagtatacggagtgttagcacggatgctcacgtttcgacggaacttgtacaggcaggcatgcaccgcagtggtgaatacacgtctgaccaggctccatcttaacgatatgaggacgtcctcacggtgctcacgtgatcgacggaacttgtccaggaaggcatgcaccgcagtggtgaatacac

SEQ ID NO: 480592 - DNA, 301 bp, Homo sapiens
aacatctgctgctgtaaaaaaatacaaaataagctgggcatagaggtgcatgcctgtgtctctagctatgcgggagattgcttgagcccatgagattgaggctgcagtgagctgtgatcgtgccactgacctccagcctgggggacagagcaagaccgtgtctcaaaaacaatttagtctgaaacacaatttgtgcttgaatctgtcttgactataactctgaccacacatgaaccagggctgcccctgtaatccccacagtaagaaagttgtattggcatattccaacaagtatttggtt

SEQ ID NO: 480593 - DNA, 398 bp, Homo sapiens
aagcagttaatacagactcaacttttagatgagatccgggaaacaagtgagtcaaaacctgtgaacactagcaaagcctttccttttcatttgatgtatagtgtgtattaagacaccttttttaggctgggcacagtgtaatcccagcactttgggaggcggagacagaaggattgcttgagctcaggagttcaagaccagcctgggcaacgtagtgagacccccatctttacaaaaaatttttacaaattagctgggcctggtggcacacacctgtagtcccagctatacaggaggctgaggcaggagcatcacttgagtctgggaggtcgaggctgtagtgaagcatgattgcgccactgctttctagcctgggcaacagagcaagaccctgtctc

SEQ ID NO: 480594 - DNA, 310 bp, Homo sapiens
aggatccaggcaaagctctaattggagttatctgttacagtcatgatggctagtctcctgttctgtgttgactctaggaatctgttgctaatatgaagagtatggaacattcgtatagtctctgtgccgcatgcggggagggcagaccattctttttcttataggcttaatgctcacatgtcatagtctcctttcacagaattgctgtgcattataaatgcacgcagcttaagtagaagacattgaaggatgcattaatttcgcggaactattctgaatcatgaaaagatacccacttgaaacacattat

SEQ ID NO: 480595 - DNA, 447 bp, Homo sapiens
tgaaacaaacgtaccctgtgctcttgctaagtgggaaggcaccagcctgggagtggacaagatcacaggtgaacccctcgaggcacagggatggcaatgccgccactgaaggaggtccgaggagggaggacaggatttagaactacagcgtcagcactggaaagagggggccagatcatgtggagaggcagaagccctaaacacagtgctttgtccagacattgaaacttgcttcacgaagaaagggaaaagatctgagggtgctgccacgtccctgtaatcctagcccctggagagtgaaaacaggtgtaccggaaactctaggccagcctcacgcatacagggaactctatcaggaaaagaggggctgagtgagggctctttgggtaatagagcttactaacacagtcatgaggacctgagttctaatccctagaatccacgttt

SEQ ID NO: 480596 - DNA, 175 bp, Homo sapiens
gagactctaaggatccccgtcggcgtggtacaccaaagcctcttcgcgtcttcctctcgtatcccccaccttaacccacaagtatgggacatctctactccttccctggcaactgatcacatgcccattaccatcccgttaaaacctaatcacccttaccccgctcgacgccaac

SEQ ID NO: 480597 - DNA, 451 bp, Homo sapiens
cttgcgggcctcatataacgcacgggcaataaatcctccttaaaacatgtcatccctttatacttgagaacttcacagtcttaatggccagtccttacaaaatgtgcataggattaagtatatttaagagagcagacaaacgaaacatattgtaaaactagtattctccagaagcgattgccattctcttccttccgtcctgcaatctggtgtctgatctttagctagtgctctgtcatcccataagaaagctgaacagaggtaaaaacatccagtctgcttgaattccctgagtgctacagattccggtgagatggacggtcatacataacagttccaatgctggtgtggtaaagggagaacataaataaactgggtttctgcaggttagtgagatgacatgatgaagaggaataaggttgtccggcagtatgattaggctcgtgggtgc

SEQ ID NO: 480598 - DNA, 182 bp, Homo sapiens
gttgctcatcattggtatatcgtcgagtgtagtcggttagtactgcctacgtatgaggagcgttatgagtgaagtgaaatcacattgctaggccggagtaattaggagggctagagagggcccctgtaaggggtcatgggctgggttttactatatacataggcatagtacattggtgggac

SEQ ID NO: 480599 - DNA, 515 bp, Homo sapiens
  misc_feature (80)..(80): n is a, c, g, or t
tatttccacagggtccacgatagaaccgcttccggccctcgctgtcgcctctaacaagttctcagtcaataccaatgatngatgctgactcagccctgcgtcactgatgatgtacatgatgaaacaggatgccagtgtgatgtgatcagtggatgaccatcaccccaccaataaaaactgtgcatccgagctatcagaattttgaaatttcatgttgctaaccggaggttttgggatgcattacgtccatttgatgtataagatgtcgttgaacaatattctgctggtcatctagggcatgttgtgttgaattatatgccttcaaatcacgtgttgatcaaagtcttggaaaagggtcgaatcacatcagatgataagagccgatataaaatagcagctgaccatgagaccacatacgatctcagtatgctcggccggctggtcaaggttgaaaaacaggtaccctgcatagaattcaagctggacttgctactatacctctatcaatgggtcct

SEQ ID NO: 480600 - DNA, 423 bp, Homo sapiens
  misc_feature (162)..(162): n is a, c, g, or t
cgatctaagatccactatatgtacttcatctataccatcgcaagcaagggagtagtaaatgggtcttgttcactttgtctagatattttcctcttgcattttcttatgttctccttgcccatagcttcatgcttgtcattcctttccattaaactcctggtntcttgcttccatcatcttctttttggttgtgatcaaagctttaagcttataaatactgtgtatgatgtacatttatcctgtgtgttgctattgtacagtactgaccacatgacaaaacaagaaacagtcaggaggtaggggagtgggttgtcatagcaacagactgatttgcaaaatgtaagcagtctgcagcagtgcaaggagaggaaagagcatgtccccaaagtgtcataaatctgtctaaccgcagttgatgcatga

SEQ ID NO: 480601 - DNA, 450 bp, Homo sapiens
aggtagatggagaggccggtgaatctgggcttatgggatacagctggacaagaagattatgacagattacgccccgctatcctatccgcaaacagatgtgtacttaatgtgctttcccattggtgagtcctgcagtcatttgaaaagtgtccagtgcaaagtggtatcctgaggtgcaggacaccagtgtcgccaacactccgcatcgatcctagatggagaactaaacttgatcttagggatgataaagacacgatcgagaaactgaaggagaagaagctgactcccatcacactatccgcagggctctagccatggctaaggagattaggtgctgtacaaatacctggaagtgctcgagagcaacaacacagcgaggactcaaagaaagtgatatgacgcaagacgatccgagcaagtcctctgaccacgaactcccggtgcaagaat

SEQ ID NO: 480602 - DNA, 441 bp, Homo sapiens
tggcatcaaaaagcttatattcccattgggcccaaggcttgtaggatagttaaaaaagctgccaatgggctggaggaagaggctattaggaagaagccctataatttggcaaggggcccttacaaaagtcgctgggctcaacaaggctcttagtcgtgcttgaaagtgagcctttcgaagagatactcgcccagcccagcctcggggccacccagcctgttggaggtgggctcagggggtcaccccatcttctgtgataagcttcacttcctccatctaggaagtgagtctccaggaagtcaccagagcatgggggtccgtgcgggcagaaacccagggcatgaagatccaaagagggccgtggtatcagcttttcctccaggccagggcgagcttccagtggcgtctggggtttacgcccactcatcttcagcgggctcc

SEQ ID NO: 480603 - DNA, 454 bp, Homo sapiens
taaaaattctcgtttttcaaagtaaagaaagtgtctgtctgtagtttaaagataccacttctcagtttgtgcaaacagctgtcgcagaagtatcacattggtataggcagtgtttatgagctcatattccacctcactatgaacctcagcttgtaatccattgaggtcttcagagatttcatatatggtgaaggtgtcctcccacagcttgctctctttgaggtcttgaaagcaggaatctacagttttgagtccaaagcctctctttgagcgagcaaagcgcatatatttaataacttcttttagatggtgctcatttaggccaatctttgccatggcggcagacagcggcggcagcctaaagaacgggaagagcccaggcggtgccccacaaagcctggtatcgcgagtgctgatgacctagctacctcaagaggattactgaaccgtgcca

SEQ ID NO: 480604 - DNA, 460 bp, Homo sapiens
  misc_feature (30)..(30): n is a, c, g, or t
  misc_feature (41)..(41): n is a, c, g, or t
  misc_feature (458)..(460): n is a, c, g, or t
catttaattacccccgacctcaattgaggnccctactgtgnccccaatagggtttggggctgcagggcaggccagcaccgaacaaaactgatgaaactcttccctcatggagatccttaccgtactgatgaagacacacaataagtaatatcattataaataatacaggggcccaggcacggtgacccactcctataatcccagcactttgggaggccgaggtgggtggatcacctgagttcaggagttcgagaccagcctggccaacatggtgaaaccccatctctactaaagatacaaaaattagccagaaatggtagcgggtgcttgtaatcccagctacttgggaggctgaggcaggagaatcacttgaacccgggaggcagaggttgcagtgagctgagaccgcatcattgcactccaggctgggcaacaagggcaaaactccatctcaaaannn

SEQ ID NO: 480605 - DNA, 268 bp, Homo sapiens
gatcacctgccaatttctcagtcccttcctcccaccttaatgatcccaaccaggtaagtcaactacttcaactaattccactaccaggcaacagacttattgcttcccaagaccactactccctttttctgaacctcatcttcaataatccccaatactccccactattctcacacccaacaaacaacaagggggcgctaagattatgacccccccgagaactcactggtggtatttttgacaaccaaaacccctcctcctattactg

SEQ ID NO: 480606 - DNA, 93 bp, Homo sapiens
ctgaagtgggagcggccgtatctcatctctccgcaccaagatggccctgctatccccagcattggccatcttggtgcggagagatgagatacg

SEQ ID NO: 480607 - DNA, 165 bp, Homo sapiens
aacgcctaaggtgctctgaggattgaataagataacttaaaatccccagatgtcagctgaggtcactctgtcctctaagttttaataaaattgacgtttcctatctcacattccatgggaaataaatgtcctcccaaggttctgtggacgtcagaagcttaaatc

SEQ ID NO: 480608 - DNA, 154 bp, Homo sapiens
atagtgactaataaggtacactgggagtctccagaggcagaaggggacccgaaaaatagtataaagaaataatattggaaaatttccaagtttggctgggaacagtggctcaaccctgttaatcccaacacttggggaggccatggtgggtgga

SEQ ID NO: 480609 - DNA, 910 bp, Homo sapiens
aaaaaaaagcgccgtggggacgcgtgcccgtcagcgagacgccctgaggactctgtgcgaccacaaggggtaaaaagccttcggaaacacagagcaggggtgtctaacgacgttaaagagctagtcgccaatcatgtggggcgggaaccgcaacaaaacaagacccacgtcgtttcccacgggcggcacagcgctgtcccggccggtcgccagggtgcgccccacagcggtcggaccagcaggccccccagtaccaggaccccaatggggaccaccacagccttcctcagcggaaaaaccaatgctggcgcgccccctcttaacgagttctcacgtaacaggtaacgccggcgagtggccccggcctccacccacagggtatccgggacaccgtggaccccagcagtccggctatcagcaagagaaaagtggctggccacccacatctggggggagggcgggccacccgaagacggctatgtggacgcaagcacgccttgccacacggacagaacttgaaaccccccaggggcgtcctcgcgaacaaaccagtcggcacgcttccggccaccccgacaagaccaaaggagagagattaattgtgcgcgccacaaaaaccacggggccccacccacaaacgggcaccccggctgccgcgtcaaccgcatctgaaaacaagggaactactcccagtgcgcctctacggggcacgaacagcgatcgctgcggaaaacagatggtccgggacacaagaagcacagcccacaactagagggcaccttcccgatcggcaaacacaagggggcactcccgcggctgtctaatacaaagggagagagccttcaggcccccggagcaacaccccgaggccgttttccgggcagagaacaccccccgaaaaaaaaagaca

SEQ ID NO: 480610 - DNA, 804 bp, Homo sapiens
aggttccccctgtggagctcccctgtccagcccctctgtgtctcccagagtagggtctctgttctggtctccctgtttcaagaatgtgtagttcgagcctcgccaagcgtgaaagttgttccaattcgtgcataggctttgtaggcctttatctggcaacacaggactacgttttaccagcatggtaggtccctgagctgtctgcagtagccccatgtgattattctgcagttcccagtccagcctccgacatcggggactctgccgtaactcggaatcgtcataggtcatactctgaaatcttcaatggtgtaccatgccaccaaccgtggctgcatagggagcagtagtcactggcatgactcccggcctagggcccccaggattctaggatctccccaggcagcctccattgtggacatggtcccggagtgccttaccaagcacagtctccatgctcccagattcatcgaccttcaccccaggcccagggaggtgcagcttgcgtcatgcctctgtcgtgtgtgctgatttgagtggctaagcttgccacagcgcaacctcttctgtccctttcagtcattttgctgtacttccctgtggcacgttaccatggaagccgctccagggtgggtcagggtgcaagctgctggtgaggtttggaagcatctaggctcacgggtgttcatgtgtgttcgtgcagtgctgtgctgtcgtacagtgtatataacatgaagctgtcatgtaccggaatgccctttgctagccatgggctggtcaatacctcgtgggtatgcccgccca

SEQ ID NO: 480611 - DNA, 194 bp, Homo sapiens
  misc_feature (2)..(2): n is a, c, g, or t
  misc_feature (101)..(101): n is a, c, g, or t
  misc_feature (184)..(184): n is a, c, g, or t
  misc_feature (189)..(189): n is a, c, g, or t
gnacggggtttcaccgtcgttagccaggatggtctcgatctcctgacctcgtgatccgcccgtctcggcctcccaaagtgctgggattacaggcgtgcacncgcgcccggccaaagctactcttttctgtcggcccagtgtagcatctggcggttttcttctctccaccctgctcctccgaagngcggnggttc

SEQ ID NO: 480612 - DNA, 105 bp, Homo sapiens
tatatagctgcccctgttattcgtgtcagtgcaaacagacgactcacatacttcatagacagcacgtgggtggcgcagccttggtaacgccatggactgcagggt

SEQ ID NO: 480613 - DNA, 269 bp, Homo sapiens
  misc_feature (27)..(27): n is a, c, g, or t
  misc_feature (92)..(92): n is a, c, g, or t
  misc_feature (189)..(189): n is a, c, g, or t
attattatcttatactcaattaatctngagtaatctcgataataataaaaatacccgcaaacaaagatcacccagctactaccatcattcangtagcacaactatatattgccgctaccccaatccctccttccaacataactccaacatcatcaacctcatacatcaaccaatctcccaaaccatcangattaattactccaacttcatcataataattaagcacacaaattaaaaaaacctctataatcacccccaatactaaaaaa

SEQ ID NO: 480614 - DNA, 413 bp, Homo sapiens
gggcagctgtttgaccctgccccggcctgctgtgagcccatccttgatcacaatccttatcccaagctagtgagcaaatatgccccttcttgggcccagaccccagagacaggctgggcagcctatgggggctctcggaactggaatgtgcccctggcccatctcagcctcctgagcctgtgggtccccactcaccccctttgctgtgaggaatgctctgtgccagaaacagtgggagccctgaccttggctgactggggctgaggtgagagaggaaagacctacattccctctcctgcccagatgccctttggaaagccattgaccacccaccatattgtatgatctacttcatagctccttggagcaggcaaaaaagggacagcatgccccttggctggatcagggaatcc

SEQ ID NO: 480615 - DNA, 232 bp, Homo sapiens
agatcccctgtcacgccatgtctatatctatgggcacaagcactattcatgacacaaaatgttcacacccatcttttattttatttgtaaaatatggcatattttacaatgtaataatcaagctaaatatgacacagataatgccccgttattccttccacctacacaaaacagcatgatacatgggagcacatcatgcaaaatccttccgtccccaatcacctgaatttca

SEQ ID NO: 480616 - DNA, 302 bp, Homo sapiens
  misc_feature (295)..(295): n is a, c, g, or t
gaccgaaagcttactagtgcagtctcaaaaacaacacacaaaaaaaccaaatgttcttgccaattcttccatttaatatttaattttgaattatattggtatctttctaagggatggtttcttatataagcaaagatttttcagtgctaaacatttacgactggctattcagaaatgggttatttacaagctctttttggttttaagcaaaatgggctgttcaagaaaatttaaattagtatataaagccacaacaaacatatttttggcttatggatgctctggttttgcagancttcttc

SEQ ID NO: 480617 - DNA, 684 bp, Homo sapiens
  misc_feature (262)..(263): n is a, c, g, or t
tgctggaaaaaaaaaacatgtgcccaaaaaaccctgattctccaaaaacctaacctgttaataacatagcttatatgggaaaaaaaaaaataagggcttgcccactcagaatggatacagttgggtaatcggatgcctaacaatcctaataaaaattcaagcccagttaaaagagatgttaaattcctagttaatagaagctgaacagattgtgctgtgttctgaccataggacacagtggaactattgctgctgttaatcnngactctgtcctatgaatactttctggaagtgtaaggaattgcattttaaaatgttgttaaaatgagtaaaggaagtctcagttaacaatattaaaaaatcatgtggataataggcacttaaatagtggaagaatgcacagagaaaaatgtcttcctgtgttatcccattcttacgataggtcccatctttcagactgaaaagcctgcattctcctgttttattctttggagatctcttacactgaagatgtttaagcagaatcttacttccttcaaggaacttcagaaagttgatgattacaattctaatggagttactttttcttcagtggataatgtttctgaaattataccagcaggatctaatacaaaagccaggggtttatttaaaaaaaaaaaacaacacacaaacaaaaaaaaa

SEQ ID NO: 480618 - DNA, 586 bp, Homo sapiens
gtcacatgacatctgccaaaagcaatttacaaattcaatgcaattcccatcaaaaataccaccattattcttcacagaactagaaaaaaaaacttaaaattcatatgaaacaaaaaaaagagcccacatagccaaagcaaaaagaacaaatctggaggcatcacactaccctacttcaaactgtactataaggccatagtcaccaaaacagcatgatacgggtataaaaataggcacatagaacaatggaacagaatagaaaagccagaaataaacccaaatatttacatccaactgatctttgacagagcaaacaaaaacataaggtggggaaaggacaccctattcaacaaatggtgctgggataattggcaagccacatgtagaagaatgaaactggattctcatcttaccttatacaaaaatcaagtcaagatggatcaaagacttaaatctaagacctgaatctatacagattctacaaggtaacataagaaaaatctctctagaaattgagttaggcaaagacatcaagaccaagaatccaaaagcaatgcaaaaaaaacaaggtacaagttggccttaa

SEQ ID NO: 480619 - DNA, 426 bp, Homo sapiens
  misc_feature (335)..(335): n is a, c, g, or t
cgccggagcatatgcagaaggaagaggaaggaggagctggagaacatgatgctgctaaccccagatgaaagcgtgtttgcaggaaccaggtgggaactcctggagacggcaggggaaccaggtggagggcggctgctcagttgtatctgtacatgagacttcaatcagcgccttcgctagcccattcattcacctggcatttatagaacgctgctggtgtacagggtgaacacaacagccaaacatcttggttcctcctcagagatggccggcccagagcctggacatctgactcaccaatactctagtccgtcaaaaggacacacaccaaaggngaagggacctgctggccacaggtggggctgaaatgggttgaaatgtgttacacaactcacatctcatgggttcataactatcccccccgca

SEQ ID NO: 480620 - DNA, 352 bp, Homo sapiens
  misc_feature (57)..(57): n is a, c, g, or t
  misc_feature (87)..(87): n is a, c, g, or t
  misc_feature (171)..(171): n is a, c, g, or t
  misc_feature (227)..(227): n is a, c, g, or t
  misc_feature (290)..(290): n is a, c, g, or t
aagagtaaaagagagaattgggaggctttcgaagccctattgtaatatttcttaaancacattatttattgctaaatatatttagtntgagccatgtaaaaattgccatttttggaggtcaaaaaccgttgaatatcagcaatctagtatggttcaatttatgtggtttcnaatcaaatgtacaaagtacaataatttcgtttcatacttgattttttatttcttangctgagtcattaaaagttgatcagtgataaatggcaaaattatttaaagtgcttgaggaattngggagacttgctgcttatgtgatcagatatccaaaaataaagtttttcatttcattaaaaaa

SEQ ID NO: 480621 - DNA, 153 bp, Homo sapiens
  misc_feature (32)..(32): n is a, c, g, or t
  misc_feature (66)..(66): n is a, c, g, or t
  misc_feature (79)..(79): n is a, c, g, or t
  misc_feature (141)..(141): n is a, c, g, or t
atgggctaggcatggtggctcacaattgcaancctagcaatttgggaggctaaggtggcagcatcncttgagccccggnggttgatgctgcagtgagctatgattgcatcgctgcaccccagtctgggcgacagggtgagntcctgtctttaa

SEQ ID NO: 480622 - DNA, 1343 bp, Homo sapiens
gaggaggctcgtacctgcattaatgaatcggcagctagactctaggaactatccgagctccatccccacaaatatcaaaggaacggagagaaccgggaccccctgggggacccggaactgatctgacaggatggcatctgatgacatttgacatagtgattgaggacatgctggaagatcccatataaaaaagaagaggatgagacaaaaagagaaagaagttaaaaaggattatcctaacaaataccacacaggaagaaaccaaggaaacagtggcaaatgaagaccagtggaagcaaaaacaaatacgagaggaagacaagcaaacgtagtcgagaatcgggaatcggtatagcacaggcagaaatagtcggagccgaaaggtcccaggatcaggacagatagatcgtacaacgatagaaccgtaagactggggatcagtacagacaatggataatagagtcagacagaaagatcagggaaccatcgatcagatgagggaatcgaagatgacaatataccagcgaagtccatcacaaatagaaacaaatggaattataagagatagtggaacagcagataaagaaagttcctcaatatatcaagagaacgaagcagcaccagatacaagaagaagaccaagattgactaacacctagcaagatccactgacaggaaagacagtggaatggacccagccaacaaggagtcacatagggagtggcacgaatacgcactgcacccagaacaatagacgagaacatcgaagcaaatcattgagcagcgaacaattaacacaccacctgaccatggcagagagacacaagggtagcaacaagacatggaacaagtacatgaaatacatacagactacgtgacacataccaccgatcaacaaccactaaacagacacaatctgacgaataaccaatatgagacaaaatccctgaggaaacaacgtcacaaagccattgatagacccaaacatgagaaccacatacagagcaacacttggaacccaggagaacaaaacgcagagcaattggcgtgataaaagcatggcacataatccaaaactgcaaatacgaatggacacttacaacacacaggacaaacacgcaacatagacacacctgaaactggaaagaaaccaatggaccaacacgacaaacaagaacagaatcagagaacaaatagcagcaaacacaataacaaccacaacagaaacaaactccccatacaaaacaacaaacacatcgcctacaaacaacataaagcccaaggacaacctgtaagaacgccattgggcaaaaatataaaaaatcataaacaacacagaaaaa

SEQ ID NO: 480623 - DNA, 139 bp, Homo sapiens
gctcgactgaaaagctattagccaggatcatggtcagataagacataacgtttttcctttagaattattttattaaatcatagctgtacaacagcttcttaactctacacacgcacttaaatttttttaaaggtcgacg

SEQ ID NO: 480624 - DNA, 213 bp, Homo sapiens
tttatccgggaggaaaaaagataaatcaagtatgactagtgaacaatagattgatttacaatgtacaccaatctttgttaagttcttaaaatgttaataaaaatgcgttatttgagggattgaaaaaagaaaaccaaaacactagaccatagcatgtaagtagggtaagaaattattaataataaaatcctcaaaatatggtgtgggtaccga

SEQ ID NO: 480625 - DNA, 555 bp, Homo sapiens
gctacgaatattgttgtagtacagaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactacagagtgtgatgtatgaacacactgggttgggattttctgttgaggatatccagggccattttggcatgaggcaaatacagaagcaagatttcattctacttggtgatttgaatcatgccagtcctcattccaatttctcttttgttctctctggcactgggtacgctctgtatttcaaaatcttgctttgctctttccggagcttgcctctctgtacgtgcatattgtgaaggtgtatacatctatcattcaaaggtccagtgtgtcagcagtggtgtcgccctcaggttagatgtggtcgtgtcctatataatcagtggcatcgtgtgtgctgtgtgcatagtttcattttaatgcccgct

SEQ ID NO: 480626 - DNA, 795 bp, Homo sapiens
caggggggtcacagctcggcaagacctttcccgtacgccattacagggcagcctggtcggtatgcaggaacacctgccccccatccccaggaggagcccccgttccctccatctggcaaaacctggggaagggggcaaacacagggaaagggacaaccagtctgcatcatggaggacagggtcagacgcacaggagttgcgtgtagagaacttcgggggctagcagccccatcttcatgggtctccaacgcacattcccggtctctcagtctcagtcggcaatcatcattccatcctggcagcagctcagagcaagtttcattctccatgaccagatgccgtcagagatccggcggagaactgagactctgaggctgtgggaacgccttctctgcccgttctatccagctccgttaacacgagatggccaagtgggcttcccgagcttccttgtgtcaccataatgtgcagggcgctcacccttgcatgcaatgactattttgtagtacacatgagagcagtaaggcgaaaggtagagtcaggcagaatatgagcacgttctgctcctccgtgataagagttgtgcccaagggtcgcttaaggaatctgccccacagcttccccccatagaaggatttcatgagcagatcaggactcttagcgaaatctgaaaatcggatttactctcacttgaccagcagagaaaggaaagtttaataccagataagcttttgattctcttgtaattgttctgcatccccttgccctcaatcaataagttcttttttagttcca

SEQ ID NO: 480627 - DNA, 674 bp, Homo sapiens
  misc_feature (237)..(237): n is a, c, g, or t
  misc_feature (507)..(507): n is a, c, g, or t
tggagtgggaagggggcttgcgccagggcggtggaatcttcatggatcttcatgcagcatacaaagcccgtggttccaagagaatggtgaagttattcgacagccttctgctatctgggagtatgaccccagtctgttataagactgttaagttgtgtatacattgttactttgattgtgtgtcaactggtgtgtgctcccttcttccgcatcatcgttccctttttccatggaacncatttggaagttcttttccaatgtttccgcaaatttggatttggtgcgccattggcatcatttattcaagggaaatcaaatgggaattttgtgtagaagaagagctacaataagaaacaagacttggaatttccttaggaatatactttggcatgttatactggcagtgggatctatgaggcaatattaaaaaacgggcaatttctacctcattaaggggagtgcgtggttggcccgcaggttattttacgggacacgatttggggcccngtgggacacggcaactcatgtggaccacaggtatttctctttggaactgacccaaccgggtagttgggaaacaacagtgcctgtggtgcactagaaacttacgggagattacggggggagcattgtgtggaagcggaaggaaagaatcgcctagtggtgtttctcct

SEQ ID NO: 480628 - DNA, 127 bp, Homo sapiens
gggaaggaaatggtctgagagcagatgatgtccgtggagattttaagaggggaagaagctaggttgcaaaatagacctacaagaaactatagcaggagcctccttcctcatgctgatcccatccccg

SEQ ID NO: 480629 - DNA, 976 bp, Homo sapiens
  misc_feature (682)..(682): n is a, c, g, or t
  misc_feature (778)..(778): n is a, c, g, or t
  misc_feature (976)..(976): n is a, c, g, or t
tatcttaaaggatttatcaggtcagaaaaagacataatttatgattggatttgggaaagttggtcaaatatcaaaggtttagaacttgatatcacaaaataggatcacaggtcattataagataagtcattcttttaaccaaagcaataactcaaggatttcaaaaagaaggtgaaaatctccattccttgagagcggagactggatttttcaatcaataagccctaataaaaacagcatgaagccaattaaatttatttttcaaaatttggtaaacaatctataaaattttaatcttgaccataagatataacttccataagccttttataacctttataacctttattaaggggctggttaatgcttcaagaaaatctggttaatctgatgcaggggctcatgtgctgcttttgcatcagtgtgcctttgacattcatgattcatttataaagaaacttaacctattttatctttaaaaaatcagctctgtgcaatctcatgcacccactctttcgcaatagtccctggcgcttgaagagttgagtagctttaattttctgggcccgggtcttaagaatgcacgtatcctgagtgggacttttaacaaggcgaagaaaagagtaaatgcgcgcacgcttaaaatgggcggcgcgggggccaccccgttgttgccgccctntggagcgcgcggcgcgacgtgaggcggcgcaagcacgctccgtgaccgggcagccaagcaatggtatacgccgcggccggccgcgccggccgcccntgctcggctcagccgtgtgccgtcgcccgtacactcaaacacacagcaccacacgcacaccaccacactccgcagtctgtgtggtgttacaaccaccctaccaccgcacacacaccacaccagccaacaaacgagaccaaccacaaaccaaaaaacccacaccacaccccacaccaacaacccacccgccggatgggn

SEQ ID NO: 480630 - DNA, 276 bp, Homo sapiens
cttgaacccaggaggcagaggttgcagtgagctgagatcacgcactccagcctgggtgacgaagcgagactgtcaaaaaaaaaaaaaaccaaaaaaccttatttcactgagtggtatagcatttggcatgccttttctgcagtccttatcacaccacataatggttatttgggggaaaccccagacccttattggagtttgggagtatatcataataaatatcttttatctgcagcacttagaaggggcacaataaatttttgaggagtaaatcaa

SEQ ID NO: 480631 - DNA, 826 bp, Homo sapiens
gcctgacctcgcacccagctcggagcccggagcgtgcctcggggcctgtcggttttcaccatgagcagctgagctcagaaaaacccgtttcgcctgtgacctgttcctggcgttgagtgagaacaatcgggtggaaacatcttcatctctcccttcagcatttcatctgctatggccaatggtttttctggggaccagaggtaccacggcagcacagtgtgtccaagatttccatttcaaacacggttgacgaggtccattcaagattccagagtctgaatgctgttatcaacaaagtggagcgtctatatatacttgaaatgtgctaatagattaatatggagagaaaactttacaatttccttcctgagtcttggtttcgacgttcagaaaaacatatgtgtgtgacctggcaggtgtggattttcagcatgctctgaagatgcaggaagaccataaaaccagtggtcaaaggacagacagagggaaaaattccgggactgttggcttcggggcatggttgataatatgagcaaaagttgtgtagtaaatgcatctatttcaaggaaccgtggagggataacatcctggaaagaaacaggaggatgcaccatcaaatggattacgaagccggaccacggtgccctggtggttccgacgaaaaatcgcattggtaacctcgaggacttagggcggtggggaccgcctacacgcgaggagcacacaggaccggggcgggaatgagaagcccggtgaaattgcaggttggcagtgtggtacctcaaccctgaggagtgcgcaggaaacccccgcttggcaaaagggg

SEQ ID NO: 480632 - DNA, 302 bp, Homo sapiens
  misc_feature (6)..(6): n is a, c, g, or t
  misc_feature (47)..(47): n is a, c, g, or t
atttgngggggggccccccccccggttgttgcccccaaaaaaaaccnggggggggtttccccccccggttttatcggggcggggggggggaacctttttttccccgggaacccgttttgcccctgggcccttttggggggccccttaaaaaccagggggggtcacaaaaagcggggggggccgggccgggatttccggggattttttcccccccggggccggggggaatttaacccttggttttttttttttttagggggaaccccctttccgccaaaaaaaaatttcctggggttttttta

SEQ ID NO: 480633 - DNA, 83 bp, Homo sapiens
gcgtcgacttcaaatcattaaactggggctgttatggtaggttgttctggagatactaattacatgtcaggtagtatcagttg

SEQ ID NO: 480634 - DNA, 126 bp, Homo sapiens
agagtatatatcaagctgtgtaggtgttgggaccagcagaaggcaaacgtccagccaacacacaggcactgtaagaggactctgcagctactgtgcctctgtagaaggacccctacaggctattgt

SEQ ID NO: 480635 - DNA, 685 bp, Homo sapiens
gaacagcctctggcatgtggaacgtggttggctcagggtttgacatgatgaaaagacaaataaatactgtattaataaggaaaaataaaatacaaaaaaaaaagaaaatgaccaccgttgtggctcggaccccgaaagattcaaatcgaaacgacagtcgggtaacagcggcccgcgtcagttcaatgttgacttaggggcagatcggtgttccctaaggaacaccgggtcttgagaagccttcgctgtggcgttcgtcgccaagttaaaaaagtcgccgggggaacccctcggagtgttttctgaaaagatgaccaatatgggatgccccggcggagccatacgcgggatttcagaaagaaggcggttcctacagtaagcggcgtagatcaaaaattggacccccgggctggtgaggcccaaaagcctggtttcaaggccaaacgcccagtggactccactgacctttttcccaaaaaaacaaacaaacacaaagaacagcaaaaaaacaccgttgtctgacgtctctttgcgccaccgagaaaccctcttctaaaaccacactgtgtttgggaggcgcggcacccaggtgtttatagggatcaacccaggtgtatctgcgacctgggtccacagagagaacccactggacagcgcaacggcgcggtgacacccacccaataag

SEQ ID NO: 480636 - DNA, 711 bp, Homo sapiens
gggggcgtaatgagtgtttaagatcttctcaaaaacagttatagttttggtattaaacttgggcgataagacaatactactgtgtacaacctacaatggtcctgtaatctctgttgtaagccctggatcaaccctaaagtgccgattttgcattcatttgatccatatacctttaagtttacaaatattattggttgaccgcctaaagctgaatgctaaggactactcccttgaaagctttttgcgcataatcagcaccggggccataaacatggtctgggagtggaaaccccttgatgtccaagacttaagggcttttttaaactaccccattgtaacctgcagcgaattttgaatggggtcgcaattggggctcttttgccaaatttcgccctccgtggagcgaatgaaaattttctggcgtattatttcatcaaatttcctggtaattttttggagtttccccctcttttttatcaacaagtgttgaccttttaaatatcccttaaaatcggccatttaccccccccaaattggttttttttcccaaaagtttatatctaaaaggcctcttttataacgctaggggtcttcattttgttgaggtgaaaatcccttttttaagtgacctaggtccattttgtacacattgccctttagttttttggttctaaagttcttaccccttctcggccccttggggccccccct

SEQ ID NO: 480637 - DNA, 998 bp, Homo sapiens
agaaaatgcatatagaaaattgttagattttaaccaaaatacttgataatatatagatctttagatattgctattatagataaatactggagcaaaatattattaaatggtatggttattaatgttaaagaaccacagaatgttgtaaatatagattcatatacaatttctcattaaagtcgattgtatgcctatcagcaaaacaatataaacatagagatttgaatataggataggaagaatagctctacatatcataataaagaagacagtataaaagtacaatatttgctagaattgaattgttgctgggaatttttgctggagaaaagataaaggactcttgaggactaattatataggaaggtagcagaaggagaggtcctaccagaacagcagatagacgactaaatataacaaaaaatagcgtaggctacgttcagctaacgctcttatttactagagtaagaggccaggcaagatactggttcaggtagagagaacaaactgaaactaaccaaaaacataccctaagcccagagagagtttctctttctacttttggtcattctcgtcctcgttcctagttttgcagattccaccaaagtagacacaaagtaccagccggagagtacgattccaaccgaaggctaatgagaaaccaagaaaaccaccaccgcctacaacaccatgactcccatcatccagatgagtcacatagaagtccgacctagtttcagatctgaaaacttccctgctaaactaacataatataggcacccaaagaaaccaataccttagaaagaagcggaaaacggtgctccgggcgcgccaatggttgcttcttagagaaccagtgatcccgcgtccataacaggtcccctagtgcttcgtctcatgatcctcattcgtcggcggggtattgcggcctcgtctgcgcatgttgcctcgttccgctgctgtgctccgcccgcctctttcccttctctggcttcgcc

SEQ ID NO: 480638 - DNA, 106 bp, Homo sapiens
tcatgtggaaatctacgtgtaaacaggtccaaaccagacttcatgaaataatgtagtggaactgatacgcagtgagaggaatattaaggtgctgcttaactggttt

SEQ ID NO: 480639 - DNA, 208 bp, Homo sapiens
tgtccccgtgcactcgggcagcatcagacgcccgcgcgaactgtccaccctgagcggctgcgccgcgcacgcgcagcggatggccacgcagatatcttccaggacccgatgtcctcgctcaatccgcgcaagcgggtgcgcgacatcatcggtgaggcgccgctggccaacggcatcatcgcgcgccgcgactacgacgactacgtgg

SEQ ID NO: 480640 - DNA, 127 bp, Homo sapiens
tcccaagatgagaaactggagtagaaagttggttataagggttctgctttcacagaatattccaggtttatgtgtcaggtggtgacttcacacgccataatggcacggggaattctcatcctgggag

SEQ ID NO: 480641 - DNA, 960 bp, Homo sapiens
gactttcggaactcaggcactttcagaggattttgtgtgtatgagggcttcggctacagcaagaattagaggagcagctccataaggaaatgtttcaactcgtgctcacgcatactatgatcccaattcagaatgctgacaagtgaaactcgtgaaggcagcaaaggtcgtggaaactcgcagaggtcctggtgggtgagcagcagcagtgccaggatgccaagacgccagcagaaggagcagatactatgctgctggagaagaagagatcactgcttactcccaggtgacttctccgactgacctcactgtgcagcagaggcttcttcaagaacactcggactgaagactcaatccgagctagaccgcatcaatgcccagtacctggaagtcaagtgacggctagctatgatccattaagctgaggatggaggagctaaagattgttgtcacgacacgttacactgttgagaaagtggaagttcatcgtctgattagggaccgtttggagggaagccattcacctaacaggagacagcacatggagaactcaagacaggtcctgaactcctatgaggttccttgggaaggagttcgacaggctggtgaaaagagtaacacctgtactacaagcaggcaacagacgaacaagtcggtagggccctcccacgtgacgatcgatgacaacggtctaccgtctcgagctctgaacagggaccacgagagacatggcttctagcatacgtctgctgcctcctaatcttcactgcaacgtagggaccaccttcacctggggctgccttcagtacaagagagatgtggaaatgctagcgcattgaaacactgcagtaatttaggcactctcctggtttctcatcatatttattatgactgggcctcatctggaaattctagcaaggagattatataattttaccacaggggtgtgtaaagtgttca

SEQ ID NO: 480642 - DNA, 430 bp, Homo sapiens
  misc_feature (52)..(52): n is a, c, g, or t
  misc_feature (400)..(400): n is a, c, g, or t
tatcaataatattacatttataaaatttttttagttttttttgaattatagngtaaagttgcaaaagatttgccattttaacccatttgtaagtgtacagttctgtggcattaattaaattcatattgttatgcagccatctccaggactgttttcatcttgcaaagctgaaactatgtccattaaacaataactcgtcattcctacttcccctcaacctctacttacccctagccaccattctactttgtgtctctgtgattttgactattttaagtacctcacagaagtggaacaatacagtatttttccttttgtgactggcatatttcactcagtataatggcttcaagattcattcatgtcatagcatgtatcagaaatttcctgccttattaanggctgaataatattacattggaagtatatg

SEQ ID NO: 480643 - DNA, 327 bp, Homo sapiens
ccaccttttacgctgggggtggcattgccctcaacgcccctttttcaagctccttttctggtatgaaacgaatttgggtacaacaacagggtggtgggcctcatggcccccatggcctccaaggagttagacccctgggcccccagccccagcaagagcccaaaaggaaaaaaaagaccctcccttttggggagtccctgccccactcagtcccccccccccctgaatttcccctcctcccagttgccatgtagacccctttaaaaggggaggggcctagggaaccgccccttttcttgttccctccataaagttccctgtgctcca

SEQ ID NO: 480644 - DNA, 884 bp, Homo sapiens
  misc_feature (11)..(11): n is a, c, g, or t
  misc_feature (13)..(13): n is a, c, g, or t
tggtggtggtntngcgaaggagaagaagtacgaagagaggggaggacacaaacaagaagaaatgatccgtgagccgtgacccgagagcgacgagacatctgtatgtgctcgcgaagttaatgccgttgcactgacaaaggagataggagtccccgcgcagctggaagtccgagggtgcagcgggaacggctcttgccggagatcggcccccggcctgggggggggcataccggcaagatgtaaagggcggctggcaaacagcaccgggccccgctggaggccaggaaaacaccgttgtcgggcgccccacagggtgcctaaaggccctgcctgccctgggcgtgggccacaacccgcacaaagtgaatgcttgcgccaacagcgccaataaggaacaggtgcatgcccacgagcaaaacatagatgactgggtttcccccacgcccgggagaacatgaacatgctgaaatcccccggggtgaaggaaacaccactcccctgggggaaggatccatgaaacccgccgctagggaggttcagtactataacaggtgagaacaaacggccgaaaaacaccccggggtggtcccgcaggggccccgacggatgtacaagtaagtgaaaaacaacccccggggagagaattcacgcggcgcccggtgtgcgtcgtccacaaacggggtgtcccggcctataaagagaggtgtcatcgaggcccaccactcgcaggccaccagggggcacagggccgccgctcccgccacaatgtgacaagctgccgcccttgcgccaggggatatgcttaatgccccctcagagaggaggggtttcttgggccctatccccgtttggaaacttacctcccttttaaaccccacataaca

SEQ ID NO: 480645 - DNA, 261 bp, Homo sapiens
aataattgtgacacaagttgtcaacacctttgggataaagcaaaagcagttctaaggggaaagattatagcacaaaatgcctacatcaaaaagtttgaaagatcacaaattgacaacttaatgttataactcgagaaactagagaaacaagaacaaacttaacccaaagctagcagaagaaaagaaataacaagaatcagagtagaattaattgaaattgaaacaaaaaatacaaaacgtcaatgaaacaaaaagctgatt

SEQ ID NO: 480646 - DNA, 333 bp, Homo sapiens
  misc_feature (13)..(13): n is a, c, g, or t
  misc_feature (15)..(15): n is a, c, g, or t
  misc_feature (107)..(107): n is a, c, g, or t
  misc_feature (134)..(134): n is a, c, g, or t
  misc_feature (217)..(217): n is a, c, g, or t
  misc_feature (227)..(227): n is a, c, g, or t
  misc_feature (243)..(243): n is a, c, g, or t
  misc_feature (270)..(270): n is a, c, g, or t
  misc_feature (309)..(309): n is a, c, g, or t
aagaggctgaggnangagaatgacatgaacctgggaggcggagcttgcagtaagccgagactgagccactgcactccagcctgggcaatagagcaggactccatctnaaaaaaaaactgtctttgcttacattnagaataaggctttcaaaactgtgggtgtgctggtttcgtgagccttctacttgccccaaagacagtatttttgcagctgtatnaaatgaaccnagttggaggaaattgntaggagtatatcttaatggcctcagcnaactgtttattgggttttggcaagaatgaagctggtttnaaggactggagctgtaccccccct

SEQ ID NO: 480647 - DNA, 1821 bp, Homo sapiens
  misc_feature (364)..(364): n is a, c, g, or t
  misc_feature (1688)..(1688): n is a, c, g, or t
attaactaagttcagttggaacgaatctgtaaactctgggggacaggtgacccgatagaccagaacgaatggtcccagaagtcaaaacatatcgtcttcgcactctagacggcattcatggtacgtgtggacaagtggtggctaccataactgtcgatggggactgtgcagagcacgcatgaggagtctatcagatgcctctacaacttctaaacctgtgtggaccttgtggaccggggaccattgaccctgcacatgtagtcacaccacagagatgatcacatgagagagtctctcgagaggcgtctctagaggttgtcgatggtttgcacgatagtccatgcgcgcctggacatagaatgcnacgagagagaccacagtgagtcacagtcatgcacatctataaaacgtctaacataaatagaacccggtatattactcaacacggagaccatgtagactcccacgcaatactatgggatgttggagttgaacacaggacgcaaactgtaagtctgcggaaccgcggtaagaatgccataggcgagggcccccgctatgacgattggatacggctgtccggggtgtaacgcgcacgcttctataacccgtcactaaatcacgggcgtatgtgggcgaaccttgcctgagtgtcttcgctcgacgccggagtttttgaacacttttcgtcaaagtttacccttgtgaattccccgccggtcctaaggtagaggttcttgggcttaggccctctgtgtggcggcctgccctattttaggtcctttacccttttacgcggcgttgtggtgcccttgcttcgttagcgcccttgctccctttggggcgctaagctccagacctcgcagtcgttccgttgaccccctccgtgggcttcttttcaccccgttataccagtcaggcggacttacttagcgccggtaggtgaacgccttgcccttttcggtgacggctctctataggcgaggcgggcttaccggcggctcgccgccccttggtggggtttggcctagacactccgctttgtgggggcacgttacacccgccccgcgatagcgcccacgagcttcgagggggggtgccccctctgtggcttccattgccgttgtaacccccccccttggagggtccctagcgttgtccttatggtcgccccccgaatttcgcgttcccattgcaaagccccttgccgaaggggtgccccttttccctttcccaccgcttttccacaccaacggggtgggcccctctctgaggtgcgggacactgtccgtgccctgggtctcgatgacacctccacggcggagagcaacgccgttggcggctatctcctctccttcgtaaacatgtgtccgggactctggtcaccatccatggatattcgtgttccccccacgagcgtataaagccaaccttcaccatattggtcgccacattatacgagaacacatcggtagtatgtattcacccgagcggcagaaacaatggcgggcgcgagcacaccacacaacgcgggggggcccgcccaccccgcgcgagccgcgcaaaacccccgcggccaactgcccccccgacacgtatacaccatgcccgccacggggcggctcaccccgcgtgttagatcacgatgcaacggcccgacccgacgcaccccaacaaacacagtggtngcccccacacgaaccgtactccgccgacatccctactcacgtaggcgcaacaagggcagggctgcagacaaccaggacacccacaccagacacgccccaaccccccgaccgcaccacccccatcccacacgaa

SEQ ID NO: 480648 - DNA, 329 bp, Homo sapiens
  misc_feature (38)..(38): n is a, c, g, or t
atagtgccttaggaattttaacatatattgatataggnccgggccctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgacctcagactgtgccgctgcactccagcctgggggtcagagtgagcctctgtctcaaccaaccaaagga

SEQ ID NO: 480649 - DNA, 733 bp, Homo sapiens
  misc_feature (183)..(183): n is a, c, g, or t
gtgtcgttcgggtgggcagtgtccatggtaggtcagtgctgaacagatctgttcgttcagtggatgtgacgctgttgaagtttgacaagttggattctgagaaggctggacgctgtgtgtcctagagctcgcaggttgagtactcctggatcctgatggggcatgcgttctatcgttgacatncagaattgcttattcatttctctaggagctgttgctcagagggagcaggtgtgtgcatgggtattacgtcttatacatgggcgtgctgaactacatgctctagcgtttctagaaggtcttatggatcttacataggttgctgcatacacagctccagaacagccgagtctaggaacttcagtctgtcattgtgctggacatgatgtatgatggactcgagggcatagccgtcgtatgaggcattagcatggtgttgtagtgggactggcccgtctcattagacgggatgtgtacaagtgcaatttctgttggctacacgagagcacactgtgaactgttcaggagggcctgttcattctcacaggtctttggctgtattacctataggggcggtctctatactatgtggcctacatatcaatttggctccgctgtgataccaccttatccccatcaattgctatgggatgagtgtttgatactctgggaaggggccgggccctaattgggctatatggagttggatacaagtatttcttcgtcgttacgg

SEQ ID NO: 480650 - DNA, 734 bp, Homo sapiens
  misc_feature (289)..(289): n is a, c, g, or t
  misc_feature (313)..(313): n is a, c, g, or t
  misc_feature (329)..(329): n is a, c, g, or t
  misc_feature (373)..(373): n is a, c, g, or t
  misc_feature (386)..(386): n is a, c, g, or t
  misc_feature (421)..(421): n is a, c, g, or t
  misc_feature (427)..(427): n is a, c, g, or t
  misc_feature (468)..(468): n is a, c, g, or t
  misc_feature (475)..(475): n is a, c, g, or t
  misc_feature (479)..(479): n is a, c, g, or t
ggatttctgaaggggatatggttgtgatgccgtctgtgagaattcattgggtaatatgcgaattgccatgactagaactcgtgttatgagagagagcaaccccgggagtaggccaaaatttccttatgggttaaatgggtagcgcataggtatagtgagggactaggtcaggggaggaaagacataaagacttcccttcaccatgtgtacaacgatatcgctacaagggccaggggttcctccgtgctagttatactaccatgctataaccagtcagtcgggaagagcnacgtggatggcaataacaccactnctgagcgataaggggntcgaagattttatattaccctttatagtttagaaccttgtcaanatcggctcgatcntaaatagaagatggctaagttgcgtcactaaattntgagtncatcctcaacgagctatagtggtttagctagggttcgatanctccagntagncaattcgaggaagcaaagatatagttgaatacattactgctggtgcactatctctacttagaattggccgattcttgtagtccctttgggtgagggggatgcgagtggaatatattcacctttggttttttttgggaacgctaaggactaaaatacttcctctatagggtgggaaggacgtttttctttttgaaagcggacccagggggggaagggctttttgaaagaagttcccgccattcaccagaaaaaacg

SEQ ID NO: 480651 - DNA, 423 bp, Homo sapiens
  misc_feature (315)..(315): n is a, c, g, or t
  misc_feature (334)..(334): n is a, c, g, or t
  misc_feature (369)..(369): n is a, c, g, or t
  misc_feature (381)..(381): n is a, c, g, or t
  misc_feature (399)..(399): n is a, c, g, or t
ggcacgcttggatctagatcagtgaaataaaatatgaagacaggaacctggagactgcagaacacacagaacatgataaaagtagcattttaaatcagtgagggaatttattcaaagggtgttgggataactgggtagccatctggaaaaaaataaagttggatctataatttatacctccaccagaatgaaatttaaatggatcaaactttaaaaggcaaagtcacaaaagaaatagaactaaggcaggggagaaaacttgtatagtttaggaatgaaagtttttttttcttgacattaaaaccctggaaacantaaaaaaaacaagatttcntagttaggttgtattaaaaattaaaggtttttgcntactttaaactnccccagtgttgggggttnccggcctgcttaccccgggcccgg

SEQ ID NO: 480652 - DNA, 574 bp, Homo sapiens
tttattttggagacagtcttgctcggtcgcccaggaaagagagatcagactgttactgtgtctgtgtagaaagaagtagacataagagacttcatttggttctgtactaagaaaaattattctgccttgagatgctgttaatctgtaaccctacccccaaccctgtgctcactgaaacatgtgctgtgtcaactcagggttcaatggattaagggctgtgcaggatgtgcttggttaaacaaatgcttgaaggcagcatgctccttaagagtcatcaccactccctaatctcaagtacccagagacacaacacactacagaaggccgcagggacctcgtgcctaggaaagccaggtatggtccaaggtttctccccatgtgatagtctgaaatatggccccgcgggaagggaaagacctgaccgtcccccagtccgacacccgtaaagggtctgtgctgaggaggattagtaaaagagggaagacctctttgcagttgagataagaggaaggatctgtctcctgctcttcgctgggcaatggatgtctcggtgtaagctggatgtatatccatc

SEQ ID NO: 480653 - DNA, 880 bp, Homo sapiens
gaggagatttctagtgaagatgatgagctggtagaagagaagaagcagcaagaagaagggtccctgcaaaggaggaagctggagatggaggactatcccagttcatggaaaggctttgcgatttacagtctacaggaaccgcacacttcagaaatggcacgataagaccaaatgcttctgaaaactgggaagggttcgggtgcctttgaacgctcaatcttgactcagatcgacatatctgatgggaccaacgagagattacttcgaaggacacagaccaagcgctctgtcctatcgagttcttggaaacctgagccagcagctcagcctgtcccagagagttgtggccaggggaaaccggagatcttcctcaagccctgctaatgtcaatctgaaggacttgggatgaagaaatctttggatgatgatgacttttaccacagtccttcgagaactcatagaaggaaagacaggtcttggatcccaagatcaggtggcatggaaggcagtggtttgaatcagaagttagaagaaaatccaaaaaacgtagataggaagcagcaatggcaggaaacttcgttttcatgtcttagcaagtatgagtttatggactattgacatatacactgatgatgatgccaggcgaactgtacggtcttttgggagtcaccttccgagaggcaggattgaatggcaatcgaaaccaggggcctgttgtgggttgcgtcaaatgaggacacggattacgggggacatgggacccgcaaatctgtcactggtaaaaagggggcccaccgtttagcaattagtgtcgcaaaaaaaaaatggggcgcaataatgggcgagagattaacgatgtaacggcctgttctgcatcggg

SEQ ID NO: 480654 - DNA, 178 bp, Homo sapiens
cgagctcgtacccttacccacaaaccccgtcaggcgactagtcattgtatgcagcaactttagatccgcaaaaatgccgtaaacaagctcttgccaaaccaatcccttccttctgacgatgccacaaggacgctgcttatgagggcgcaaacttctcggcttgtgctcggacccttta

SEQ ID NO: 480655 - DNA, 109 bp, Homo sapiens
  misc_feature (2)..(2): n is a, c, g, or t
tnctcaggatagtgtgtctcgagaccgagcacccgcagcagtttatccgtaagcgatgatagagtctgggcgaaagatctcaactatctcaacttaatggtagaagccg

SEQ ID NO: 480656 - DNA, 431 bp, Homo sapiens
  misc_feature (12)..(12): n is a, c, g, or t
  misc_feature (68)..(68): n is a, c, g, or t
  misc_feature (106)..(106): n is a, c, g, or t
  misc_feature (150)..(150): n is a, c, g, or t
cgtggtgtgatngtataattcaatgttagcgtctgtcccgggtttactatcctgggtttctccttccntgacgacgcgttaggactaccgagtactttagcacttngttattctgtacataattgaccacacttactaaaggagtatccntgtagcactagaacccctcttttttaagatgaagtccaatgtgcctagcttcctgtgtatttagttgacaacagattgagaggagagtgggattgaggagcaactagaccagtgattctcaaaccctatgtgaccaaattcccttttatattaaaaaaagttgcaatgcctttactctcctgaaatgaaattgatgtataacatacttaagctatactaacaatttcaaaaaaagaaaaaaatgtaatggcttaactataatataaaggagaaataaaagt

SEQ ID NO: 480657 - DNA, 459 bp, Homo sapiens
attgcttacaggggtctctttatcatcgatgccaagggtgtccttcgccagatcacagtcaatgacctacctgtgggacgctctgtagacggagctctccgcctagtccaggcctttcagtatacagacgagcatggggaagtctgccctgcttgctggaagcccggcagtgacaccatcaagcccaatgtggatgacagcaaggaatacttctccaaacacaactgagatgggtaaacatgggtgagcctgaagcttggatttcacctgtgccccaacctggatgtcctgtgctggcccagaaaatgctagattttcctccactctctgaaggggctggagtctaggctgaggttttctcattacccacctggaatctggtgaatagtgatcctgccctgagcacacctagctgggcccaggtctataggaaaccaataaagtattagggacagtgta

SEQ ID NO: 480658 - DNA, 111 bp, Homo sapiens
cagatctttaagcatcctaacagatgtgttttgattgattcagcacagacttgccctcccgtgaggcttgaccaaccacagctcctggcatgggatgcactcccaccgctc

SEQ ID NO: 480659 - DNA, 137 bp, Homo sapiens
caactgtcgtgatcatttgaggactcaggaagttggaacctatactgttgtgtagggccttgccttaatgttgatgggctgctgactgatcaggacggttgtcgttcaaggttgctattgaaacttctaaaactagg

SEQ ID NO: 480660 - DNA, 607 bp, Homo sapiens
ccttcagcctttgtgatattaatgcacagcaacacatttcccattacacccctgaacacacacacacagaaaacccaaaagtttcactgattcttgctcttactactctcagtacactctgtatttaaattggcgataaagtgtgccctatactgattatctctggacaaagtctgaatggggcttggctctaatctctagtcctcattggacattttacatacctggcctttgcctccaccctgatgtggagtgatcatgggggtgcgaaatatagctggatcctaaagctctgaactgtggatggaggtgtcacagctgaggctaggaccattctgcagggcacttagtgtgtacagttgtatatctatcaggggtcaactcgctggagtgacttgagaacagatctctgagcacaaagcagggcctttgccctgaggcttggtatgtgccttagcctacacggtttttccctgcagtcctgttcaaagcccattaacctaagtaccacccccaggaataaggctacctttacatccaggaaggtttaacctggggaagaatgtggacccaattttttatgaaaggaggtccctcgcccctgcgt

SEQ ID NO: 480661 - DNA, 402 bp, Homo sapiens
ttttggctcccggagtaatccaagtgtcgctctggcagttgcgagcacgattttcgaaaatgtaattattgaacagggctccgagtgcaaaattttgttcacctggcggaaacaagacgccaaagcctacgacttttgctttactttcaggcttcgtaaaaacagttgtactcgtgattggaaccatagaaatagtttttaaaatttcagctctgggatctgagcaggcagatagtaaatcagccgcttgctccactgacgttgccacaaccagccaatcacatattggcaattgggtgggcgacgtcacttcaatatcgtaattaatttttacgccgcttttgataagataatcagtgagtttagagattaactcacccattccatttttcggagccaaaa

SEQ ID NO: 480662 - DNA, 418 bp, Homo sapiens
ggctcatttcagtccattgcaaggtggtgtgacaggctgactccaggtgttcttttggatatttactactgaatttgctttattacaattgacgtacagaatcttaaattatttattaatgaaattatggatacaatggttctggggttaatgtacatacagtgatgtaggaaactaaattgaaatgattacagacttaaatggtcctctggaaaaattagcctttggagataaaagaaggaaggatgggaggaggaaataaaacaaatgtaaggatttaactttcgggggaagcaactgaatgggagatagtccctattcttaagaaggttaccaaagttatgtaggaaaagaatgtgcttaaactttataataaaggggctggggagtcttacagatgcacataaactgaaatgag

SEQ ID NO: 480663 - DNA, 396 bp, Homo sapiens
cgcggcggccacgggaataagaggaagcagccggcccgcagcagcccctgtacgggtggcctgcaactcactgaacttgactccctccaggtagagcacgctctggctgtaggccaggatccagggcattgagcgccaggatctttaacatctgtcgcgtggtcaccagcgtgccgcgtgccctgcttgatcacgtcgcagatgcactggctcgatgagagcttggaggtgaagggtgctgcgatgctcgcatcccccagtttcaccatgtgcgtactctcgtcctcgaggtctcgcagcacctggctcaggccgtccctctgggaggttggctgctcctcggacgggagggagccccgaccgctgcttggctgtcctggccgtggctcccatgcc

SEQ ID NO: 480664 - DNA, 852 bp, Homo sapiens
gaagtagatacgtatatagttactattagacatctgatgtttgttaattgtccgcatgacgcatagtggtgtgcctttctgtagcctctgaagacaatggcgctagaccccttcggcaacaaaaatgtccggggcatacactacacgttgtcgggtgtcccccctccatggtgagcgttacaaaccgggtccaaattaataagccggtgttcgccaaaacatttcaacgcaatgtggcccaacgaatttctgcccatttgcgcccaatgacatcccgctttataaaagccgcactgtgtacacacgttctggcaaataggcagcaatttatgtttctcgatacagacccccctaatttccgcgttcaatgtcggcaattacaaacccacttctcctcaaatatttctggaacacccctgttctccccaagatctttccaaaagatctcatccacgttggtagatgttgcacccaataagcgctcttgaattatcattttggagctccctatcctttccatacttctgcaaacccccggcccctgtttcgttttttcaacatcaacccacccacattctatgatggcggaatattacgagacagcgcacatgtttcccccataaagatgcaagtgacgactaaatgcttaaacagacaaagttcgggctgtcaccccccccccaatttatagtttttaattccctcacattatctttagtatgtggcccaattcccatgtaggaaaacatgtctttcagaaatctgtcacttctggacccacctactttccgggggtagtttccctacgcaaatgcacatgcgcccaatttaaaggaaaccgcccaaataaca

SEQ ID NO: 480665 - DNA, 147 bp, Homo sapiens
agacgcacactcccttagaggcccattcttctgcatgtaattagcacccccagcacagagagtctcgttagggaggggatgacccatggcccttctctgtcttgtgcttctcctgtattggggtttgtcctctgtgaagcctgcgtc

SEQ ID NO: 480666 - DNA, 192 bp, Homo sapiens
catgactccatgtgaatgagggtttatgtggttaatgtggtgggtgagtgagccccatggtgttgtggtaaatatgtaaagggagtatagggctgtgaactagttatgttgagtccgtgtaagttaggagaagtgatattggatcaggagaaacgttggttactagccacagtggagtttcatggggttacc

SEQ ID NO: 480667 - DNA, 363 bp, Homo sapiens
cacgcgagaacatacacatagatgtgatagggcctcagtatgaggagagtgagcgccacaggttaaaagtgggggcgctatatcaccaatatcctctatataagaatggaggggaagagaagagaagaggaaatccggagagataatccaagcgcaacttaaggatcacacacacactttaaacgggaagagaacaatggttgagcaattttcaattgggaatgagagaattccgaaggccgtgaaatgggtggggaggttggtttgaaggcaccgtggtaatataaaggtggaaggaccgtgcacctatggttagaagtgccaattaatcgccctgtgaaccaagtgtgaagagaagtagtg

SEQ ID NO: 480668 - DNA, 163 bp, Homo sapiens
tgacgttcattgagctatccatagcacgtcccgcgacttttttactcagacccagaccgagtttcgtcatccgcatgcgagccttgaaccttatcgagttcaacagcctgtagtacccgataagctgctcgagcattgcggctattcgagttaccacagtcca

SEQ ID NO: 480669 - DNA, 984 bp, Homo sapiens
ggggcctgcggttgggtggtgtagtgtcggcgggcttgggggtggcttgtggtgcggcgcgccgctggggttgtgtcggcgcgccggttgtgagcgcgttgtttccgggaggtcggcggtttgatgttggagcgaattctgttggcgggccggtgtaacggtgtgtgggtttttttgtgagagagggggggcgcggccaccccccccctgggggggttgtttcgccgcactgggcggggcgccgttcgtccgcgtatatgttcgggggggtggaccacgcctagtcgttgttggtgggaaacgagccccgctccccgcccccctgtgtgtgtgagaaaaggggacaaggagttggttggtgaagatgacgaggaaggtgctatagtgcgccttgtattaatggccacccacaggaggaggtacatctcctcccaccccgtggtagaaggatttttggttctccaccgacgcgtgatggtgtaaggatgttcccccgctctgctacgccccccaagttaatattgtgtgcatccacgaagagcgagccccttttatggactgacccccttgtttgttgttgggtggagggacacaccacataatatttcttctagggtaggggaagggtctgttgtgagaatgtgtccccacccgcgctgatgagtgcatccgccagctctccagcagggttgctctgagtgtggtggaggcagaaggaggagtcgccacagtgttgtgagcacatgatgtggaagccctctggttccctcccgacgacagggatgatctaggagggtgaacgtgtgtggtgttgaaataagaggaagaggttgtgcgttggtgcgggccccgcacagaagaaggaacgggggggaaaaacccgggggcgcgccccttgggaccgggggggggcggcggggggggcccgggggggataacccccccaactattttttgccccccaaaaaaagatttcccccccca

SEQ ID NO: 480670 - DNA, 309 bp, Homo sapiens
agtaagcctttgtcccgcctactaaattccatccatttgagctctcagagatcgatgcccaagagctatcagtaatatatacagcatattgagtctagttgcatcaattatgcctgacgagtttaatacccatccaagtccaaaggtggaagaatacatacactggtatggtaataggcaagagcaggctgtaaaagcaaaggctggctgtgctagtgcagccctgtgggaagttttcttccacagaggctgagtagaacagtcctgctaaagaaaccagtggaataagaacagtcaacgtaggaagag

SEQ ID NO: 480671 - DNA, 428 bp, Homo sapiens
gagcatccccgttctggcattcgtgaaatgatggtgaaagtaaatggtagcttttcccttctttttcttcttatctttgtgattgtcccaactctgtgtaactgacacgttatggtactatgttagccccataatattgtgttttgcctttcaaatacacttccataatctggactcctcagtccaggcactgtgtgcccagcctcctaagttccatctccactccagattctttacagctgcctgcagatactgttacctcctatcagaagtttctcagctcccaaggctctgagcaatatgtggctcctgggggtactttcttcctcggctgtaggactagatggctccttgacattgtcgagcttctggaacttggagactggtatgatagatgagtgtgcctctgcctgtctcccccaccatga

SEQ ID NO: 480672 - DNA, 846 bp, Homo sapiens
  misc_feature (454)..(454): n is a, c, g, or t
  misc_feature (698)..(698): n is a, c, g, or t
gaacgctgaactaaagtatactatagtgagtggaaacaataaaggctaattccggatgatccagtaacaggtaacattactctggaagaaaaaccagcacctactgatgtgggatgcatcgttggtggtcaacataagtgacctggggtaccctaagtcttgcacacgctgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgtgtgatcttcgtcaccgttctggtgcctgtcgccatgcatcaaggttcaaagcagctcagaggagcaagcaaggtgccgaatggatgtccccaaaccaggagnacaagcaaaacaagaaaaaacgacaaagaacgaaaaggaagtctcccaaaagctctctttgaacttgttactatcgaagagtccaaaccccgatgatgcagttcatgaacctatcaagtgcgacaaataacgcctgcgggtgaactggaggagccacagtatacggaagatttgactggggcgcggcacctccaacaaaattcaaggcctaagagtcctgactggcaaggataacaactctgtntcccaaagcctgttttatctcaaccagaactccaggttccggaaaacccaggtgtcaggaccctggacaacttgggggtgtttacctttaagctcaagtaatcatgggcgaggggccagggttaaaaaggcaccaagttcttgggaaa

SEQ ID NO: 480673 - DNA, 374 bp, Homo sapiens
  misc_feature (340)..(340): n is a, c, g, or t
aatcccccggctgaaggtaagttggtaacctccaaagtcaaagatgaaaaaatatccaatggtgaaagattgattgttccatatagagaggacattttttttccccagactgtaaaactgaatccttgttgaatttaaagagaaattctggcagaggcagatgaatcacctgaggtcaggagtttgagaccagcctgatgaatatggtgaaacccagtctctactaaaactacaaaaatagccaggcatggtggtgggtgcctgtaatcccactcgggaggctgagtcaggagaattgcttgaacccggaggtgaagattggagtaagccaagattgtgncgttgcactacaccctgggcgacagagcgagact

SEQ ID NO: 480674 - DNA, 920 bp, Homo sapiens
taaagtagctctgtgaaagccaccatgccctttgcccttgccttttgggactgaccaggagctgttcatgtgggtgagagtgggaaccatttccttgcggcagtggcttccgggtgccccgtgtgctggtgcggttcccatcacgcaaacaggaagggtgtttgggcactttgatcaactggaacctttgtatcatgcggctgaattccctttttcctttactcaataaaagctacatcagactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataggggccccaattacccaaaatattttaaaaataaaaaaaaattataaaagacccccaatataacaaaaaatgggcaaaagcccaaaaaagggggttataaaaaaaacaaaagaggcaaattaaaaaacaagaagtgggaaaaaaccgggagtgcccacaaaaaagacaattgaaaaaaaaaccttttatgaaaagggagaaaaaaaaaaaaaggccctaaaaataacccttttaaaaaaaatagaaaaccaaaatgggaaaaaaaaaatttaaagcaaaaaattattcaaaaaaaggggaaaaaaattattaaaaatgaaacaataattaaacaaaaaggggaaataatacataaaacccacttaaagaaaaaaaaatttattcccgaaaagagggacaatgtttctaaaaattgaaaaaaaaaaaacgctattataaaaaaaagggacccaaaaagccataagggagaaaaaaacatgttaataaagagtaatatcacacttatggagataaccctctatggtgtgg

SEQ ID NO: 480675 - DNA, 191 bp, Homo sapiens
cgactgtttggtgcatgaggagaaacaccagcctctccacacctggaacaagccgacgcttccagaccaggcggaaaaggccttttgtcatggaaatctcgcgagggttactcttctcttgagcaatggcagtcaagaacatgagatggttcactatgactacttgagcatgtgccaagtctggcgaagca

SEQ ID NO: 480676 - DNA, 608 bp, Homo sapiens
taaagtagctctgtgaaagccaccatgccctttgcccttgccttttgggactgaccaggagctgttcatgtgggtgagagtgggaaccatttccttgcggcagtggcttccgggtgccccgtgtgctggtgcggttcccatcacgcaaacaggaagggtgtttgggcactttgatcaactggaacctttgtatcatgcggctgaattccctttttcctttactcaataaaagctacatcagactgatgctctttctccagatttttagtctcccctcggccacatggagccattatcccccttggcagaaagatttttctttaaaaaaaaaggctagaataacccaagaaaccacatttaggattatgcttccctcaagggaggcaggcagggaggacaccccaggggctttaaacccctgggcatgttttctttctcccattgggcaatggggacaaggacgttccctgtaacgggccttttccttcggcctttttttttttttttttttgctcccggccaaccggggcggaccattcttaaggcctttttgtatgccaaaaacttcatactaaactttctaaagaattaaactttaatgatgggca

SEQ ID NO: 480677 - DNA, 141 bp, Homo sapiens
acagactgcaaacctctatctctacatacgactagcctactccgtcctcactgcactatgttcccatccaccaactaacataaacagtaaaatgacaattcgacacacacacaaacaaactaaaactaccttcccctcaac

SEQ ID NO: 480678 - DNA, 873 bp, Homo sapiens
gagcggtgcaccgtcttgctgaatggcggagtaggatgaggcccgcgggcgtggctccggcgtcggcgggggcagcagcagctgaggcagcagctgaggcagccgctgacggccgggcccccaccgtagaccgtggattagctgcaggatggtccgttgtggctgcggctgatacctgtgggggcctgggtggggacgtgcttagtttcccgaccagtaaggggcaagtacatcgcgagggttacagcggtcacgagttctgagcgagccgggcagcaccatgagagtagcacacagtctccgcccgatataacatcgcagcgtcactagaatctacgcgtcacaatagacacgctcgtgctccaggactagaaagacaagaccgttgtagagacgcgcgcatataatgccacggtcacaatgataacaacgacacccaacaggcaacagagactagcatgacgggatcagcgatcctcgcacgacagaacgattagcactatgtagttaagggtgacgcgtggctatttattagcatgggtgagaatattcgcacggcggcctcagactccgaatggagcgctcgcacagccttcgtaggatcacgatattccggaatcaatgcacgacgaccgcgctgcacacccggggaacataccgaatacatatacgcacgctacgcgatagctctcggccgtagaacgcgcagcgcatgcgaccgcacatcaagaccatgtacgagcacgccgctcacgaaccactgacggaagcataatgcctcgcgagcctgacaaccgtcgagcgtaaacacatccagcagagccgaacctggcctgtccgttatcatgcagttacaaagcgcagcaacgctaa

SEQ ID NO: 480679 - DNA, 138 bp, Homo sapiens
tagaccactcgagacgctcaaatcgtcagcaacattgaatatgcgtattgtcctcatagcaatgtacagctgcgagtcagactgtctagtgtgaggtcagatgataaacactgctactcttactgatacatttaggca

SEQ ID NO: 480680 - DNA, 108 bp, Homo sapiens
ctgcgcatgtatatattaggccacaatcttcaatgagtaaacatattcctcaatcctgtggtgtcttggtacaccacgatttataggagtttctgaagggcagtggag

SEQ ID NO: 480681 - DNA, 433 bp, Homo sapiens
  misc_feature (72)..(73): n is a, c, g, or t
  misc_feature (77)..(77): n is a, c, g, or t
ataaataattaacattttattttgaaaaaatagtcagaattaaagggttgagtgttaaaaagtaatatctcnnatgnccctaatgtcgagaacaattctttttggctttttgggaatcagaaaattagcagtttgggtgcagtggttcacgcctgtaatcgcagcactttgagagcctgaggtgggcagatcacttgagcccaggagtttgagaccagcctgggtaacatggtgaaactctgtctctacaaaaatacaaaaattagctgaaaaaatgcaaaaattagacacacgtggtagcatttacctgtagttgcagctacttgggaggctgaggtgggaggatcacctaagcccaggaggtcgaggctgtagtgagccatgatcgcgcaactgcagtccagcctgggcaatagagtgagactctgtctca

SEQ ID NO: 480682 - DNA, 883 bp, Homo sapiens
tgccccccaactgggtggagcatgatcctgtgatggatgttgctggtggttgctggcctgtgacagagtgatccatgtgttcaccatcctggcccctggaatgaccccccagttcccttcagtgatgattggtgagtgatgctggagtgcccctgtgtgatgatgcatgctcataccatgcaaatgcctgtgttgcctactgtggcttgccaaccatgctgtgcttgcatgcatgttgctgtggcaactgtgcttgatgtgcagatgtgtgttgatgctccatgcatgcctgatgcctgtgctgatggaccatgtgatgctgtgtgatgtgtgtgcccatgagttgaagcatgtgcatgcattacctgtgcatgcctgatgtgcttgcctacctcagtgcttgacctctctgagggtgaccttgcatagtgctattgtgtgcaatgctgcaacaaatagggtttggcacattggcaccccacggttgcatatatcccccttgtgtgtgtgtcccaggtcaggggcaacccaaagaacatgagcaaatatccacctgggtaggtccccatggcccccagcctgattgtcagttgttgaccaccatggtggctgcccaccattccttaaattagctttggtgtgctttggtagtggtttcaatacacggtacggtacatacagttcagttgcctgaagtttcggggttggggaccccaacctcatgcttggcttctggtacgttgctgttgacacttgagtgtgccccaattgggggttacttggcacgagtgatacgtggacgctttagtctgcttgtactttgttgatatcttggatgcatggaccaccgatggcctgtggtctgcagttggggccctttgag

SEQ ID NO: 480683 - DNA, 607 bp, Homo sapiens
aggcggatagatcacctgaggtcaggagttcgagaccagcctggcaacatggtgaaatcctgtctctactaaaaatacaaaaaattagctgggcgtggtgatgcatgcatgtaatcccagttactcgggagggtgaggcaggagaatcgtttgaacccgggaggcggagtttgcagtgagctgagatcgcagcactgaactccagcttgtgagacagagcgatattccatctcaaaaaaaaaacaaaaaattgctagtcttccatggtggcttataatagtcattccagccccccagtcaaccagagaggagaaaagagaaaatgggcttgaaggctagatctcctgccatcaatctgatgggatacaacgtgcaagagatgtatgaggcccacgcttggatccaaagaatcctgagtctccagaaccaccacatcattgagaataatcatattctgtaccttgggagaaaggaacatgacattgtgtctcagcttcagaaaacttcaagtgtctacatcacagaaattatcagcccaggaaggacagagttagaagattgacggagccggggctgacctcattgaggtggatataaccttgaggat

SEQ ID NO: 480684 - DNA, 340 bp, Homo sapiens
ttgcggaccatattgcagtgtggacttaggtccaaggcctccagaggaagaaactggagtctgtcactgtcctactgagacagcacagcaacctagctcagccacatttgttttagtctagaactctatctacttctagaatacagtcaaagatacacaatctgacacagcttcatggggtggactctcaacagtagctgcaatgtactagaatgagcattacttctctagcaatctagatctgaactccttggcttctttacttagttcaggccccagtctaggaacgccagttacatcacagttggctcaggagtcttagagcttacctcattatgag

SEQ ID NO: 480685 - DNA, 269 bp, Homo sapiens
cggtccccgtaagtgccaaatgtacatatataatgaatggtaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagct

SEQ ID NO: 480686 - DNA, 410 bp, Homo sapiens
ctgcccccccgggttcaagcgattctctcgtctcagtctctcaagtaactgggattacaggcacacaccaccacggccagctaattattttgtatttttagtcgagacgggaactcaccatattggccaggttggtctcgaactcaccatattggcctcaggtgatccgcccgcctcggcgatcccaaagtgttgggattatgggcgtgagccagccacggtgcccggcctgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccagg

SEQ ID NO: 480687 - DNA, 714 bp, Homo sapiens
ggctgtgctgaagagagatgggcgatatatatattacttgattacaaagaacagggctgcgcacaagccaacttatgaaaacttacagaagagttagcaaggcaagtgaagtcgtcattgtctgaacaatggagtcactgtaggcactcatccatgcccaggattggatgtggtcttgatcgtctgcaatgggaaaatgtatctgcgatgcatcgaggaggtattgatacgtgcatacagacatcaacatagttactgtgtactcactctgaaccagctgaactattttggatgtttccgtgttctcctgtgtcatctctactgggccataggaccgggcagaacctaccttaagatagtaggcagaggaaagtttcatgagaagtagtgtgtaacacagacagacttcggttgcgtgtcattcacagtattggcgacttatgacgtgtggaggtagggcctcgctgaacgatctgtggtagagcgtgcgccgtcgagcacaacaacaaggacgtctggcccactcgcaataatccccccttccataaccaaaagacaggacgtgtgtaccttgtaactactcccatcatcgatacgatgcattcaagccggccgcggcctagctatgctgaacacaatagccttgctaatcccctcgcacgcaagagcccatcgtagggaccatgtcccctgcatgaactcgccctcgtcgtc

SEQ ID NO: 480688 - DNA, 131 bp, Homo sapiens
actcgcgccctactgagagaatacatttctgttcttgtaaatccaccccgtaggtggaagttgtgatggtaaacactatggacaactaataccacatgacatacctccaactcaggtatatctgctcgtgg

SEQ ID NO: 480689 - DNA, 252 bp, Homo sapiens
agatcgtgccactgcactccagcctgagagacagagtgagactctgcctcaagaaaccaaaataaaaaaattgcagtctgagcttactatgcaaagtggtttgttaaattctgtgactgagaacctgcttaagcacgacactccataggttcaaactcaggcaccttgaacaaggagaaccaatggaggtcatcctgatgagcagcaaattagagcctcattcatcattgctcagatgagattcaaatgcct

SEQ ID NO: 480690 - DNA, 130 bp, Homo sapiens
ttctgtcgattgaggatccgtctgcacaaaggatgccttcttcaagctgctcagcaggcgctggttgggctccagtgggccaggcttggggaacagcacctgttccatgctgctctcagagcctgagggc

SEQ ID NO: 480691 - DNA, 866 bp, Homo sapiens
  misc_feature (22)..(22): n is a, c, g, or t
  misc_feature (65)..(68): n is a, c, g, or t
  misc_feature (88)..(88): n is a, c, g, or t
  misc_feature (90)..(90): n is a, c, g, or t
  misc_feature (93)..(95): n is a, c, g, or t
  misc_feature (123)..(123): n is a, c, g, or t
  misc_feature (146)..(146): n is a, c, g, or t
  misc_feature (149)..(150): n is a, c, g, or t
  misc_feature (153)..(155): n is a, c, g, or t
  misc_feature (167)..(167): n is a, c, g, or t
  misc_feature (219)..(219): n is a, c, g, or t
  misc_feature (223)..(223): n is a, c, g, or t
  misc_feature (227)..(228): n is a, c, g, or t
  misc_feature (232)..(232): n is a, c, g, or t
  misc_feature (237)..(237): n is a, c, g, or t
  misc_feature (257)..(259): n is a, c, g, or t
  misc_feature (295)..(295): n is a, c, g, or t
  misc_feature (304)..(305): n is a, c, g, or t
  misc_feature (307)..(308): n is a, c, g, or t
  misc_feature (310)..(310): n is a, c, g, or t
  misc_feature (356)..(356): n is a, c, g, or t
  misc_feature (360)..(360): n is a, c, g, or t
  misc_feature (362)..(363): n is a, c, g, or t
  misc_feature (415)..(415): n is a, c, g, or t
  misc_feature (432)..(432): n is a, c, g, or t
  misc_feature (471)..(471): n is a, c, g, or t
  misc_feature (596)..(596): n is a, c, g, or t
  misc_feature (626)..(626): n is a, c, g, or t
  misc_feature (795)..(795): n is a, c, g, or t
  misc_feature (846)..(846): n is a, c, g, or t
ccccaaaatggacaatcatgtnaagcagctcaggtcaactgcagggccacattcccacactgcannnncctccacccaccctcaactnanatnnnccctggatcagcaggtctaggctgaaanaaaaaacagtgaggttcccaggntgnnagnnnggtttgacaggnaccataccccaacctgctcaaaaccctaagttagcaaaggaagacagaagantggnttgnntgcncattnccctccccccacccccaatnnnagcttcaaatccctgatcagtaaaattgtgattttnaggtgctanntnntngggttttatcagcccctgggtgattattaccaaacggcccagaggncagntnnagagggcaggaatttgccccactacctgctcagtattagccaagctgctgcnttcagcttgtgcctgtnggtgcctccagcccctctcccttccagaacaggtatggntggaaaccagttctcctgacagaagaagtaagttccaggaggtcctttctcccccagcctgggaggatgggttgtgacgcctgggacagctacacaagcttcttggcttcaaagaagctcttttngtgccgcatctgccagacaccgatggccangaggatgagggtctgcagaatggaccaccacagcacccgctggttggtgctctcactgggtctgccggaagcgctcctctcgccaccgctggtagttctgctctttctggatctgctccacttgttccaccagctgtcgcactcgtagctgcaactcactcaacttgtntttagcagccatttctgcatagtcattggcatgttcacctacctggatgtncaggtgaactctcagcatgc

SEQ ID NO: 480692 - DNA, 1185 bp, Homo sapiens
actaaaagccaatacatgggaacaggaagacagactcatatcaacattgtcgtctttggacacgtagattccgggcaagtccaccacgtactggccatctgatctcataaatgctggtggcatccgacacaaaagatacccattaggcaaccagattttgcagaacggcatggctgctggagactcgtgccgacacaggcgctctcttcaagagtatgccatgtggtcgtatggataactactgacatggctggcagcgtgaagcgtgcgtatcactcaatttgcatactctgccttgctgagaaattgtagacgacccagcacagttactatgtcgacgtatcattgatgtgccccagggacacatgaagatcttgattcacaaacctagtgatttacatgggactagtctcaaggtctgatcgtgtgcctgtccgtgattgttgctgctggtggttgcgctcgaatttctcgacagctggctatctccaaagtaactcgtggcatggacccgcagtacgtcatgcaccttctgggacttacaccactggtgtggtgcattacatcaactgaagttcgtgcggtgcttacacagacaagttgtgcattccaactgcagcgcaccccttactaggcctagcactggagatcactgcacggaacaatgggtcgaaatggcacatgctccacggtagccttttaccatttactgtacacagatgtgggtctgacatatccccgtgacagcgagtagccattgtgtgcccaattctctaggtgtgcgaataggtgaacaaacaatgctggaagcccgaaggtgctgagcaattgcccttggctttccacaggggatggggaagagttcagccccggttaaaggcgagtcggcaatgggccagtgggaatccgacggcttgctttgaagggctgctgggactggcaatccttaaccgaacaaaagtcggttccaagctggacactaagtccgcttggaggcctggctgtcttccgagggcatgtccttaacaagagatttgggttgggcaatttgggtaactgtttccctgtgtggccgaattgggaagagggggtgttccccaaagccccggagaatgggtgggtcacccctatggcgatcccagtgcagcagttgcagggaaggttaaaccttggcgaaatgggccg

SEQ ID NO: 480693 - DNA, 547 bp, Homo sapiens
  misc_feature (225)..(225): n is a, c, g, or t
  misc_feature (254)..(254): n is a, c, g, or t
accctgtggaggtgcagtgcagtggtacaatcttgatcatgaaatctccacctcccaggttcaagcgattctcatgtctcagcctctggagtagctgggtgtataggcatgtgccatcattcccacctaattttttttttggtatttttgggaagagattgggtttcaccagtgttggcctggactggtctcaaattcctgtccctcgacgtgatctggcccacnctcggcctcccaaatgtgctgggatcacnaggtgtgctgttttttggttcggtttgtttggtttggtttttggctttttttttttttttttttggaaacagattttggccctgtacccagggttaagaagcagggttgcaatctcagctcagtggcacccttcggccttccagagttagcggggattccgggttgctgtgccattagtgccgggtatattttgggaatacaaagcaaaaacagagtttttggcctgtgtggcccgggcgggctctaacttcgtagactaaggtgagtcatgggcagccttcccggggggacc

SEQ ID NO: 480694 - DNA, 355 bp, Homo sapiens
caagcaggaaatcttatccacaatacaatatattttggtatatgaaactgataatatatcatgtaatgcacaccaaataagttgtgcattatctattaatttcccttctcaatgtttcagtatgtcgctacttaacaattcacttctcacaaaactaaatttttatattttcacatttttatttacacttacagttttgtctttcacattccaaaacacagcagctccttccctgatttatcaaaataaaagacaacaactaagatacagatggaatacattctttagggtcgtatatgaaaccatgtaacttctagaatgtataccggatgcgatttttcaaaatatgatggta

SEQ ID NO: 480695 - DNA, 804 bp, Homo sapiens
aaaaaacaacacaaaataaggctaagaagaggaccgggaggttgaggcatacataatgagtcggcggctgatttagaaggaggttcaggcatacggatgagccgaagccaacaggagccatggaagtggacagagcccaggagccccactgaagaggaggaggaggaagaggagcactcggcagagcctcggacccgcactcgctccaatcctgcaaggggctgaggaccagggcagatagagggcacagagccagcgatgggcagccagcagcgagggtgagggtgaggccgcacagatgcatgatgatgggagcctcaacaacttccaggagccaggcctaaagtcctggcaggtgcacccgccagccccatgagagtccacaattcaggacaccaagggtcaaacatgtccagagcaaagtgattcatctgcctggacctgtccagaggacacatgtccactgccgaaagctggagtcagttccaacggctccaaaaccgaacgccctcaaatgtctcccagcaagatgatctgagatgttcgtgcggcacacaacacaagatcgacaaaagccacgagtttgcactggatggtggtgaacgatgacaacggcctggctggtctggcctgcacctccgaaccccacgacgagactcgtgtagctgcctcttatgatctggagacggacatccatgtgccaactttcaaatctggaaggcattttcaggcctcatccagcagaaactgagctccggtcacagagaacgtgcagaaaatcccccgcaatgtggccgacatctg

SEQ ID NO: 480696 - DNA, 165 bp, Homo sapiens
ataaaatgtagtgatataattaaccagccattttattgcaatatagtactcatttaagcacttaaaaatggaaggtgtacaaagattaaattaagtgcttaaatgagtactatattgcaataaaatgtagtgatataattaaccagccattaaaaatttacttct

SEQ ID NO: 480697 - DNA, 204 bp, Homo sapiens
gctgagctcaggcactccaccgctcggctcccagagtgctaggattacaggcatgacgcagcgtgcccagacttatcatcccttttctgcagataagtcaagatgaattacctggcgaatgtcatgtcactgtacgaggtggagctgaacttgggcctaggatgtgtagctctatcttaactactgctccaggaatctaatgcg

SEQ ID NO: 480698 - DNA, 105 bp, Homo sapiens
cttttccttcctggtccagctctcacttccatcaggcgtgatagctggtttctgtttcaacatcctgtagctacagatccatttccaagcttcacacccacaatg

SEQ ID NO: 480699 - DNA, 256 bp, Homo sapiens
  misc_feature (24)..(24): n is a, c, g, or t
  misc_feature (70)..(70): n is a, c, g, or t
  misc_feature (231)..(231): n is a, c, g, or t
  misc_feature (250)..(250): n is a, c, g, or t
cagagcatgttaaacactgcttcnggcttactcaggaattcgatatctgcacagacttataccaatcacnaagataaattacaggtgaagaatggtatctaccatgcagtgaaagatcagtgtatgtgaagcagtgaatcagttggcttaattcctgacatggaataatacagagtgtaatttagagatctggcttggtagtctactctttaatgccactgaggcttgtanaatttggtcgcgaaggttngattcg

SEQ ID NO: 480700 - DNA, 263 bp, Homo sapiens
agagcagtctgcacacgtctgtgctccacggtaattatacatgtgtcaggatgtcacaaaagcaattctcctgcctcagcctcctgagtagctgggactacaggttcctaccaccacacccggacaatttttgtatcttgagtagagatggggttcaccgtatcggcgagtatgatctctatctcttgacctcgtgatctgcccggctcgggctcccaaagtgctgggattacaggcgtgtgccattgcaacacggtctctca

SEQ ID NO: 480701 - DNA, 390 bp, Homo sapiens
ggtcgacagcgtggcagcagggagccgtgcaggttgaacgcgccgttcttggcggtggccagcagctcttcgctcaacaggttgcggtagtagaacgagaagatgtagtccgggctcagcttggcaatgcgctcgatccacagaggatggttggcatcttccggggcgtgcacagtaatgcccttgcgagcacagagttgcgctacggaaccgtagaaggcgttctccttcgggtcgtcggcatgggtgaacactgcggcgatgtcgtaacctgcggcgagcaggactcgatgccggtgcaaccaatatcgtgataggcgaagacgacaactttcggattcatggtgcgacctgattggaggtagtagtagaaggggtatcaccagcagc

SEQ ID NO: 480702 - DNA, 736 bp, Homo sapiens
agcgggttcttctttgggacgggtccaggaggacgaagcgctacaaagcaagccactgtgcttactgaacgggctcccccgtgtgatcgcttaatgagaaggtatacaagagctctcagtccagccagagaccaaggccgaaaggtggtgcgggctgcaaccgaaagagtcaaggagcggatactctggctaaaggcacggacaaagtactggcatgaagacggctgaagtgtgccggctgtgactgtcgctgggagaggctactttggtgtaacgggaaagctgcgctgacttgtagtaagctcatccctgcctttgagatggtgatgcgtgccatggacaatgtgtaccacctggactgctttggcatgtcagcttagtaatcagacgatatcgtgtaggagacagaattttttcctacagaataacatgatccttggccagacggactacgaggaaggttcaatgataccgaaggttaggcaccccaggttcgctgatctatcaatcatgcatcccgagttaagaatacaaaagcacgtacattgctttatattcttatgtgggtcgcacagtgtaccattaagaatttgacgaccaggtaacgtagtggaagtagcggtaaggtataggaacggcagcgagtggatagacttggcccttgaaaggcggtacttgcgatctgtatgtagttgaaagttgcccaaggccgagttgagtgttattatttaggaaa

SEQ ID NO: 480703 - DNA, 440 bp, Homo sapiens
gacttgaggtgcatgtacgctgcgatcatgcctacgaatccagcctaggcacagagcaagaccctgtctcacacacacacacaaacacacacacacacaaaaaaacactgaacgagaacgcgcaccctcactgtacgtacgccggcccccaatgaccactcatggacagcactcatccatcctggctgacttttccatcagaaacaacagcaagccagaagcacagtagaatccccatcatgccagtcctgaaaaaacaactgtccagccataaattctatcttgccacaacactcatccctccacaaattcacagtgaactaaaggccttatcaaataaataaacactgaaaggaattcactgctagtagacttgggctacaagaactaccaaaggaagtcctttggagagaatggcaatgctactgtatgagaacttg

SEQ ID NO: 480704 - DNA, 1288 bp, Homo sapiens
ggagcagcccagcgtgcccattccagcgcccgcgtcccgcagaatgccgacgcccccgcctgctggccgcgctgtgcggcgcgctgtctgcgccccctagcctccctcgtctgccctggatatctgttccaagaaaccctctgcctacaacggtggtttatgcgaggagatttcccaagaagtgcgaggagcatgtcttcccctcgtacaacctttgcaacgtgccttaaagggctacggctgggcaacccactgtgagacgacatcgtcgtcggatgccacttggtgccaatggacgcaatggggaacatttgccaaacttcacaggatcgacccgccctcatcttgtcgcggtgtgaccctttcttgggggttaagcacgacaattaggggtccctgtgagccttgggcccggacttgaaacacgggccagggcaattggtccaaatgcccttgagatcaatcccaagcagcaaatggacgactaaaccccttgtgattccaagcgttgaaccttggtggcgggagggatcgtgggtaaacagagtgatgggtgcacgcaagtggtagccacggccgctttggcccaaggtcaactgaggtaaccccttgaactgggcccttgcaaaacggttgcgcccttcacaggacccttctacagtgggaacacccgaaaatttcggacacaccactcccaagcgacactgttatccataaaaaaaaacaacgagcaaagcgaagcttttcgagggctacaccctcggcaaaaccatacacaaacgcgcggagtgcatcgttccaaacccatgttataggaggaaacaccccctgtaattcagagcgacgcatacaagataacggttgacacactttggtacccccccaactgaaggctttgccaacaaaggggccttgcgcagcttccatggcggctttagaaagacacaagtaggggtgtagtaggaagctagacacggaaatcgatcgcacaggctccaccgtatggggcctcgaaagaaactaaacccaggcgaaatcccctgtatcgaaagaccaaaattcaactgggccatcccagaggacagggataacgaaagcaacattgtgggccttggccgtacactattcaagacgtgggaagccccacttcctatatattgcagcgggttgtgacacaaagacaggaggacaactattccaaacggccttaagtttgaccagggagagactaacgtgacacacgaatagcgagtgcaactgccgagtgtgaaccctggggactcctcaa

SEQ ID NO: 480705 - DNA, 171 bp, Homo sapiens
tcagcctccgtgacatcttcagtttattgctgcccaacccatactgaattcaccaactgggggtatatacccaacactaggctcccaccagccatatgccttctcatctgggcacttactactaaagacctggcggagcttttgccatcagcgtgcattcaccagcccatg

SEQ ID NO: 480706 - DNA, 412 bp, Homo sapiens
cggggtaaccaaagcacagcggcatgaagcccaggagccagaaatggcttcctctctggattcgtgtcacagcacagatcttcaaacttcaccaagagcaagtgaatgcccattgcaatcaacatggctttaaactccacacacgtttctcgttgtgctcgatattgaggatttggtgcccagactccagttccaattgaggctccaccaatgaccattaacttccacagccatattggacgcaaagccagcccagtacctccactgtatgatgccatccaaacgaagggccagcagcacagagacacagcagcagacaggcatagatgaggaatttactcgggttaatgtcctggaagaggcccctcaggttcatggcggagatcttcactcgtgccgtattcggcacgag

SEQ ID NO: 480707 - DNA, 755 bp, Homo sapiens
  misc_feature (458)..(458): n is a, c, g, or t
tggaaaaaaataaaacaatttaatggatgggtcttccttgaatttacaccacaatctcctaaaacaagaaggacaaatatttttctctcccatgcatcgggtcacaacgaatgttcagggaccaaaaggcaaccccaagtatacaggtggcgtggtgggtgtctcagactccacgcctcagccctcgagttctcagtgtttccaaccagacgcgtcgtaggctcaagtgacgtggtggcacacggtggggagagagagggacgtgcccagaaccccttcaagttgcaggttgagtgggacctggcaagcagaagttagtgcatgtggtgcacctccagtggccccagggtgcgagaaagtgtgccacgaggggcacagcgaaacacacagctctccaggttgcacccttgaagaacccaggtgggcctcagggggcccagctcctcccaatcagaagncgtgtccctccagggcgtggaagcgtggaggctaggggctagaaggcgctagagggctggagagggaggtggtgataacagaaccatctgcagaaaggaacacatgctgattgctggggccatagctttcctcccagacatctgagttcctgaagacccagctttatcttccaggggtaacaactattcccaagactcagagctggaagggcggcaaagtggagcccggagagaaagatcgatccatcctgaagccgctcgattgttcctcccttttggcctgaggccgaaaccgat

SEQ ID NO: 480708 - DNA, 902 bp, Homo sapiens
taggctaggtagaggctggtgtgaatcggcgagggtgcggctcctgcaggctgagatctgctggcggctgggcagcaccctcgggggtagcatgctgactccagctggtacagctttggctctggtggtggctatggcagtggctttgggggtgttgatgggctgctgttgctggaggtgagaagggcacgatgcatgtaaactcaactgaccgagctggcctcctacctggacttggtgcgtgccctggaggaggccaacactgagctggaggtgaagatccgagactggtaccaagaggcaggctccggggcccgcccgcttgactacagatcagtatctacaggacaattgaggatgtctgcagaacaaagatccgctcacagtcaccgtgcgataatgacaacatcctgctacagattgacaaagcccgtctggctgctgatgacttccgaaccaagtttgagacatgagcaggccctgggcctgagtgtggacggccgatcatcaatggcctgtcgctgtgtgctggatgagctgatacctggatcagagccgaactggagatgcatgattgatgaagctcaaggatgatgctggctaatctgaagaatgaaccacgaggaggagatgaacgccctggaaggcaagtgcggtggtgtagcatcccttgtggacgatggacgcgtgcccagcgcgtggcaccgtgtagctcgcatcctcagaggagatgcgtgagctgtatgagcaagatggcagagaataacctgggggatggccgaagatgggttctgcagcgcgatagagggactggacccgcgaggtgggcagcaacgagtgagctggttcggattggccgagtgagtctcggggctcggcgccctgcagggctggggattggg

SEQ ID NO: 480709 - DNA, 776 bp, Homo sapiens
cacagcagcagctccgcctacctctgagcccaggccccctccctccctcagccccctagtccctccctccatcttccctggggttctcctcctctcccaggctccttgtccttcgttcacagtgggggtccccgattccaatgctgtttttggggagtggtttccaggagctcgctggtgtctgctgtacatgtttgtctactgcacaagcctcggctcgccctgaccagctcggtaccgatgcgtgggctagggctcagcggtccctctcgtcccatcttcggtgcccttcacgtattcgacgcctgctattcgccactctgcctccacccctcgatccatatgtcacccactgccttcacgcacggcgcactcaagtccgtctaccctagaaagaaccatcctctcgtcgcgcacacgaacactcgctgcgacacactcgaccacgatcccctgctgctcggctcttcccactcgaccatcctagtctcccacagtgcacctcgacgcacgcttgacaccgtcccatcctcggcctgatcgacatcgcgcgctcagcacgcccatgcaacacttcctcgcctacacgacgcgctcttcgtcatccgcatagtctccccacacacaccacgccttctcacgcgccgcccacatccggggcgcagcccacaatccaactgcgcttcaaactatcgtcgtccccaaaaacaaacaacatcagctacagcggctcagcactctctcgcttgcgccacatgctctggtcacgagctgga

SEQ ID NO: 480710 - DNA, 724 bp, Homo sapiens
caagaagagtcatacagggttgcagaaattacacgaggaccttaaaggatacaatatagaggcagaaggcctttttatcagaagctttttctctaagtgagcacaacagcctccaaggggcctgtagtgtgttatggagcatgtctggtacaggcagaaaacaatggctcgcatggcacagtgtttgtagtgcttgatgctggaaatgtaagcaggataccatacacggggttcatcttgtcagtggtgtgtcatgcccttagagtgctgcaccaagagagcacactacgagtcgtccctgtacagacaggaggtaagccaagaaaggaaaccaggattcaagtggctaaatcatatgacccaagtagctcccagtagccgaagaaatcagcgaagaatgcatgtcgtcctatgttatggatgacatttgcaggtcactgagcattgctgatgccatgacttctgaaacaggtttttgaaaatctgttcaaaagacggggtcgtcggtgtggcaacatccaacagggcaccggaagatctctataaaaatggactccaagagagctaactgtgtaccattcgatagcagtcttgaaggcaatattgtaatacagtccagctagattctgggcatagattaccggaagagggcaacttgctgctgcgggaaaagtctactagctcacaagtgaagctgatgtggaggctgtcatgggtaagatgg

SEQ ID NO: 480711 - DNA, 211 bp, Homo sapiens
ccgtgtcagtgtcccggacgataaggtcctcatgcattgtagtgagatcagaaatctgctggcccgcgtagtcgctcatgttccccagtgccaacgagcctcactgaccccttgctccctgaccacggctccaccatgatcacacggccgtgctgtccagtgataacggcccactgagcaagcgcccgtggtctgggagactgctggaccc

SEQ ID NO: 480712 - DNA, 160 bp, Homo sapiens
gacatgtagatatagaacgttgattttagaaaggtcattagtttcttgttacacattattgttagatctggtttttgttgcttatcgggtttaatattgttcttgaacattgtttatgctgtgttatgtattacttttctaataaaagttgtgttataag

SEQ ID NO: 480713 - DNA, 838 bp, Homo sapiens
cgggagtcttttagtgtgtgtaggcggctatatcgcgcgagggtgaacgacctggttttcccgcggcccccgtgaattggccacaagatgtcttgacacaaaggacggccgtatcccccaggccgtctgctcgcgaaactctcccccgggggtgccccatgtggtcagttcgcgtggggcgcacacgcacaggttttgaagcaggaagcccgccaacggtcgctgcgaaacatcgggaggttccttcaaaggtgttgaccgcagaaatcttgcggtccggtaccattggggcccgctcgcggagggtgtgaacaccgcccccggtctggctacccagaaataataacatgttttcttataaaacgttcccgtgattgccccccgcatacctgctcgctccgcttgagtgtcgtgttttatacaccccctgaagctctccgtctaaaaaagattatgtctttttcgaaatacacttgagagacctcgtgcatataatgggaatatctttcccgcgacgactagtaattttcttatcaaaaaggaagtctccttccaacatgagacgcacccacgcaatgtcctcggccccgtgctatagcacggacatggtcccgggcttcaatgcttctggccacagtgtacgttctttgtttcaccccgggcctcaggcgccaccagcgatttcagaagggaagactgggggtccataaatatagagtggtaagaatacaggaaatgatgcaggttgctccaagcgccccgaagggttgacgacaggctgtaagagcccaacactctggaagaactgcgccacaaaaaaaaaacattcccccacaaa

SEQ ID NO: 480714 - DNA, 318 bp, Homo sapiens
ggtttgacattggagatacgctcgtaactgtgctaccatactctaaaacagaagaactttctgctactcaaaactgcctttttacaaaatcactgtaaatatttgtaaaataccataacactaaactttaagcccaaaagcagagatagagccatccgttcagttctggacctgctccgtgcggcacagtgccaccccatcacagtgttgctctcatcaggccacagtgaatgtttgtttatggcaaatccgtcttttgcgaatggcttacttctgacactacctttctgggaaatgctcataaattttcaatattca

SEQ ID NO: 480715 - DNA, 1404 bp, Homo sapiens
  misc_feature (311)..(311): n is a, c, g, or t
gttgcgatagaaagatgatgtacagtgaacgacactgaaccagaggatgaccttggagattatgctatggtcatcaggcgagagaaaccaagaggaatgtaaaagttccgctacatgaggtatgaaaatagctgatgagactgatgaagcatctagaagatgaagcactaggcatagaacaatgcatacatggtatctcattcatctaagtcaggtagagggcctggtatgcgccgcggctcggaaacgagactagacataggaggaagcttgctgaatcgcgtgtgcatctgtcgatgaacgcgggacanagaaagtccacgaatattgtgtgtagactgagtggacgtcacccagggacatatttcggctcgagtgaaagaaccctaccagcaaaaggttcggttctcggaagttagagagaaccagtgaagaaaggtatcctgctctgatgcaaacgtgtgtaaacacgcgcttatgcttgataaagacttggggtctcatatatgacttgtgcttagggttaaatccaaagcgtggctaaactcgaaaggggcaaagaatttcccaaaggagaaacacaggataggataacactgttctgtgacgtgacagcatatctatccaaggaacattagtggtccacctctggtccatgagcatggccggaatccacccggtgatcacaaatggtcctggcaagaaaagggaacgacagcggaacctcttagttttcccttaacaagtatggcggagaaaccattgtggtcgacgttgcactaagaaattggtccgttgttgtggcgcaagtaatgtcagaatagagccggtgctatccccacgaggctttgtgccaccggggacatagcggaagcaacaaggatgcctggtgcaccagagaacggctaaagcgtaactttcggactaaatcagggtagaagattgggaaaagacctttggttgtggtggcagcatggttgggcgagggaccaagggttttggccaatacagaggtggggattattacccaggggagtattgaaagaaccatgaatagaaacaaaggttggtgcaggaaattgtatagggtgagggtgggaggggtcctggaaagtaccttgggaaaaaaaggcgggaatgaatcaaagggtgttgagaataacttaatttgggttaatttaaaagacctggtcagaaacgaaacgggtatactggggataagggagggaccgctctccaaaagatccgtgctacaccgtctgcgacaaagcccagaaaactagaacgtaaacaaaccgggcaaagcccagaaagacacacaagacaacgacattaaccaaggacgcggaaaacaaaaacagtgaatgcacactgctgcgtaccccaggattgaaaagggaacta

SEQ ID NO: 480716 - DNA, 1044 bp, Homo sapiens
caagaagtgaacatgaatgacattccagatggacatagaattctctctcttgactctttgaccaacatggtacttaaggggtttcttctttcccaatgtactgtactgtgccctgcatgctgggccttacttgatagaatgaaagcatccgagcttccctaatgaatctggctagttctgtggtctggcgtgaggatactggtagctgtgggacatccacctctcgtgatccctcgagcagtcgcgacgaaaatcgctttcagtttctgctgtttctggagatggtacttctcgctcctggttttcctgcccgggctcctatggttttgagttttcgtagtggtctgctggtactccttctccttctacgtacatgctcggttggtgactctgttcccgccgtggggcagtccttttcttgttgttttccactctcctttcctcttccatctgatagtggcattcaagctgacttgctcattcaaactgttcacggattctgacatctgccaagcgttgcgctgcttgtgaatgggctccacccttgaataagggccacagtcagggtcaaattttccccactaccatggaatacttgcaaatattcacatcgacaccacgttctacgtctagaggccgaaattatatttcctttatattcaaactaactatatggacgcaactaataagtaccatcacataaataacgtttattgtgggtgcatgtgacctattctccggttattttatatccaccttcgagttagggctttctagcaaacgtgtctggtctttgcgagtcactggtgatcctgcgtggtggtcagttgctacgggtactggatcccggggcgctcgcgttttgccgaacgaacaccgggtgtacctggtttgatctggccgcaccaagtacttgtttagaggaaccgggcgggctagttaccgggcccttccgcacccttttaaggccacggggttaagcgccgccctggacactgctttgcttggtggtgccacatcattgctgtgtgccgatccacccta

SEQ ID NO: 480717 - DNA, 261 bp, Homo sapiens
ttctggtgtatgagcttgcgagagtagcgcgtgcgagcgagctaccatcagtgagattatgcgatgcgcgcgtataagtcggcatgacgcacaggcggaccgagcgtgtagcgtgaggggaacccgcgtggcctcgcatatcgcgttcccttctctgtcccctccgcggtcccccccgccccctgaacagccccagggcgggggggagggcgagagctcagtacgaagcagctccctgggtccggtgcggagtgcccttag

SEQ ID NO: 480718 - DNA, 807 bp, Homo sapiens
tggtcgcaggtacggcctccagtgtaggtctctggtgcgggacgcgctattgggtccgctatggggaggccctgttgggtacggtcgtattagtcggtatggctgtcgcgctctggataggagtgaacccccctgggggtttctcgcgtatggtgttaccctcttctgtgcactgcgtaggcgcgactgtgccatgcgactcgatgctgggttagtatctgagtcatgtcgtcctcgaatccggggtttgttggatatacctagacacttctgcactcggtagaacaggtagtcgctaaccaagtgttaaggcccctataaggcctgcaaggcttcctcccgcctacctctttccgcccccgggtggtgactcgtggcacgacggtggccctggtggcatgcgggtgatggcaatgaggtggcctcatggattcgtggtggtcctcggtggacatgtttcatgaggtggtccgtggtggagatcagacgcgtggcgttccgctggtggtccggggcatggatccgaggtggatttggtggacggaacgacgagttggaccctggggggtccccctggacctttgatggatacagatgggaggaagaagaggaggacgtggaggacctcggataaactggataaaggcgagcaccgtcaggagcgcagagatcggccctactagatgcagagaccccgcagagctgcattgagctaccagattcatcgtctttaaacacgagaaaatgttattaaattgtactaattcctatatttatcaatgttggccacaacattatcgtctattg

SEQ ID NO: 480719 - DNA, 109 bp, Homo sapiens
acatgacccaagcctcagttgtattggggtcgacgtgtatacaccacatgcggtgatgcctccctgtactagttccgtcgacacgtgagcacctgtgctgacctccaaa

SEQ ID NO: 480720 - DNA, 316 bp, Homo sapiens
tcttcatagtaaagcgatcacagcaggctggatatgaccctcacgcatcgttaacaagcacataaagtcccaggaaatcttagctttggatccttattgcacccttaaatgttagaatgtagcagaagaatatacagtggtactctattccttatatggagttgttgaacacagaggtactatgaggtcggggccttacactgcctatgccaaggaaagaaccgcaactcgtcatctctctaatcttgtacttctcggtgatataccacaagattttgaaatggaatcaaaagggcagtggttacacattatggcg

SEQ ID NO: 480721 - DNA, 178 bp, Homo sapiens
tgggtgactgaggatcgaatgacgaacacacacatactagaccaactgggatagatacccactatgcttagcctaaactcacagttaataacaaactgtcgcagaacactacgagccacagttaaaatcaaaggactggcgtgcttcatatcctctagaggacctgttcgttccattt

SEQ ID NO: 480722 - DNA, 389 bp, Homo sapiens
  misc_feature (20)..(20): n is a, c, g, or t
  misc_feature (29)..(29): n is a, c, g, or t
  misc_feature (137)..(137): n is a, c, g, or t
ttttccttaaatttgccatncgtggatanttagcccttatttttgtaaatttataagtcctatggccatagtttatcaaagacccctaaaccccatgattttttaaaataaaaatagaaaccggccgggtgtggtgnctcatgcctgtaatcctagcactttgagaggctgaggcaggtggattgcttgaagcccaggaattcaaaaccagcctggccatcatagtgaaaccccatcactactaaaaatataaaaatcagctgggcatggtggggcacacctgtaatcccagctacacaggaggctgaggcacaagaatagcttaaacccgggaggtggaggttgcatacagccaagattggccactgcactccagcctgggagataga

SEQ ID NO: 480723 - DNA, 871 bp, Homo sapiens
  misc_feature (127)..(127): n is a, c, g, or t
agcggagctgtgggcccgggccgtcgtgggctccgtgcttgcgtgcggagatgagcgggtccctcggccgacgctgcgcgcggctctgctccgctgggggcgcggcgcgaggcagcaggatgagacntctgtggggtgactcacagatagtgatcagcgcatgagatcgaagcaacggaccaacggcagcgaagataatcaacccataacatgaggcaacagccagcaagcaaagcaccaagcatgcccagacattatacagacaaaccgcacatgaagcatgcaacaactcccatgagggcagtgacacaccagaggccgctcacagcggtagatatcaacaacaagcgacagaatagcaagaaacgcaatggaatgagaccagagccaccagagatacgcgatcacagaacgaacatgaggccacaattagcaacacgatagcataattcacagatcaataggtaagacacccaacagcagtatccatccaagcacaacagggatggtaacacactctccagagaaaaatgtaagagacaccagaatatactaaagagatagcacaggcacggggcagcaactaggactgacgacacacgcatgcctcaacttacactgtctaggacgacgacaaaacttgacagacaccagaaggaaagacaactagcagagacacaaaacctttaaggcgtgatacaactgcacagcggacaaaaccgcatggacaatcaaccaaactcacactacgtaatgtcggagacaagctgtacagtgtcatccaacggatcatcacactaacatcaatattagcgcagacgcagaacacgtagaccaagacaacaacgcagacacactaacaacgcagact

SEQ ID NO: 480724 - DNA, 677 bp, Homo sapiens
  misc_feature (385)..(385): n is a, c, g, or t
cgatgccctaaaaagccccctcctagtagtaactaccggactcctacccctcacaatcatggcaagccaacgccactgtatccaggtgaaccactatcacgaaggaaaatctctagctctctaatacgtaagtctcccgtacaaatctccttaagttgatagcattcagcagacacagaactaatcatatcaatatcttcttcgaaaacacgacttatgccgcgactggtatcatcacccgatgaggcaaccaggcagaagcctgaacgcaggcacatacttcctattctacaccctagtaggctcccttcccctactcatcgcacgtgatttacactcagaaaaccctaggctcactaaacattctactactcactctcaatgnccaagaacatatcaaatcctgagccaacaattaatatgagtagcttacacaatagctttaatagtacaagatacctctttaggactccacttatgactcccctaaagcccatgtcagaagcccccatcgctgggtccaatagtacttgccgaagaactcttcaaaactaggcggcctatggtatcatacggcctcacacttcattctcaacccctgaaaagacaatagctaacccttcttgtaatatccctaatgaggcatatttataaccagtccatctgctagaaaaaga

SEQ ID NO: 480725 - DNA, 185 bp, Homo sapiens
atgggcattgtcagggaagctgcagagttattgaaccacttggacaccttaccctgtgagtccaacaacttggcccccatgtagagctgaatggtgtcacccttgatggcaggatacagaatgtcaaactccagacggtcaatgctgggggaaatgggcactggtcaaggacaagaagcaagttc

SEQ ID NO: 480726 - DNA, 318 bp, Homo sapiens
ggcggtgaaaggattcaccattctggaaaggaacttaagagacggcgaggaacataatgagacctcacttctacaaaactttttcaaaattagctgggcatgctggcacatccctgtagtcccagttactcagggggctgaggtgagagaaccactttagcccaagaggtcaagagtgcagtgagctatgatctcaccactgcatcccaacctgagcaacagaatgagaccctgtctctcaaaaacatagccaaggccaggaacagtggatcatgcctgaggctgaggcaggaggaccacttgaggccaggagtttga

SEQ ID NO: 480727 - DNA, 181 bp, Homo sapiens
acagttgataggggataatgaccagtttccacttcccaagctggctgcggaacatctgttacaggcaaagatgatcgtattgtcaggacctggccttgctatgagtctcagaacttactccagcaaaaggactgtaaacatggattatctgtcgcttctaagggatgcccttggtacagcc

SEQ ID NO: 480728 - DNA, 493 bp, Homo sapiens
acgtgaggctcagcagagtttaagacacatagtcactattcaccaattaaatgatgaagctgccatgtaaacagtatatcatcacactcccgagcacttcttctccagtagtgtaaacaagcttaatgagcatgcagacactaccatcataaaattatgtagagacatacttgagagttacagtttaaagacaaacaaggtgtcatcatttggtaatacgtagcattaacatatgcttgaaaccttctgctatatatacagtaagattaatttatactaacaaatatcttgataatccccctgattcccagactccttggaatagctccacagctatcagtggttctgacaaaggttcagagccttcccagtactgacttcttatttgagaggtgtgctaagagctatcaagcagaaggttcaattgtacacagattggaagtttaggaaaaagtcatatcttccactaatatttagtcaagcatgtagaggt

SEQ ID NO: 480729 - DNA, 117 bp, Homo sapiens
  misc_feature (99)..(99): n is a, c, g, or t
ctcggtacccttatgtttttctatcctcagattcactgattcttttcctgtttgcttcattctgctgttgagcacatccaataagtttttaacttcagnttagtgtacacatcaatt

SEQ ID NO: 480730 - DNA, 143 bp, Homo sapiens
tgcactagcaggcatcccgggggcggctcctcggtccagtctcagcaatctccagtccggatctccagtcctctagcacatctcccagtcccagcacatctgcccagtcccttccagcacatctgcccagtccggggtcaccg

SEQ ID NO: 480731 - DNA, 175 bp, Homo sapiens
actggaatttagggactagaatcagattcagaaatccctagataataaaactgaaatcattattattttgtataaatatatctacattacttgcttatttaataaaggaatacatttttaattttctagagctattatacatgaaactgttgcttatggcttttcgctttactta

SEQ ID NO: 480732 - DNA, 173 bp, Homo sapiens
  misc_feature (2)..(2): n is a, c, g, or t
  misc_feature (132)..(132): n is a, c, g, or t
angtataacgggaagagatcaggactcgctgtgggcagagataaacgagtgatggcacctattgtcctgggctacaagagctcgagctggaggcgaaccatcaccctgaaccctggcttcagctgatctgancaatagcagctgcccatccccatcccacacagtacagcgca

SEQ ID NO: 480733 - DNA, 786 bp, Homo sapiens
gaaactcggtggtggccattgtgcagtaccatacttcgctcgtattcgtgcgcctcggcttcggcttgtttccttcgcgcaaatgcatgtcatgactagaatccccgagtatgtgctagcattgatctgcacgtaaaccttcgatatacgttcgcaaacttggaacagaacgacttaggaggacgtcacaacgtagtacacaaagtcttgatctgacccttccaagagagagacgtatggaactaggagcaagcaaggcacggacgtaatcgatatagtgaggtgcgttgcgaccgcgcgaaatagtgcggctgataccattttgccatcaaagccatatgcgcctttctatactgatagccttttccctttagtcctgatttagacctcctgtgtaagactgcaaacgtaggttgtgcattcacatgttgtgaaacatgagctgtgccttgcccctcgttttccagcaattcgatgatgcatagcttagcgtgggaactagacttgcagatgggcccggcgccccttggtccggtttgcgccgaattctggctcataattcttgaattccctgggcctgagtcgaacgagagaacaccgcgcatagaaggataactattgtccacttgcttaggggtttggaaaatgggtcacgtaaaagattgcgggtctcgaggagaggcaaagattgagagcgttgcgcgaaacgtaactgtgtcgcaactggttccttaggagggttaaggaccccccaaaggcgtgtccacccaataggttgttcccttg

SEQ ID NO: 480734 - DNA, 218 bp, Homo sapiens
caggacaggttgctgaggttcagcagatactgcggccagcagaaaagctggtgacaagcagtacctaagcagctgggtgacttctggacagcgcgattgaggagctccgccaccaagcccggcagcagggggcagaggctgtccaggcccagcaccttgcggaaggtgccagctgatgcaggcattgagtgccctagagggatttgccgaggtgcagt

SEQ ID NO: 480735 - DNA, 596 bp, Homo sapiens
aagctcattgcgatggaattgacctccaaaggttaaccaactgtcccagctgagaagatgacgcccatccgggtgctgtctctctattgatggaatcgctacagggctcctgtgtgctgaaggacttggggcattacaggtggaccggtactttgcctcggaggtgtgtgaggactccatcacggtaggcattgtgcagcaccaatggaagatcatgtacgtcggggacctccgcagcctcacacagaagcctatccaggagtggggcccattcgatctggtagattgagggcaatccctgccatgacctctccatcgtttaccctgctctgcaagggcctctactagggccctggccgtcttttctaagatttctacctgtctcctgcattatgcgcggtccaaggcctgagattatctccccttcttctggctccttgacgaatgtggtttccatagctgatactgacaatagggacatatctcgatatctcgagtccaaccctatgatgaatgatgccaaagaaattttcaatagacacatggcccgctacttctgtggtaaccttccctgtattaaccgggcgtttgcatcc

SEQ ID NO: 480736 - DNA, 768 bp, Homo sapiens
  misc_feature (31)..(31): n is a, c, g, or t
  misc_feature (69)..(69): n is a, c, g, or t
  misc_feature (73)..(73): n is a, c, g, or t
  misc_feature (84)..(85): n is a, c, g, or t
  misc_feature (93)..(93): n is a, c, g, or t
  misc_feature (112)..(113): n is a, c, g, or t
  misc_feature (115)..(115): n is a, c, g, or t
  misc_feature (119)..(119): n is a, c, g, or t
  misc_feature (122)..(122): n is a, c, g, or t
  misc_feature (129)..(129): n is a, c, g, or t
  misc_feature (139)..(139): n is a, c, g, or t
  misc_feature (146)..(146): n is a, c, g, or t
  misc_feature (154)..(154): n is a, c, g, or t
  misc_feature (177)..(177): n is a, c, g, or t
  misc_feature (200)..(200): n is a, c, g, or t
  misc_feature (203)..(203): n is a, c, g, or t
  misc_feature (208)..(208): n is a, c, g, or t
  misc_feature (249)..(249): n is a, c, g, or t
  misc_feature (268)..(268): n is a, c, g, or t
  misc_feature (386)..(386): n is a, c, g, or t
  misc_feature (513)..(513): n is a, c, g, or t
  misc_feature (603)..(603): n is a, c, g, or t
  misc_feature (613)..(613): n is a, c, g, or t
  misc_feature (617)..(617): n is a, c, g, or t
  misc_feature (659)..(659): n is a, c, g, or t
  misc_feature (670)..(670): n is a, c, g, or t
  misc_feature (686)..(686): n is a, c, g, or t
  misc_feature (698)..(698): n is a, c, g, or t
  misc_feature (753)..(753): n is a, c, g, or t
gggggtaaaggaagagtccagggttaagganttttcattctgccttggcaacaaaaggacaaagaaganaggnaggagggttgnncgggtagngggcctgggggttaggggnngntggnagngggggtnagtgcgatgnagcagcntggttttngctcgggtgggcaatgagtgggntggggggggggtggggccatgangcncaggntctgagcccacatctgggaccagctctaccaagggcctgtngggcccacacaagcttgcntgttcctagttaggctggtaccggcacctcctgaaatgggtcaccctccggttcctgctcagcagctctgagcccttttccagcctcttggagggaagtaacaacaacagcatctgcngaggagcacacggttcaggctccatcaatgacggtgatgtcgaggggccccagggctaccctccacctcgagttacctttgatcacaactagggcatctttctggctgagttaaggtgagaacagtnccctgaagcctcccccaaataagttaaaagtgctctactgtggggtctggaaagaagaaagcaaaaagcagcctattcacgttcacagtngaaaaatgtnagcnaaattgtaaacctgctcaaagaaaattctagaaaggcctctncccctcctganataccttccctatganaggaatccaganacccaagttaaaaagaaactgagcccctgaatctgattttggtcgagggatcgtnggtcagaaatgcata

SEQ ID NO: 480737 - DNA, 129 bp, Homo sapiens
  misc_feature (38)..(39): n is a, c, g, or t
  misc_feature (87)..(87): n is a, c, g, or t
ggaggaacagcgggattacgtcttctacctggccgtgnngaactaccggctcaaggaatacgagtaggccttaaagtacgtccgcgngttgctgcagacagagccccagaacaaccagccaaggaactg

SEQ ID NO: 480738 - DNA, 888 bp, Homo sapiens
agcggaacagcagcggtggctgctgaggggacaggaatcgcctccgcttgcaggcgttacctccaacttgcttctccgcccagctacaggcccccgccctcgcgccccagcgcggtgtccgagctgcatcggcatcgcctgagagccagcccgcaagagcgccggagcgggtgcgggctcctgcccgggttcagatccttggccatctccccccgcgcggaaagcgggagcaggcgggcgggagggacacgcgagcaccgagagcgcgggcgggacaaagcggccatagaataatcccggggtcgggggcactcagggtgtccgctgggggttccaaggatcaccaggttgaggagtacagcaagcatgaacatcccgggacccacaaggggaaaggcagggaaatcacgggcccgagaggaaggcagccacggagtcgccgcatcgtacaaggacaagtagtgcactaccgggataaggcaggaaaagagcacgcacgaatgggaggcgccagtgggagcggcctggaaacacctgtgtcagggggagaagatcaccacgcaagtttcgctcccagaagatgggggcaccacaggagggaacatgagggggcgaaagacggcggaactacgggcacaggccgcacttccgccggcccgtccaggggaccaagcggcgccaaacggacggagaaaagcccaacccaaggacctcatcggtgacggcccggaccgttacgagcgatcacagatgcgacaggcccgccatgcaaacagctaaagaggatggcgacaaggtagcacaggggggaacgggggggaacgatggacggcggaaggaaccgaaagcaacacgaacggcaccgcccatgcggcgaccttcttccat

SEQ ID NO: 480739 - DNA, 503 bp, Homo sapiens
  misc_feature (58)..(59): n is a, c, g, or t
  misc_feature (158)..(158): n is a, c, g, or t
  misc_feature (178)..(178): n is a, c, g, or t
  misc_feature (203)..(203): n is a, c, g, or t
aggggggggggcacaaattgggccgaccccgccacttttaaccgaaccggggaaaaanntggccgggagggctttctggacaccctgggggtttttccccgggccggggggcggctggaaggggccaaaacctggggccgttttcccggggacctggnttaagaaatgggcccttccnattttgcccgggacctggggggggntttgggggggcccaaaggcagttaccatggccgcataaattccccggaagggccctccgacatccccgatttaaaaaaccaaaaagggttttagaaacccccgggaactttgattttcagttcccgaaggttcttcaggggcccaaatggcccccccccaaccccccccgcttttggagtttttttttaaaaaaaaaaggtttttaaaaaggcctgcctctttaaaggaaaaaaaagccttcccccccccccggaaaaggccctttaaatcattttttaaaaattttttttaaaatggta

SEQ ID NO: 480740 - DNA, 688 bp, Homo sapiens
gcttgagcccgggagacagaggttgcagtgagtcaagatcgtgccgctgcactccagcctggcaacagagcgagactgtccccccccaaaaaaaaaagagagagactgcattcaaagaggaccaagactacagtgaaattaaaactgtttggctgggctgggcatggtggctcacacctgtaatcccagcacttggggaggccgaggcggttggatcacctgaggtcagaagttcgagaatcagcctgaccgacatagtggaaccctgtctttactaaaaatacaaaaattagctgggcatggtggcggcacctgtaatgccagctcctccagaggctgaggcaggagcaatgtgcttgaacccagtaggtggaggtcgcagtgagccacagtgtgcgccatgtgcacctccagcctgggcaacttgagtgaaactctgtctcaaataaacaacactaacccttaacacacctattggtgactttggtcttccattcagtttggaaacacgactattggcaaaagtacagagttatcttcagcaatcacttcacaaccttagatggtacccacgagtgacaggagatctggtctggcacgatcattattagatgccacaaggagaccacgtgtgattcctggtaacctattggggaaaagacctaatgacctatatgcattctgtctg

SEQ ID NO: 480741 - DNA, 178 bp, Homo sapiens
agatatgaagtccttgagagcggattatgatgcgactgtgaatgcgtacgtagtatgagtatgctaggcagaatagtcatgacggatgtaagtccgtgggcgattatgacgaatgacctgcgccggtgaagctacagaggaggattaggatgagaatggctgttacgccgatgcggga

SEQ ID NO: 480742 - DNA, 133 bp, Homo sapiens
  misc_feature (12)..(12): n is a, c, g, or t
  misc_feature (33)..(33): n is a, c, g, or t
actctttcccangcgtttgtgccattaggacanatatcatcagtgggcttgttgtaaatgtaacccacgttggtgaacatggtattaaaagttcgttttggccatacactctgaagcagcggggatcctctag

SEQ ID NO: 480743 - DNA, 978 bp, Homo sapiens
  misc_feature (5)..(5): n is a, c, g, or t
  misc_feature (9)..(9): n is a, c, g, or t
  misc_feature (12)..(12): n is a, c, g, or t
  misc_feature (31)..(31): n is a, c, g, or t
  misc_feature (38)..(38): n is a, c, g, or t
  misc_feature (58)..(58): n is a, c, g, or t
  misc_feature (65)..(66): n is a, c, g, or t
  misc_feature (77)..(78): n is a, c, g, or t
  misc_feature (80)..(81): n is a, c, g, or t
  misc_feature (89)..(89): n is a, c, g, or t
  misc_feature (95)..(95): n is a, c, g, or t
  misc_feature (97)..(97): n is a, c, g, or t
  misc_feature (107)..(107): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (133)..(133): n is a, c, g, or t
  misc_feature (138)..(138): n is a, c, g, or t
  misc_feature (156)..(156): n is a, c, g, or t
  misc_feature (159)..(159): n is a, c, g, or t
  misc_feature (164)..(164): n is a, c, g, or t
  misc_feature (183)..(184): n is a, c, g, or t
  misc_feature (187)..(187): n is a, c, g, or t
  misc_feature (193)..(193): n is a, c, g, or t
  misc_feature (198)..(198): n is a, c, g, or t
  misc_feature (214)..(214): n is a, c, g, or t
  misc_feature (219)..(219): n is a, c, g, or t
  misc_feature (235)..(235): n is a, c, g, or t
  misc_feature (237)..(237): n is a, c, g, or t
  misc_feature (244)..(244): n is a, c, g, or t
  misc_feature (248)..(248): n is a, c, g, or t
  misc_feature (267)..(267): n is a, c, g, or t
  misc_feature (271)..(271): n is a, c, g, or t
  misc_feature (281)..(281): n is a, c, g, or t
  misc_feature (300)..(300): n is a, c, g, or t
  misc_feature (303)..(303): n is a, c, g, or t
  misc_feature (321)..(321): n is a, c, g, or t
  misc_feature (329)..(329): n is a, c, g, or t
  misc_feature (332)..(332): n is a, c, g, or t
  misc_feature (334)..(335): n is a, c, g, or t
  misc_feature (363)..(363): n is a, c, g, or t
  misc_feature (383)..(383): n is a, c, g, or t
  misc_feature (387)..(388): n is a, c, g, or t
  misc_feature (391)..(391): n is a, c, g, or t
  misc_feature (412)..(412): n is a, c, g, or t
  misc_feature (424)..(424): n is a, c, g, or t
  misc_feature (456)..(456): n is a, c, g, or t
  misc_feature (465)..(465): n is a, c, g, or t
  misc_feature (471)..(471): n is a, c, g, or t
  misc_feature (519)..(519): n is a, c, g, or t
  misc_feature (547)..(547): n is a, c, g, or t
  misc_feature (549)..(549): n is a, c, g, or t
  misc_feature (639)..(639): n is a, c, g, or t
  misc_feature (644)..(644): n is a, c, g, or t
  misc_feature (651)..(651): n is a, c, g, or t
  misc_feature (700)..(700): n is a, c, g, or t
  misc_feature (784)..(784): n is a, c, g, or t
  misc_feature (796)..(796): n is a, c, g, or t
  misc_feature (820)..(820): n is a, c, g, or t
  misc_feature (877)..(877): n is a, c, g, or t
  misc_feature (890)..(890): n is a, c, g, or t
  misc_feature (948)..(948): n is a, c, g, or t
tagtntaancanttttatttcaagggtattnaaaaaancaaaaatgggggttcaaaanccaaagnngaaacatttanncnncaaagccncagaantnaacaaccaantgnagaccangcntcccaaatccagncttcnttgccatttttcaaaacntcngaganccagtattaaaccgccccnntcnaaatgnaaagntttagaaaaggattgnacacntgtggaaaaggggttncngaaagcngtcnaacaaaaaaaaagaagggntccnatccaagaancagcagtgagggaagaaanaanaaacacccaccaagaaancaatcatncantnnaaaaaaaacagaaccagggccgcccccngtcaaaaaagagaacatggnaaanntanttttaaagacctggggaaaanttcacccccccncagaggccctcaaccccacctaaagagatttnacacacagnaaccancaggattcaccgaggaaaaaccccagggattaaccacgccccccaaangggccaccccaaagaggaacagggtacntntgaggaaaaaagctgccttggtaacttccctcaaatgtttattttaaataaaaatggttgatggaaatattttttaaaagaactttgggnataanatggcanactgcccatcaaacaaaaaaggaaataaaactttctttccatttataanaagttttccacctttactatcaagattacaacttattgaccttttatgcttgcttggtttttttgactgcctaatccaatgttnaaatttttaagnctgcatttcaatgtagtaggggtnatttttcaaataatcttcagacccagaatacagagcaactctcagaataccagagcnacactctcaagtnatacttttgaacccagaataccagaataccagacttcagaacccagaataccagagcnacactctcaagtaatacttttgaccacaat

SEQ ID NO: 480744 - DNA, 341 bp, Homo sapiens
ggatgacattcaaaaaatgaaaacaagtgttggcaaggatgtggaagaattggaacccttgtacactgtcagtgggaatgtaaaatggtatagctgctatggaaaacaatatggagattcctcaccaaattaaatatagaactatatcacccagcaattctacttctgggaatttatccaaaagaattgaaatcaggatatagaggagatatttgcactcttgtgttcattgcagcactattcacaatagccaaatgtgggaacaacccaaattctatctgcagatgaacagataaagaaaatttggtttttaccttccattggactttttttcacccttt

SEQ ID NO: 480745 - DNA, 1101 bp, Homo sapiens
cggacgcgtggggttctagatcgcgagcgccgcccttttttttatttttttggccgggcaataaatatttaaattggtttcattattaatgatgacaaataattttcaagtttaattctccttattataaatcacaaagctaaaccacaaacgaggtataatcaagaacatgggtgtctcactattacactcccatcggaatcctcttccaattggcgtgaccacgtgaccaggcatagcgggggggtgggagggaagactttctaaggtagcaccgtcgtgaggcccgagggtggggtagggggggaatcaaagacgaggacagcctcatcttaccgtgtctccattcacatttataccgtgggaccaggggtgggcaggaaacaccaggctcagggcatccgtgagcccgggcccccgtggacgtgaagggacacgggtgtgaaaatcagtctctgatgaagggcgggagcgaagcagtcacctattcctccgtgccttcacagtataaggtgaaaaccttagccatatcctggatcccgggggggctgccgggccctgtgtgctcccttgaacaccggggtgcctaactagaggctggcagcagcggccggggtacaggggtccggggctcctaggttcacacctaagctacacagttgcgtactagcaggaggacacggggtgtctggataaacaacaaggcatagacagaagtttttggacatttcagaccaaaaggaattagggtgcaatgggtgaaggatagtcagataagaaatatggtcccaattaaaatttaataaggatagaggtacatatcaatgtctctctaaaaagtcaaaacaacaacaaaaaaaaaaacacaacacaacactccacaaagaaacgcgtaagcggccacgacaagaagaagagaagacaagaagaaaagagatggggacaagacatccgagaggaaaaaagaaagcccaagtgcaggaacaaagaaaaacccgggcaacgaaagaactaggtccacgacacacagggcactagagatcctagagtcgggtggaagtcaacaccacagaacatcgagaggcaaaagctaaaaagaga

SEQ ID NO: 480746 - DNA, 1487 bp, Homo sapiens
gcacgacaactggcacctcgcaaaggggacaggacaacagaacggacagacacacggtcactcagtcctcgagacctcagcgcctggctgacagcgcagacgaactgtacttctggctgctctggcccatactcgtttgacatcccttcacactgcacgacctttctggtcccatggtacactgaactctcttcctgtggcaaacgcaatacgccattcctgtccgttgtctgacctggcctgcgcgcactgacacggctcaaacgcgccaagtaccctgtacgcactgcaactctcgtctatctcgatcttactgcgcctggcgcttactgggctgtgcgtcccctaggcgccccacgctgtcacttgtcttgcggcctctccacgtcacgcgtgttggctcacttcgcgggcgcgcccctggagggcccttactttctaccctgcgtgctcgctcttaccctaccactttccaggataatgtctttcccctggcggtggtcctccaatgctactgtcgtccatgtcggcatacgtctttaactgctagtaatcctgctacagatcgagagctcgccacctccagatagcggagaaccccccttggtggctgtcagtatcatcccctccagcggctcttcccagatcgtcatgtgccgccctcgttcccgtcgttcgctgcgatcggtcgctcccgccctgcccgcctatcctgggtgcccgcgcctcctcgggtatcctccattttccctgcgatccgtctcggtccctcttcacaccgcttctgtgacacggacaggctgccacactctttactccgggcaggtgtggcctcccagcctggggctgcaacccttgtcattgcggcacaacccgcccggctgacgcttctatgggcgctttctccgtcatggctctgctcccgcctcatcctcgcctgtaatgagctgtttttccccgcctccgcgctcccagctgtttactctcctttggggcgaaatcctcatcgctgcgcgtcctgcaatcatcctccatatccgctggggtctcgccatcaccgcggcgtcgctgcactaacatcgcgtcggtctcgttgcgtcgctgcgtgactttttctttgtgtcctcacccccggctggcattgggggtcggcaacctattaccggggcgctcatccgtcggtcctcgtccccctattggggtgccttgggctcaagcacagtgcgcccgtacgctcagcggcgcaacgagcatgttactcacacgtccctactgttttccttcttacgcatcgagtggcacatgtctatcacaacctttgctgtgatgcgtgtggtcttgcccctacttttcggggcgtctgttcttcttgtcattcagagccgtgttttgtcagtcaggcggctgaacactctcttgactcctgcggtcctcgctaccccttgacactttctgtttccgcgcgcacctacctatttgtggggcct

SEQ ID NO: 480747 - DNA, 453 bp, Homo sapiens
  misc_feature (289)..(289): n is a, c, g, or t
ctcgaggccaagctcgacctgccggccgacctcggtggcgaccgtcaccaccccggcgaacggggcagcgatgtggtccgggttggcgcggtcggccttctcggcggcgggcacgtcgatggcgatgctgcggtcgcgcaccaccaccggtcgcagctgcccgttgagaatgcacatcacggtgcgcatgccgcgttcgtcgggatcggagatggcctccaggccgatcagcaactccacgccgcgctcgagttcgacgcggtgttcgtcgccctggcgtaatccgtanaagaactggttggcgctcagccccgaggtgtcaccgtactgctcgcggtgctcctcgagctccttggtcggtcccgggaacagcagccggttcagcgccgcctgccgtcgcgcgcccggggcgaccaacgctgcttcgtcctcagcggtcagcggctgctccgg

SEQ ID NO: 480748 - DNA, 682 bp, Homo sapiens
tgcagtggctcaggcctgtaatccccatactttgggaggcagagatggcgtggatccctcaaggccaagaatttgagactggcctagccaacatggtgaaattgcatctctactaaaaatacaaaaattagctgggcatagtggctcatgcctgcaatcccagctactcaggtggctgaggcacaagaatcgcttgagcccaggaagtggaggaagttgcagtgagctgagatcgtgtcactgcactccagcctgggtgacagagcgagactctgtctcaaaaaaattaaccaaataaaataaacactacaaataaggaaaatgctataagcatacagttatcccaacttattatcactagtgaaccaccttaaaaacaacttagacaaatactcaatgtgagctacaagttaactaagtaggatatccatctgaggcaaatatagtacagccattaaacataagcttattcgataactactctttaacgacacaggataacctgggtgtggccagtgtgtgcgtctagttaccagccatttgggaggctgaaggcaggaaaatccctttgagctcaggaggtctgaagccagcctgggccacacagtgagactctgactctaagaacagaaatcagcacatggacactaacactatacgttacgatttttaaaaacagttc

SEQ ID NO: 480749 - DNA, 146 bp, Homo sapiens
agttcaccaggatcccgacgatcaacgccgccggacacacagtcttgtggttccggggtcgagtctggttgcctaagctgaaagttaacaggtaatagacggaagaggcaccaccaggtagtggagcctgcggcgttggatgcagt

SEQ ID NO: 480750 - DNA, 364 bp, Homo sapiens
cggcgctgccaactgcttcatgtgagctgcgcccaggctgcggtgtaatgatgcagcctgacgactgccttttgtggtcttcattacctgctttcggcacaagattcctaaatttgagcggtgcaggggccttgcaagcatcactgcgggcagaacagtcattagcaagcatagaacgggcgctttcttaccaagtgtggaaagtggtcaggctcaccaccgaagaccttctattaagtcaactttgatgatggctccttcagcgacaatctttatcctgaggacatagtgagccaggactgtctccagtttggtcctcctgctgaaggggaagtggtccaagtgagatggacaggacgggcaa

SEQ ID NO: 480751 - DNA, 373 bp, Homo sapiens
  misc_feature (7)..(7): n is a, c, g, or t
  misc_feature (33)..(33): n is a, c, g, or t
  misc_feature (59)..(59): n is a, c, g, or t
  misc_feature (73)..(73): n is a, c, g, or t
atggatnaagtttggagtgtccaggagttaggnaggggaccaagcttttggaattgganggtttggggccccnctttggggttaataaaatggccaatggaaatggcccttctttctccctcatatatactgataaggtcctaaaaaaaagaaagaaaaaactatgcaaaaatagcatttgaacaatcccttgcatgatatgacttcatttcaaaaacaatacattcttctctaaacagaaaagctaatgatttcatttttctgaaatcattaatttttctaagaccactgcttagccttacaaaagtagtctaaaggaaaaaaaaatattttgccaaaacatctgctttaaactttaagagatagtaggcaa

SEQ ID NO: 480752 - DNA, 1765 bp, Homo sapiens
  misc_feature (1138)..(1138): n is a, c, g, or t
  misc_feature (1622)..(1622): n is a, c, g, or t
  misc_feature (1765)..(1765): n is a, c, g, or t
gaagtgggaaacccatactctcaaaccaacctcagcatatgcatgaatggagcttaaagatccaaaccaatagagcgccatattcgttgtagagctcacgcattgtgaagccagggagcaacaagcaagtaaatggccgttaccggaacagatatcctggatagtaagtaacacacaggacctatatatcgtgagcgacgtctgtcatatacctgtgagatttctcctctggattgatggtacatcaacggaagactcctgatcatgtcgtgcctgtaagtataacctattgagacatcttcatcctcgtcgaaatatgtgcataggtacggcaagttttaccccatatgggcagcaatcgaatctttcacatttacgcttgtgagtcggccgtccataattgttccgtcaagcaattgaatacaaagtgaggagacataaaagttataacgggagtcttgcattgtggccgatcgaaaatatctctcagacggcagaattaccaccttgttttcgccacgtcgggacaacgggcaggcacttggtggcccaattgctacgtgaacacacattctcataggacggttttcagaaggtggatccttcacaccggggtgtttatgttacccacagggcgccgacacaattctcagcatgtgcgcttaaaccaaactactgtggtgattaccgccaaattaacaaacatggggagaacagtcgaaataatccgtgggtcgcacatccttgtgcatttcggcccaccgaagggttcattatcattgagaattctacttttcgaacagaacaacttttgggaagtcgggttagggggtgtacgcggcgcacttctagtgctcaagttcaacaccgaaactgctgggcaaaacgaggttcctaatcaaggacaaaacgccgcattttataacagctaatgtatccgttccgaaaatgatagattaccttaaagaaaatgagcgcgtcaatgaacaccattgcctttatccacactgtcaacttctaattgagtccaacaagatacgtggatgactaatggaacatctatagtcgaggtgttatcaacacaattgggttactggttccctatccaacgagtataccccatacattcccgaagaantctagggcacagtatgaagcggacacaaataaatgaacagagcgcttgaacaagttatgtgtaacgacgtttaatatcacctgttataacagtatatttgaccataacacaaacacccaattgggtaacacgatccacagagtttggcacacgccgacaatctgttttgcaaaacgacttaaacgtgggtctgttgccaatttagcaagacaacacggtgtgcagcaataaccccacttgatgaggcacaattacaaccatagtggggactagacacaccaaacaactggtgtcgtgcgtgtaccagatcaagtagcaacggacaagtgcatcctattggtgtagattgtggtataaaaacccacatattttgcaccgaatgtgagtgtatgctatggtaacacacacgggctgtttatccaaaacagtcttaaatggtagtacttgtgacaagagttgtagacacaggctataccacggtgtnatcatgggtagtgataaccagagccatacacaaaacgagcagggtgataacacagaaacaacaacaagaacaaacagcaaagttgtcagcacaggacggagaaaaatcaaacacttgcggcgccgacgcgagtagcagaaacn

SEQ ID NO: 480753 - DNA, 157 bp, Homo sapiens
aatgtattaggggaacagcaagaaaaagaaaaatgatacttctcgtttatttagctgtgccaccgacatacaattcaaagtgctgttttgtgttatttttttaccaattccaatttcaaaatgtctcaatggtgctattgaaacttctaaaactagg

SEQ ID NO: 480754 - DNA, 1467 bp, Homo sapiens
  misc_feature (581)..(581): n is a, c, g, or t
tttttttttttgggctgcttggagttaatttcccgtcttggtgccatggtgcacagtcccaggtgtcatggaaagtctagctgagtgctgggtgcctgggctggtaaaaatcgctggggctctcacttggtttttgggtggtctgctgtgttagatcgcagaagtgtctggcttgctggcacgcccgccatagttttacatgtggttggggtgtgtgtggagatgtgtgtggagatgtgtggtgtgcagatagtgagattctgcgcgagacgtttgtgtgagaagactagtgtgcgctgtgtagagatgtgtgtgctctctagttggtgtgagcactataccgcggcgccctctctcgtgaaatggtgcctgttggagcggccactggagggagcgataaacccgtgcctctcaatgttgctcagtgagaccgtgtgggtgcggccccaaagggcgcgcttgtgggcatgttgtgcgcttttgagacctatttgcaccacgcgcgttgtgagattatgaggtctctcccctctcgagtgggggcggttgatcccccaagaatcgcccctagtgtggcccanatagtggggcgatgagcaccaaactttgccattttgcttgttgaagagtagtggccctatttagtggagaggaagaagatggttctcccccgagaagtatgtgtggccctccatctgtagcgagagagaactcttcccacaaaagaccaatcccgtgggtgttgtggcctcaatagttagaacacaccgttgtggaagaagcagctggtgttgtggtggacacctcatgattcccccccgtggaagattaacaccagcagaaaactggcttgttgcggcccccaccaacctacaaactattttagtcacccccccgcggaggtcgctcaccaacacgcccctattcgtgggcggtcgggaggacaacgaaacccccttgcgggggggcagtgttcgttagggcagagcaacatttgtggcggcttcctcccccccacgaggtgagtcgacaaacctccccgggaggacacaccttttggcctttcgccaaacgagaaacacctttgatcctgcgtctttcggagcacaattgttggggcgaacccccccaccatgtcgtcttggcggcacccccctgaatggtactatgatcaacagtcccagcggtggtgctgtctttgggccccccacgagtaatcgagcacgaaatagcctctggtcagcttcggccaaacagagggcggtacaatctttggtgccccgcggcaaccaatattgggcttatcgtaaaagcacttgattgacgcgttcggtagccattcggtcgtttggagcaaacatccatggggggagcacgggaacaaggacccccccccttccgcgccgtggtggagcccaatcctagcagggcaaacgagcatattccaccgcatagttgttggcgcgg

SEQ ID NO: 480755 - DNA, 108 bp, Homo sapiens
gctatccgcacatcatctgatgctgctgatgatggtggttctgacagcaggtctggagggtcatgagatcagaggccagttccccattagatccttctttctagtaag

SEQ ID NO: 480756 - DNA, 309 bp, Homo sapiens
ggtcgctcttttataaagtctggccacgccagtggctcgcaactgtaatctcagcactttcggaggcaaggcggtcagatcacctgaggtcaggagtttgagaccagtctggccaacatggagaaactccgtctctactaagaaatacaacgaattagcgtgggcatggctggcacactgccttcatgtcccatgccactctgggaaggcgtgaggcaatgagaagctgcttgacacctggtgaggcagatggttgcatgtgaaccagatatcaagcgcatttgcactccagccgtgggcaacacgtgt

SEQ ID NO: 480757 - DNA, 358 bp, Homo sapiens
acccgtcggtgctggggactgtttgatggctggtcccctttatttggagagcctctcccgaaggattgcagtcagaactctagtcgcatcttgttcttgggtcagagctttggaatgttacagacctttgtctcatacacacgtgacctgactggtgccctcacgttggacgttggatacttggggacacttctgttccttactgtgcacgacgttacttttcccttactcacgacacacccaacgctgtgggactgtccacaacctttactttcccgacactgacgtcttcccttcctctgtgtgggctggacggttggacccaactgccctggacctacggtgactcggtgcgctc

SEQ ID NO: 480758 - DNA, 905 bp, Homo sapiens
atcagatagatcagcttctgattcatcagcaagttgaacttctagaagtcttaacaggctttgaaacaaataacaaatttgaaatcaagaacagcctcgggcagatggtttatgttgcagtggaagatactgactgctgtactcgaaattgctgtgaagcgtctagacctttcactttaagaatcctggatcatctgggccaagaagtcatgactctggagagacctctgaaatgcagtagctgctgcttcccttgctgcctccaggagatagaaatccaggctcctccaggggtgccaataggttatgtgactcagacctggcacccatgtctgccaaagctcactcttcagaacgacaagagggagaatgttctaaaagtagttggtccatgtgttgcatgcacctgctgttcagatattgactttgagatcaagtctcttgatgaagtgactagaatggtaagatcaccaagcagggtctggttgtgtgaaagaggccttcacggattcggataactttgggatccaattcccgctagacctggaggtgaagatgaaagctgtgacgcttggtgcttgcttcctcataagattacatgtgtttgaaggctgtgagtaggaacagaaatccgacctgagtaggaatcaactgaaaagaggacagagaagatctggaagtctacaccacggagatcatatgatggagagaactggggccttttggatttctttcatgtgaaatttctcagaaatcaagctgttattcttgaaagcctagtatgttaccatttgggtttcaaatgggacgttaatccttacattctttggcaatcgaccgggtaatttttttatcactttaaaattgggccccttttcgtttaaaaacaccaaggagagttttta

SEQ ID NO: 480759 - DNA, 187 bp, Homo sapiens
gagccccgggccggaaacaggacgagtcccccagcagaggttcccccaagagagagaaatttgcccgtgggccaccacttgtacacaaggggcctcccgggaccaggttgtgcccccaatcgtacaccctgagcctcagaacattgataatttttaaaatacttatttatattaaaagtcttttcca

SEQ ID NO: 480760 - DNA, 206 bp, Homo sapiens
aggagagtagatggtcccctatcacgagagattataataccctacaggaagcactaagtaatatggatgatctatgacaaaaccatgcttggagtctgcattaataggtgtaagcactatcgttcagcaagaatggggtgatgcaataccttgccaggttgtcctgatgacagacggcagtcttggccattggtagagggtcactg

SEQ ID NO: 480761 - DNA, 248 bp, Homo sapiens
ccgagattgtgccactgcactccagcctggtgacagagcaagaccccatctaaaaaaatttttttaaaaagctgagtgcagctttctataatacagatgcactcatgagaggacttgttttgggagatgacattttgcttcattgggttcaaatttaatgttctttatcaccaaaatcaacaacaaaggtgcatccattagtgctggcttatagtgagttcatgtgtctcctctagcgacagcaggca

SEQ ID NO: 480762 - DNA, 259 bp, Homo sapiens
ctaacgatacagttcagagagaaaagatggtgcggtacctgcggtcagtgcagcccccgacggtggcgggggcctgcacatggaggataagtcgaccggggtagggactgcgctcatgtatgtgtctctcagaattctgggtgtcgggcctgacgatcccgacctggtacgagcccggaacattcttcacaagaaaggtggtgctgtggccatcccctccggggggaagttctggctggctgtcctgaatgtatcgtga

SEQ ID NO: 480763 - DNA, 1396 bp, Homo sapiens
gagacgcaagatggcggctgtggtgctggcggcagacagcggttgcagcggggctcgagggttcttggaggctgttcgctggctgactgttatgagacctcctgtcgctatagacggtttagtagctcgcgtgtgtgcctagtccccaacattccgcccatcgtctttcgtcccgttacgcctggatgtacctcaagccgtgtctgttgtgctaacaggttgcatgggacagcggaacacacggttgtggacaacccagaatgtacaccgacctattggcacttaagtggcgacattcgcaggtggctagtcctcacgaagtaacgctttggagagcacgctctgagctaacaggctagcgcaattcattattcaagttcatggactcgacgatcagtgagaggcgaacagtagcctttagatgggacattgtcgcgtcacatgtgtatatgcgacacaagattaggcgagtttctacgttcctaccgaggcctctgatttgtgctagcaagcgcgagagagtactggcaacatttcccctgcactttagcgctgtgtgcggcagaaatggcagtgcgggcgggtctaactctctgttggaacattgtctcgagtgacaatgcaaaggtaggaacacagctcgagccaccacttgtgctacttttgcttggtggctgcgttgtccgtggaattacgcccgtggagcacgggtctcttgtggggcaagcagcgggcgaattgaggttcttgtggcattataaccttttgagaggcctttggaccatgccttggggatttgtccctggtcagagggagtcgcacccctgggtgtgtaaaagcgaaggcaagtatgaacaagaggcagcagcgctcgtggacacgcacttcggcacacaggccaggagacaagttggagacagggcgatacacgaaagaatattctggtcaaggcccatgggcgatcaggggcaacgcccttgtgacaaatcgtcgtgataggcgaggagtgcggcccttaggtaactctcacgcaatgcaaggtgcccaatattccattgatcgtttgcaaccgacaggaaaggtaagctagacaagtttatccacctggtgaactacagcctggggtcagatataaccaaggtgggactcacaggaacgatcgagcctcagggcgtagtggacggctgcctttccccaacccccgtaggtatgaacattgggtcgccaccgacactacgggataacatgagcggtattaatgagcacacataacggcaacttcccaaaactccaggaaggtgaatgaggcttgtacgtcgtaccattattccccttatacgccgttgtcaaggagagctgactcttaacccttaagcgcatgcgtaccacccgagca

SEQ ID NO: 480764 - DNA, 200 bp, Homo sapiens
ggcgtttttttttttaaagggattggggggtgcctgggggtgccctaaatgccttgttaaagggggggtagggataatgggccctggggttttttggtttttaacccctgggggcaaatccaaaatggaatgttacgcctgggtctttttggaaaaggcaaggttccccccatcttaggaaaatgttttttaagctttga

SEQ ID NO: 480765 - DNA, 362 bp, Homo sapiens
agaaaggattctgtaacagtcctcagctaattgcataagtgctatgctgttcatggctggtagattgtaaagagatctgtttaggcctggtgcggtggctcacgcctgcaatccagcactttcagaggctgaggcaggcagatcacttgaggtcagagttcgagaccagcctgccaacatggtgaaaccccatttctactagaaatagaaaaattaggcggctgtggtggtgctcgcctgtagtcccagctactcaggagggtgaggcaggagaatcgcttgaacctgggaagtggaggttgcagagagctgagatggtgccactgcattccagcctaggagccagagtgaaactctacctc

SEQ ID NO: 480766 - DNA, 671 bp, Homo sapiens
ggcgcccgagtggactgaagatggcggctgctgtaggacgggtggctccgagtcgtcggttgcccgacatgtgagtgccattccttggcggcatttctgccactgaagtcctctaggcctgctgcatgtggaatgaacgagcttgacaaattatatgcgtgttctggttgccagtcgaagcaaagattattcacgcgaccagttgcctctatgcacatgtcaccgtgctgtcacccgagcatgcaccctattttagagggtacaagcgcgttgtcaatggagagttcagagacctaagcctgtgatgactttaagggggaaatattgggtgctttcttctatccttggaattgcaccttgtgtgtgtcctacagaaatggtggcttaaagtgacaaagttaaggaatttcgacgatgtggaacgtgtgaagttgtcgcagtctcagtggattcccattttagcctatctttgcgtggatgaaatacaggcaaggaacagaatgggtggtttgtgggccatatgaaggatggcaactctgtgtcagacttaactaaagacagatttcccgagattaccggtgtgctgttgagaaggttcatgggtctgaggttaagagggtctcttcataatgtgagcccaatggagttcatcaaagcatttgagcgttacg

SEQ ID NO: 480767 - DNA, 1134 bp, Homo sapiens
acgtgaccacaccaaaatgccatctcaaatgtgaacactgccatggaaaccatgatgtttacactttcacaacacttctgcttgcggtgactaaacgtgctactctacacacacatgtgacgtgaccctgacgcaatctacctccatgtgcaacaagcgacgattccactggcactctcttcttgcgacaaacactacaacacacatgcaccctctactgcgacttgcttgccgacacacaactaactagacatgcgcacccctgcgaccgcagcttgctatgcacgacttgcgcacacacgcttgcgctgctatcccacgcagccctactccttcttacgccctaaactacttgcctgtgtggcccccctaccagcgccgatatcttgacacttgcgcaaatcttgactccatactatctccttggtaaacggtaaccaacatttcgaacaaccgccaacggaccaggtgcggacaccacgcaccactgctaatcgtggcactcgcacataacgtatgaagcgcagcgatactacctggcactacacactacgcccccttgcaccttacaccggaacgctacttggctaccccccgaaagactgtggagcttcctggcgttattcaccagcgtgcaccaactccatttggccactctccaaaccaagcgtacctatttcccttctccccaacttaaatcgaacacacgtggaacttatacttgccacctttggaacgcgcctatggaacttaccacagtggaaacgcaacaccattaataagcggccaacaacaacgcttggttcacacgcgcaacaacgtttacacagcagcagactccgtcttaagcagcactatttctcgattcgtaagactttattattatggacgccgaagaaatgggccaacatgaagcggaaaaccacgtcggatcacgacggaactccgctgcttacacgacatgacgtaatcgccgaatctgaactttaacagtgcggccctttctcttgcatctggcacgtgtctgctgcatacactgggctatcgctcatagaggtcgatgtcaatgccaaacagtatccacaccccgccatgtaatgtgggacgcccgcctatactcgaagagactaaaag

SEQ ID NO: 480768 - DNA, 365 bp, Homo sapiens
tctagttaataaagcctttaccatagtgatgagtatacgtgctcacagccacctgtgctacccaactcaagagcccctttgttacactcttcatgaacccattacgcggcatgccaaatgtttccaaaatagaagttattgccaccaaccgctattacctccctaacgtatataaatatcttataggccacttttaagataagctaaaaaatatagtgcttgaaatttatctgaaagtatcgaaatttttctcctttagctctaatatatattccaagagtaatacacatgccatattaaaagtagcacaccccaaagcagctcacatttacacgagctcgagatcacctgtgaactcgcgtgcc

SEQ ID NO: 480769 - DNA, 663 bp, Homo sapiens
gtaatttcatgatacaagtatttaataccttttttaagtcagtaaatattctagccatcaataaatgcagtagagtattaagaggggacaggatgagtttactcttaaaattaatcagtatcaaactaagtctactgtgtgtgtttttttttttttgggtttgggttttggttggtttactattatagtaaagtctagtcttatttaaatgggattttggtatcccagtttatatgacaaaatagactagatcagcgcgggtggtaaatgcatgctggtacctcacggttttctccccataatgccgttaaactggctcgccaggtggtgcttaacttatggtgaacgggactggatttggtttggtttggttttttttaaaaaaaaaaccaaaattgtcaggggacagtgcataagcctttccttggtaaagtcaggggggttggctttttcttcaggatgggatggcttgtggtccacgggaatggcctacggcaggggttaacacgtgggcaatatgggcacgctttaaatcctggagttactacaggtctccaggtcaaaggcatagggttgtagcatatcaggcaataactacttttttataggaaaacactttttcactttacgtgagccaatccactttcactggtcgattgtcta

SEQ ID NO: 480770 - DNA, 321 bp, Homo sapiens
cccccttttttttaaaccaggggcttggaagggtttttttttgggggggggggggaaatcccccccgttccgttttagatggggggtgggcaaaaaaaaggggaaggggggggccccccttttttaaaggtgtttcttagggcgggaattttttttaaaaaaaagggggggtaaatgggggggggggggggttaaccggggggggggcttttttaaaaggggggggggccccccccctttttttacggggttggtttttaaattccctggtttaaacaaaaacttttttgtttttaataaaggatttttggccccccccca

SEQ ID NO: 480771 - DNA, 675 bp, Homo sapiens
gggcgcggagacgcttctggaacgaacgccgggatggctgcgcagcgcagagccccaggtccagttcaaacttgtattggtgtggtgatggtggtactggagaaacgagcttcgtgacacgtcattggactgggtgaatccgagaagaagtatgtagccaccttgggtgttgaggttcatcccctagtgttccacgatcaagcagaggatctatatacgttcaatgtatgtggacacaggtccgggcaggagaaattcggtggaactgatgagatggctattatatccaagaccagtgtgcctatcaataactgttttgatgtgacatcgagagttacttacaagaatgtgccataagtggcatagagatctggtacgacggtgtgtgaaaacatcgcaccaatggtgttgtgtggccaacaaagtggatatcaaggcacaggaaagtgccaggcgaaaatccattgtgttacagcgaagggatagaatcttcagtagtacgacgtatctggccataagtaactacaacttggacacgcccttcctctggtcttgcctaggaagtctcatggagaagagcgcctaaactttggtagagttgttgccatgacctgctctcgtgcccattcagaagtaggacaataggagcccaggatttggccagcaccagtatgg

SEQ ID NO: 480772 - DNA, 111 bp, Homo sapiens
cgatcacttctcagcttggtattcgaaaaaacaaaaaggtaggtgtggctgatatatggtgggtggcagcggttccctgacactgatgtacatcgacttccaagaaaacag

SEQ ID NO: 480773 - DNA, 531 bp, Homo sapiens
  misc_feature (27)..(27): n is a, c, g, or t
  misc_feature (47)..(47): n is a, c, g, or t
  misc_feature (132)..(132): n is a, c, g, or t
  misc_feature (179)..(179): n is a, c, g, or t
ggtgaaccccccatttctactaaaatnccaaagttagctgggtgagntggcagatgccgcttcacctgctgataatggaaataaatggaaatgccagagagagagagagagagagaaagaaagagagagaangaaaaagaaagaggaagagaaagagaaagaaaaagaaaggaaaaganagaaaagaaaagaaagaaagaaagaaaagaaaagaaagaaaggtgatgtatttcacaattaatagcatgtcacggttaactggcagcattctttctttcttagtggtacacaaaacactggtgtgagttataatcgatgagattatataaccgaggctttaactcgatagcatgcgataatttccaggactcatttacaaaccccttctcttacttaaaaactgatctccttgtcatatcctaaggacattggaagtgtgtcaaagggtgtgttaaagtttgtactttaatacttcacatgaaaaatgatacacaaaacaacttcccggtgtccatgaatctttaacccgca

SEQ ID NO: 480774 - DNA, 156 bp, Homo sapiens
caggatcgtgggcacatcttcaggatgtgtcgtgggaggccaggaggttggaggtgagtctgtctgctcccccgagagcattgaaagctccgttggtatgttctggacctgatagcgtgtccccaaaggctgagcttgtgcgattacatgccgtca

SEQ ID NO: 480775 - DNA, 147 bp, Homo sapiens
  misc_feature (13)..(13): n is a, c, g, or t
gaggatcccgagngagacgacagaagggaaaaaggggtctgagaaataggtttctcggtatgtgtatgtttctgtgtaagaaagaaagcgagagaggaaaaagatggcaaaaagggagagacagtacccacactcccccttagaggc

SEQ ID NO: 480776 - DNA, 435 bp, Homo sapiens
gccaagtactttacagattcatgcaatacctattaaactaccaatgacatacttcacagtactattaatagaaaaaactattttaaaattcatatggaaccaaaaaagagcctgaatagcttaagcaaaaagaacaaagctggaggcatcacactatctgatatcaaaactatactacagggctacagataaccaaatgggcatggtactgaacaaaaacagacacatagaccaatggaacagaatagagagcccagaaataaggccacacacctacaactatcttatcttcaacaaagctgacaaaaacaagcaatggggaaaggactccctattcaataaacagagctgggataactggctagctatatgcagaagataatatgtcatacctcacatggggaataagcataaccctgagattctcactaacga

SEQ ID NO: 480777 - DNA, 131 bp, Homo sapiens
cgtcacaaacatccataagttgaacatcatgaattcgggatcactgtattcagtaccatgcaatagagtaatctgactaaaaagtctacacaactatttgccgaacatacacagaaatcaaggagcttgtt

SEQ ID NO: 480778 - DNA, 229 bp, Homo sapiens
ataccgatttgtacatgtgtaatgtagttacatgactagtgaaaaagacagaggcatgcctgagtgaagatcacagacaagtgggcagtgagaagcaacacaacaattcccaaacagtgtgaacagtgctgagagtgtgggaaggagtgtgatggggagtgcagagagagcttctggggggagctctagtgaaggggtaaccactactgtggctccaaagcctgttagg

SEQ ID NO: 480779 - DNA, 178 bp, Homo sapiens
attcgttttgctctcgtgaaggtgggcttgctgcttggccttctccacatcagccttggtggcgttgatatcctggtctagccgttcagtactattggaggtcttaggcatccccttggcatatctcaattgccagcatcacttctcttgcaacttggaggccatgacgtaagtaagg

SEQ ID NO: 480780 - DNA, 453 bp, Homo sapiens
  misc_feature (26)..(26): n is a, c, g, or t
  misc_feature (120)..(120): n is a, c, g, or t
  misc_feature (388)..(388): n is a, c, g, or t
  misc_feature (433)..(433): n is a, c, g, or t
  misc_feature (446)..(446): n is a, c, g, or t
caggattctaattaatagcaataatngaaggtgctcggttaaagcctccattctcacgatttagaaatacaagagcatctcatgtcagttttggtagattcagaatacgagaaaataagnatcttcatttcataaatattataaagaataaagcatttgtaaactatctttttttaatttacaggtctgggagtaaaatcaatggaaatggttcaaaaatttgtctattggagatgaccagaaattcccatctatgattgtccaatttaaacatcaaagtctccagcttatggtgcaaagagaatgtacgattgatcatgacattccttaccttcttagcttgtttaaaaaaatatagcatttattgtacaaaacttaaattttgtanaacaatataatctttcatttttattggaaatcctgttcatacttngcataaagtctcntaatgca

SEQ ID NO: 480781 - DNA, 542 bp, Homo sapiens
  misc_feature (314)..(314): n is a, c, g, or t
aagtgccagaaggtgtttactgtccaaaaacaaaaccagccacagaaaaatggagttggaaaacaggctttaaatggcctccagtatataaaatatgtccctatattggatgcctactatccaatagatggatttggatccatacccaatagcttctgttttggtttgctgaaggctaaattcacagcgctaagcaattcttaattttccttaaggtggtatttcaggtttaaatggcccctcagaataagcttccccccccccgtttttggtgcttgaaaatattggtggcccggatttttggtaaaattcanttgtggtatccctttttaaaaggaaatgggccgggtgcccgtaaaaaaaaaaatggcttcagaattaaaactatgaaatattttcccgtttttcttggacagaggacttggctgctagcccaaggttaaaaagttcataacagattttttttttgggctggtttgttgggcagggcctgataagcttcaaagctgctttattccataaaaaaaagaaatggaaaagga

SEQ ID NO: 480782 - DNA, 175 bp, Homo sapiens
aagtcccaaggtttggagaagaaagaggaggagggtaaggaggaagctggcaggcaaatcctaccaattgtaaaggagatctggagaaccaggtctgatacatctgccacgtctgtctttctcaagagttgctccctatgccccatttcccaatgatctcgtttgggtcatgcat

SEQ ID NO: 480783 - DNA, 150 bp, Homo sapiens
gtgatgctcgactgtatgcgtttgtactgttgaccgctgtgggttacgtaagtggggttgtggggttttcttctaagccttctcctatttatgggggtttagtattgattgttagaggtgtggtgcggatggaagccgtcgagtcaacgc

SEQ ID NO: 480784 - DNA, 378 bp, Homo sapiens
tggcgtacgcagataggcaggacatccgtgtgtactgagctcgagaacagtaacttccgtctcatgagttgtcacccctgtgttgaagttgttatcctgaaaagttctggctgtactggcttgtccatgtgttgcacgaggaaaagcttggattatagtgcagtaggcattactacctgtagcatggctgatcttcccaaaatagctagctcattatagatgaaatagaccaactctcttcagtgaagaggacaaatagtattatttaaagcatttgttccaatacaataaatagagggaaacttggatgctaaaataccgtgaataggaatcttcctggcacttagtgtttctatgttattgaaaaatgatgttcca

SEQ ID NO: 480785 - DNA, 844 bp, Homo sapiens
  misc_feature (47)..(47): n is a, c, g, or t
  misc_feature (89)..(89): n is a, c, g, or t
  misc_feature (116)..(116): n is a, c, g, or t
  misc_feature (119)..(119): n is a, c, g, or t
  misc_feature (128)..(128): n is a, c, g, or t
  misc_feature (157)..(158): n is a, c, g, or t
  misc_feature (183)..(183): n is a, c, g, or t
  misc_feature (213)..(213): n is a, c, g, or t
  misc_feature (258)..(258): n is a, c, g, or t
  misc_feature (330)..(330): n is a, c, g, or t
  misc_feature (366)..(366): n is a, c, g, or t
  misc_feature (369)..(369): n is a, c, g, or t
  misc_feature (420)..(420): n is a, c, g, or t
  misc_feature (426)..(426): n is a, c, g, or t
  misc_feature (430)..(430): n is a, c, g, or t
  misc_feature (437)..(437): n is a, c, g, or t
  misc_feature (444)..(444): n is a, c, g, or t
  misc_feature (450)..(450): n is a, c, g, or t
  misc_feature (462)..(462): n is a, c, g, or t
  misc_feature (480)..(480): n is a, c, g, or t
  misc_feature (490)..(490): n is a, c, g, or t
  misc_feature (538)..(538): n is a, c, g, or t
  misc_feature (541)..(541): n is a, c, g, or t
  misc_feature (634)..(634): n is a, c, g, or t
  misc_feature (681)..(681): n is a, c, g, or t
  misc_feature (735)..(735): n is a, c, g, or t
  misc_feature (775)..(780): n is a, c, g, or t
  misc_feature (842)..(842): n is a, c, g, or t
tgtaaaaaataggtggtacggtccggaattcccgggatcggcgagcncagagcctcgcctttgtcgattcgccgcccgtacacacccgntgccagctcaccatggatgatgatatngcngcgctcgtngtcgacaacggctccggcatgtgcaaggnnggcttcgcgggcgaggatgctcccngggccgtcttcccctccatggtggggcgcnccagggaccagggcgtgatggtgtggcatgggttagaaggatttntatgtgggcgacgaggcccagagcaagagaggtatcttcaccctgaagtaccccatcgagcacggtatcgtnaccaactgggatgacatggagaaaatttggtaccanatnttctataatgagctgcgtgtggtttccgaggaggaccctgtgctgctgatngaggtncccntgaactncaaggcnaactgngagaagatgatncagattatgtttgagaantttaacaccncagctatgtacgttgctatttaggttgtgctatttttgttcgcttctngcngtaccattggcatcgtgatggactttggtgagggggtcactcatactgtgcccatctacgaggggtatgccctcccccatgccatcctgcgtntggacctggctggccgggacctgactgactacctcatgaagatcctnaccgagcgcggctacagcttcaccaccacggccgagcgggaaatcgtgcgttanaataaggagaagctgtgctacgtcgccctggacttcgagnnnnnnatggccacggctgcttccagctcctccctggagaagagctacgagctgcctgacggccaggnca

SEQ ID NO: 480786 - DNA, 115 bp, Homo sapiens
cgggagcctactagggtgttgcaatagcgaagtctgtgcctgcgttcaggcgttctggctgcgttgcctcatcgggctgatgcatcgccaaggctgggcgattagctgtgcgttt

SEQ ID NO: 480787 - DNA, 1693 bp, Homo sapiens
gcgtgtgactgggaagtgggacccacccgagggtccagccaccagtccccctcactaatagcggccaccccgtgcagcgtgcgtgcagcagcagcagctgactgcatgcagtgctgacatgctcatgatgcatgtggatggcctgctgcctacctagagtggcctgtgcctggatgctggtgcatgccccatgtgcccacctccccatgtgtgcaccctgctgttcaatagcaaacgccttggtgagcacttgggcaccacagacaaatgatctcaccaccttttaacgaacgaccgaacgaacatgaccctattaaagtcccatggcacagtggaccaaacttactacctacgagcgacggaacatgcatatgagacatgatatgaccgctacgggacgagacacatgtgcctggtcaccgggccgacacagacacgctcacgccggcgcacctaaaccagcgcacccactaaccacgaacaacccccacccgaaccccaccggaaccaaaactccccacaggaagagaagaaacaaagaacaaacacaatcagacagaccacaactcaccaacaacaaccccacaccacacacacaaacaaaatatttcacataatacaaacacacttaataactaaatactctcaaaaccgcaacactaaccactacagcaaactaaaccctcactatatcacactgtttcacctacgccgctcacaaacaaaagttatagagtagtacaagaggaaatcactacactatacaaataaacacaatttactacctagcatcccataaacaaactagccgacggtattggacgaagcagacgagaagagcggaagtagcgacaggctacgaattgagctaggatccgaacggaagatgagcaaggcgagtatgatctgagaggccgggagcaaacgactgagagacttgtgggactgggtaagagatagaaggcagcgaacagggatgagacacggtgcgggccaaggcgggcagaggaggaggaatgaggacagacgatcaaagaaggagagaagcagaaaggaaacaaacaagagatgaggccgaggatacgagatagcgcgagcgactaagtagagcgggacagaccgagagacaggggagacgaagcgaccacggaagaccggagaagagagcgtagagcgaacaagcaggacagcggcacgaggacagaatcgagacgagacgcaaagagcaacgggcaagcaccactgacagacagggataaataatagacaggagaggagtgaaatagcgagaacgcggagcgcgagaggcagctatcgcacctaacgcgagaggcgatccgacctgcagagagagctggctgagtggagcggcgcgtcggccggaccgcaacgtcatagtcccaactcagggcgagagtagagcgacggagacgacgaagcgggacagagtgtgaagacgaagtagatagagatgcgtagtacgagcgataggacgacgagagtcgagagcgagtgtaagcgatagaggcagggaggcacgtagagagggaggagagagtgcatgtgtagggtagcgagtgtagggacgccgtcagcgagagcgatagagcgaagagagcagggagggcgaggaatagaggcgaccggatcagaggggccgaacgtgagcagagaggcagagggacggcgagcg

SEQ ID NO: 480788 - DNA, 121 bp, Homo sapiens
gtgtgcgcgcgctccagtccgcaccgtacggcccaggctaagtagccctcaccatgccggtcaaaggaggcaccaagtgcatcacagagctgctgtacggatttaacttcatcttcggggc

SEQ ID NO: 480789 - DNA, 486 bp, Homo sapiens
  misc_feature (6)..(6): n is a, c, g, or t
  misc_feature (13)..(13): n is a, c, g, or t
  misc_feature (22)..(22): n is a, c, g, or t
  misc_feature (338)..(338): n is a, c, g, or t
  misc_feature (357)..(357): n is a, c, g, or t
  misc_feature (426)..(427): n is a, c, g, or t
  misc_feature (465)..(465): n is a, c, g, or t
gaattnggcacgnggtggcgtnacctgtaatcccagctactcgggaggctgaggaggggaatcgcttgaacacgggaggaggaggttgcagtgagttgaggtcgcgccactgcactccagcctggtgacagagtgagaccccgtctcaaaaaaaaaaaaaagttcagttttctgtgaaattaagttagttcctttctaaggttgttggaggattaagtgaattactatttacaacaatatctgacatgagtaagtattccataaatgatagctattattgttgttcattttgagggaagagagagaccctctaatattgttctatactcagaaaaggnaacgcgaagaggaaactanaaggcaagggttagcccagtgcctaggggaacccacaccttgaaacccagggccttaggccttcccttnnccctaaagccctgggtagttaaaaattcggcccggtancctttagcaacttattgttta

SEQ ID NO: 480790 - DNA, 184 bp, Homo sapiens
ggtcaggactgaatgcctcagtgtgccaggcacccagcaggcaagagtaccctctagttgtcagagtcctgggtggcagaaaaccaacctaaactcacttaatgctcacctgtggatgtgtatttggttcattttggccagagaagtcccaaatgtagggccgagctcacatgggtttccatgc

SEQ ID NO: 480791 - DNA, 327 bp, Homo sapiens
  misc_feature (226)..(226): n is a, c, g, or t
gatctagaggatccgcgcgcttcttcgtcacatcagcagctattgatgagcgcctccagtgtgcttaggtccctatgcggcgcgggtacagcagtggacagacaggccggtcctgtccttcgaggagcccatgatccgcggggagacaggcattaacgacgatcacacgatcacttaaatacaactgttgtgaacccgggcaacaaaaagggagggacgcgcgggngtctgcggggaatgacgatggcgacctcgtcttggacccagggagggcaagggtggaccaggcaaagggaacagaggactggtgacctggaagttgctagg

SEQ ID NO: 480792 - DNA, 372 bp, Homo sapiens
atttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttc

SEQ ID NO: 480793 - DNA, 200 bp, Homo sapiens
  misc_feature (28)..(28): n is a, c, g, or t
  misc_feature (30)..(30): n is a, c, g, or t
  misc_feature (32)..(32): n is a, c, g, or t
  misc_feature (79)..(79): n is a, c, g, or t
aacctgaccgtggttctacagaccaaanantngctttcaattctatcgaagaaagtgtttgaatatgtccatcaatttntttcacgtcatctccgcacaaccttcacactggtggtggtgacacagggtttcaggagagccccgtggcctcatggaaggggagcagagttgaagcgagcccctccgcgggaggctgagct

SEQ ID NO: 480794 - DNA, 884 bp, Homo sapiens
tgccgtgtgtgatgacgaagggtacctcaccactgacatcagggatagattagaatgggagtggaaggctatggaacgaccagacatatttggaggagatcagacagtgccactaccgagatgagttcagccaccaggtgcaggagtggcaccggagctggaccatggtcatcgagcgggcttacacagcgagttcctctatgtgcagatggcaaagaactcaagaacaagctgctggctgtatgcctgaggaatatgtcataaaggcctgtagtcgaaagctctacaattggttgagagtggcaccctagcgacagatcagcaggtggccagaagatgacgactttatggacgagaaccaagggaagggcattcgagtcctcggattgctttctcctctgccagagatcaccctgtgttctagcgccctggtccactggtgaaggagaagtgacagaccttccttcgaatggcccattttaccaaacggcgaactgcatggagagaggaagagcgggaaacgacggctcaagacattgaaacgctaagagaaatttctcctgaactaagaagcctcattgtagtgacagttgcagggaggagcacacaggggacgccccagatgtttgcttgcagatgttgacgccgcattgtacatgatgctggaccagggccaagcagctgtcatctactggggcgtacaagcctgggtgagacaccgaagtggggccttgctctactttgaaaacccagaagtcagaggcacgattccgggactaaccccccgtggccgaaacaggccgattccatggccgggcttcaggcccctcgtatacttgcccgtgtggcccataaacccctggcccagttacccttcgaacttt

SEQ ID NO: 480795 - DNA, 164 bp, Homo sapiens
  misc_feature (144)..(144): n is a, c, g, or t
aatttttcgtccaaagcgggcaagtggacctggctagcgggccggctcgatcacattgcagttggtccgccccgacatcaggcagtcctgcatcttgctcgcggccgtgagatcacgcgcgaccacaggccgaccgcagaatgncgcagcaatgatcagtccgc

SEQ ID NO: 480796 - DNA, 218 bp, Homo sapiens
cccccggtatcattcacttgtatcatttgaaggtaaacaatatatggagctggatcacaaaccctgaggatgccagagctattggtccagaacatggtgtggtattatcatagcagagttcagaagggtctgaactctacatgttaccagagaacattatgcatttcatgcattccacttagcaattttgtccaataccagaaacagacccctagagt

SEQ ID NO: 480797 - DNA, 1062 bp, Homo sapiens
cacagctggcgagtgtacccgtttctgcgagagaagctaaagaatgcccttgcgtgaggaaattaaatttatgttcaagctaaatgtcgtttatggcactgggaacacaagcattgtcgtaacaagttctggtggaaatccgtacatggatacgttctcattctgggggcggtctccagttcctttctcatgagggagcacacgtccatctgcctcattgcagtggcctcagggatatggaattaagatccacctggtgtgatgaataaacccagactctcagcaacgcaggaaaatacaacaacaaaaactggttggcgatctggagtaaaggatcctcacatccacgtgaaccaggaaactctgtgcccaagatcgactgaaaaagagaacacactggggcagagccgaactaacaagtcttttagcacggggtaccagccctagaatttccagtagaccagcagacagccgggaaaccagatcctcatcaaaagacagaaagaaaaaaattcgaagccagcctgagaagggccctatttcaatgctgttaaccactgagactgcatcctcaacagtgagacaggatggaccaacatactcaagctcaaggaaacatctaacaccggtcggaaactcatgggatcaccggtacctaggattaggccatataaagtttaccgttacagaaccgcctactctcatattacgtctcacaatggacacttatccctacctatccggacaagcccctgggcatagggacctagctgacaacacgcagtaccaagggccttaaaagcagcccagacccccgtctcggcacaggtgccacatcacgagacgctatggctaaaccacagtatagacgggcgcccaaatgagaggacaccggccgccttggttgtcacggcacaagagcatcgccatcagaggtagggcatagaacatgactactacgcggagggcagcacaacgcaacacaatatatacagaaagaatgaaacgtacagaaacttcagcaagtgatctgctttcttgtgttgtcttctcctgaccggg

SEQ ID NO: 480798 - DNA, 240 bp, Homo sapiens
caggtgacgcccgagttccgcaccgtgggggtcgtggcagccgcttccacgcgccacgctcatccgccgcacaacgcaacggcggccagctggagccgggccagcgggggcaccctcgccggctccggcgctcccggccgcgccgacggccagccccgccgacctggtctacttcgaaaatctcccgacttctgcgcgggaccgcgcctggactcggcgggcaccgtgggccgcctgtgc

SEQ ID NO: 480799 - DNA, 1152 bp, Homo sapiens
  misc_feature (1152)..(1152): n is a, c, g, or t
gcaccgtatgatgagaccatcttaacgatagcatataattaagcatcacttggtcgtatccctagatacaaccggcccattggaacgttactacaccttgtcaatattgctcctatagatgtgagttgactgccaatgggatatctatcatagcaaattatggcctgtctatcttatcttgaagtcttcatgtgccagagtgataactggagcttcgtgcgtacctgtctcgtttccattgaattgggttttgacaaggtcgaccattggacattgcctaagttgtaatcaatgctctttgcctttgttcctcgagacacgtattgacactgctggcatcttttcctagacaatgcagtggtgcatagtgaactacgtagtaggtacaatagatactacaacatactaattaacgtgtatccacagacatgacaccgtgacgttacgacttctagaaaaggtagatccgcctattcattctaaaaaagcttctctagtctagcgcctcgttgatcatggcgtcgtactacatttcttaatcaggctgggcatattgaagccattctagattgagttcctcgctaagtaccagctgttaactaacaggctagtttcacttcatactaagactaaaagattgttttcgctaacaatggcgcttgaccactagagggaaattttataatgttgcgaacggagtgtacatagaatgaaaacaaaattgcattgaatgttgtcggaggacaatatttagtttccagagaatgagtgcgtaggaattatctattgtcaagttcgactcaaatgtatatttaaaaaaccgcatgtttaaattgaagttggttaggagaaaggtaaaaatcagtaattaagtgagtcttcactggcactcgtcaaaagtggaaggggtctgcaacatttggttaacagaggcaattaattgggaacgtataaatcgtaaggggcacccgttgtaacgtttcctgcgtatacaagtacgagaaaatgtctggtaaacaatggtggtcagtttaccataaaatttctcaatgttttgggcatttgaaatttgattaagttaattgtcccttcctttgtaacgttaatttggtcagtttgttacacacaaatatttatttcagggacggtaan

SEQ ID NO: 480800 - DNA, 298 bp, Homo sapiens
gcacgaggatagatagatagatagatagatagatagatagataggatagattagatagatagatagatagatagatagatagatagatagatagatagatagtctcatcaggactgccagaaaataactcacatgaagtttaactttaatgtcagttttttacgtgtggcctaagaaagcagtcttaccttatacaaacatgaaaagaaaattaatcaacagagtagaattttctactgttaaaattaaaagctagattgtgcagatttaaagagtggaaaacaaactgctctttttg

SEQ ID NO: 480801 - DNA, 182 bp, Homo sapiens
agcaggtggccatctcagcctcctaatgacctccggcctagcccatgtgtgatttcacttccacgtccactaaggctcctcatactaggcctactagatccaacatcactaatccatataccagatgatggcgcgcatgtaacaccgagtaaaggcagcatagcactggggccactcgtgga

SEQ ID NO: 480802 - DNA, 1033 bp, Homo sapiens
caggttgggttactgtatccccagttggaggtaatagctggatttattccggtgccctgttagtgacgaaaggccatataatgtgccccaagatatctgttagtctcccagagaagcttgctgaggctaaatgttagaagccgtaaactatccacccaatctctgcccaacaagggttctcagacactctgttttgggctggtgcccgcactcacaggtggtacctatctggacatgccagatcccccacttgacagaaattatgttggcttggcagctgaaagtgtctcccgaatttcaacaaggaaggatatagcatcttttcctcagtctttatggagtcaaatttgcacttgtactctaacttattggcacatggaagtgtgtgttaacatgcctcttagggattttttttttttttttttggaagcactggaatacagctttattcctacacgattagacccgttaccccgtgggtctggccgaccgtcctgacttggagatccctgagctgcgccgacgcttccttcgtcaacattcagcagctacttgatgagcgcccttcagagggccttaggtccctatgccggcgcggggttacaggagaggacagacaggtcggtccctgttctctaggagcccatgatccgcgcagagacaggcgtttaacgacgacttacacgatcacttaaatacaactgtggtgaaccgcacaagatggacgcgcggtggtctgcggtgaatgaccaggccgacctcgtgtgcgacccacggagggcaagggtggaccaggcaaaggggacagaggactgggacctggaggtgggctggaggcgtttggatcattggaggaaaggaatagccctgtgtgtgatgagcattgagaggaggtatggctagcaccatgtatggctgaagaactaggcaatgggttagcgcagtcagctgggcggacacgtgagccacggcatgaagaaagggtttgggcctagagtgcgggttcttctgtcttggtctttagatcttttgg

SEQ ID NO: 480803 - DNA, 383 bp, Homo sapiens
  misc_feature (36)..(37): n is a, c, g, or t
  misc_feature (365)..(365): n is a, c, g, or t
  misc_feature (371)..(371): n is a, c, g, or t
aagcgcccagatgcgacttgtgatttaatccgccanntgagctgttcgtacaatggctgatgctctgaatttgtcccattcacgccacctctttttatttaatttgcgataaccgcacttttcgtcatgccaaacccaaccaactgtactacgtgtactattgtacatagtacagttgaacgtgtcaacacgtgacaagcttactgctggccacttttgcctcataaacaacgcaaaaaagcaccgcaacatgattgttgcagtgcttttttgacaaacgaaaccccgtatctgcttacaatacgggggattatatatctttaagattgagaagagaagagattttttaggagagagaataaatngaaatnccccagtattta

SEQ ID NO: 480804 - DNA, 720 bp, Homo sapiens
  misc_feature (4)..(4): n is a, c, g, or t
  misc_feature (61)..(61): n is a, c, g, or t
  misc_feature (68)..(68): n is a, c, g, or t
  misc_feature (70)..(70): n is a, c, g, or t
  misc_feature (85)..(85): n is a, c, g, or t
  misc_feature (87)..(87): n is a, c, g, or t
  misc_feature (93)..(93): n is a, c, g, or t
  misc_feature (99)..(99): n is a, c, g, or t
  misc_feature (108)..(108): n is a, c, g, or t
  misc_feature (110)..(110): n is a, c, g, or t
  misc_feature (132)..(132): n is a, c, g, or t
  misc_feature (134)..(134): n is a, c, g, or t
  misc_feature (141)..(141): n is a, c, g, or t
  misc_feature (153)..(153): n is a, c, g, or t
  misc_feature (174)..(174): n is a, c, g, or t
  misc_feature (210)..(211): n is a, c, g, or t
  misc_feature (213)..(214): n is a, c, g, or t
  misc_feature (220)..(220): n is a, c, g, or t
  misc_feature (225)..(226): n is a, c, g, or t
  misc_feature (237)..(237): n is a, c, g, or t
  misc_feature (246)..(246): n is a, c, g, or t
  misc_feature (253)..(253): n is a, c, g, or t
  misc_feature (256)..(256): n is a, c, g, or t
  misc_feature (306)..(306): n is a, c, g, or t
  misc_feature (326)..(326): n is a, c, g, or t
  misc_feature (340)..(340): n is a, c, g, or t
  misc_feature (345)..(345): n is a, c, g, or t
  misc_feature (349)..(349): n is a, c, g, or t
  misc_feature (358)..(358): n is a, c, g, or t
  misc_feature (368)..(368): n is a, c, g, or t
  misc_feature (375)..(376): n is a, c, g, or t
  misc_feature (378)..(378): n is a, c, g, or t
  misc_feature (384)..(384): n is a, c, g, or t
  misc_feature (401)..(401): n is a, c, g, or t
  misc_feature (407)..(407): n is a, c, g, or t
  misc_feature (410)..(410): n is a, c, g, or t
  misc_feature (416)..(416): n is a, c, g, or t
  misc_feature (433)..(433): n is a, c, g, or t
  misc_feature (436)..(436): n is a, c, g, or t
  misc_feature (446)..(446): n is a, c, g, or t
  misc_feature (526)..(526): n is a, c, g, or t
  misc_feature (547)..(547): n is a, c, g, or t
  misc_feature (595)..(595): n is a, c, g, or t
  misc_feature (646)..(646): n is a, c, g, or t
  misc_feature (719)..(719): n is a, c, g, or t
tgangtaaatgactttactttgagaaatgaaggaaaaaaattacaggaacacatggaaaanacatgancnccaagggaaaacaancnaaccanaaagcnttaacgccngncagtcaagccgaagccgaaatncngggagcntgacacgccgcngggccaaaaggaatggacaancagtatcccccccccccccccccccccccccccccnncnnaacccnccccnncccccccccanccccccccnagggccnccncacccccccgggccccccaaaacccccccccccccccccccccccccccnccccagtcaacaaaggcccncctggcaaacaccnggccnaacntgtggcccnggcgagcccnggccccnncnatggcngtggtgttgcccacgcntgcccncancccccngtcccttggccaggccnccnccaggccccncagtgggaggctggtagttgatgccaaccttgaagccagtcgggcaccaatccacaaactggatgctgcgcttggttttnatggtggcaatggcagcattnacatctttgggaaccacgtcaccacggtacaacaggcagcaagccatntatttaccatggcgagggtcacatttcaccatctggttggctggctcaaancaagcattggtgatctctgctacagaaagctgttcatggtaggctttctcagcagaaatgacaggggcatatnt

SEQ ID NO: 480805 - DNA, 180 bp, Homo sapiens
atgggtaaaaaggcatcctgagagagttctagaccgacccatgttcctgtggacacactatacgggtcacgaggggtggcaagacaggcctaatctctatgacggtgaatctcagggctatttgtggatttgttataaacagacattcttttggccttttcctggcactggtgttgccgg

SEQ ID NO: 480806 - DNA, 328 bp, Homo sapiens
gtgatatgccttgatgtgggtttgtttttattcaccgtgctatgtaattggtgggtacattcaatctgggaactcattttttttagttctggaaatttcttccctttcatttttttggtgtgatttcttttcctggatcacatattatttggatattggatttactagatttccttggattttggatttcctggattttcttatctttcctgtcttttatctgtgtttttttttgttttctttttttgacctcactttctgaagcaacttcttacaactttatctcttaactcttttattgcggtttgcatttcaggcactatgattt

SEQ ID NO: 480807 - DNA, 813 bp, Homo sapiens
  misc_feature (1)..(1): n is a, c, g, or t
  misc_feature (71)..(71): n is a, c, g, or t
  misc_feature (113)..(113): n is a, c, g, or t
  misc_feature (136)..(136): n is a, c, g, or t
  misc_feature (144)..(144): n is a, c, g, or t
  misc_feature (166)..(166): n is a, c, g, or t
  misc_feature (175)..(175): n is a, c, g, or t
  misc_feature (198)..(198): n is a, c, g, or t
  misc_feature (208)..(208): n is a, c, g, or t
  misc_feature (237)..(237): n is a, c, g, or t
  misc_feature (267)..(267): n is a, c, g, or t
  misc_feature (269)..(270): n is a, c, g, or t
  misc_feature (275)..(275): n is a, c, g, or t
  misc_feature (306)..(306): n is a, c, g, or t
  misc_feature (313)..(313): n is a, c, g, or t
  misc_feature (321)..(321): n is a, c, g, or t
  misc_feature (325)..(325): n is a, c, g, or t
  misc_feature (502)..(502): n is a, c, g, or t
  misc_feature (508)..(508): n is a, c, g, or t
  misc_feature (543)..(543): n is a, c, g, or t
  misc_feature (550)..(550): n is a, c, g, or t
  misc_feature (558)..(558): n is a, c, g, or t
  misc_feature (583)..(583): n is a, c, g, or t
  misc_feature (588)..(588): n is a, c, g, or t
  misc_feature (593)..(593): n is a, c, g, or t
  misc_feature (605)..(606): n is a, c, g, or t
  misc_feature (630)..(630): n is a, c, g, or t
  misc_feature (634)..(634): n is a, c, g, or t
  misc_feature (636)..(636): n is a, c, g, or t
nactggaagtaacagtcaaaaaattcttaaagccactggattagaggcagagagactgaaagaagagaccngggaagaggttgctacagaaatgcagtctgggctgctaaggntgatgtgtggagatgccaaaganagcctcangcagtagaagctggggctaggnatggtagcngctcacacctgtaatctgaacantttgggaggncaaagttggtggatcagttgagcccaggngttcgagaccagcctgggcaacatggtganannctgtncccacaaaaaatatttaaaaattagctaggnatgatantgtgtgcntgtngtcccatatattattacttggggggctaaggtgggaggattgctttagtacaggaagcggaggctgcagtgagccaagatcatgccactgcactccagcctgggcaactgagtaagaccttgcctcaaaaaaaaaaaggcagaagctggagatgaggaaaggtagcctcctactgtncagatncaagtcccaccagaatatctcatcctcctttgcanaaaaagnaataatgncctagagcagtgtcctaccttattntactnaccanaatgggaaatannattactttctaagttgaattgagnttgnantcagaaggtacagctataggctgggcatggtggctcacaactgtaatcccagcactttgggagggcgaggcgggcagatcacttgaggtcagaagttcaagaccagactggccaacatggtgaaaccccatctctactaaaaatacaaaaattagcgcacacctgtaatcccagcta

SEQ ID NO: 480808 - DNA, 117 bp, Homo sapiens
ccactgcctgctggtgaccctggccgcccacctccccgcccgagttcacccctccggtgcacgcctccctggacagattcctggcttctctagcaccgctgctgacctccaaatacc

SEQ ID NO: 480809 - DNA, 195 bp, Homo sapiens
tagtcactcggacatgtttactctcatgtatttcctgatgtctttcccagttttattaggaattttttgctgtcctcttactttatttattttgttagttttgttttactttattttaaatcttttctagagatgggggggtctcactatgttgcccaggctggtcttgaactcctggggtcaagcattctactc

SEQ ID NO: 480810 - DNA, 104 bp, Homo sapiens
ctaaactacagcagcaacagagagagctaaaacaattgcaggaagacagaacgaaactgattgacattcaggagaaaattcaagcattgcaacacggtctctca

SEQ ID NO: 480811 - DNA, 280 bp, Homo sapiens
gcaggagaaagatgtccatctccgtgagcgcgggatgcagtgtaagatggtgtagagctactactaggttttagtgacaaatttacgtaaatgaaggccctcaggacccagatgctcatgcggctcacttcaattgcatatgattggcgaatgggacattcgggaatttaaatctttgagataagaagggcttgtcgttaaatatggaggcaattatttcattctaggtccaatacgcaataacaatgtgtttcggttttccactcagcaccttcaaaac

SEQ ID NO: 480812 - DNA, 105 bp, Homo sapiens
acagaacccaaaaaaacccccgcaaaaattcaaagcccttgcaaaattttttaaaatgtcagggtttgggaaattaaatccaaaaaaaactttttgaagggtgta

SEQ ID NO: 480813 - DNA, 323 bp, Homo sapiens
  misc_feature (208)..(208): n is a, c, g, or t
tcctccccgcacgcccaaaagtacaagtcaatccagccatgtcttcagctgaagagacggtctgcctggttatagatgttaacctcatggggcgcttagtaaagctatctcctctaaggaagccttatggttggcagctttcctgttttttcctaaagtataaaaaaacaacaaatgaggcctttctcatgtcatcttgattctttgngtcatgtttactttttattggactgataaagtccagagttttcaacccctgaatagacaggggtgattatcatagttggttatggcagataatgtacacaggagatgcaggccat

SEQ ID NO: 480814 - DNA, 420 bp, Homo sapiens
  misc_feature (420)..(420): n is a, c, g, or t
ctttcaacttatgtgcgtgtactgcgtagctgcgtccgacgtctgtggtgacctcttgacctttgctgaccacagaaatgggcagggctgtatcctggaccactcactaggatatctctcaccccgactgaatcttgacgtgttgcgtcctcgtggagtccctgaacagagatgagcatgatggcctcttggtggatcaccctgatatgactgacaatttgcggtttctacaagtgggcctcctgggagcccctagtgccgggagggccactgtctgcccgcagctactgggccgaaaggggatccctgaatccgggaatgtgcctactacttctatgccaagatctgtaggtgatcacgattggaacccaggtgatgctacttgacacacatggcattataactcctggacacactggn

SEQ ID NO: 480815 - DNA, 109 bp, Homo sapiens
cacgagggcgaccatctcaaccaaatccgacggagagatggtgctgccaggcttcccggacgccgacagctttgtgaagtttgctcttgggtccgtggtggcagtcacc

SEQ ID NO: 480816 - DNA, 931 bp, Homo sapiens
cacgccgaagggttcgcgccgtctccgcgccttgagggagcaatttgtggcgctctcccccatttccgtggtgtccaaccctcagtgttcccgggtgccccccctttgggttgcgcggtcagtataagccgtattgcggggtgggcaggcacccccgttttggtgtacgcggcttttataaactgtttatgtagtatctggccagaaaacgcatcagttgtgcatcaccgcgggggcgccgccgccaatgattgggggcgaaccgctccgtccactgcccagtttttctcccaataggcgccgctgtgcaatggatcagctgtgccacccccagagtcgaccgagcggcgcaaacagcactgggggcgcaccaaacttgcagatgccaaggtcatccccgggccgacccctggccacggctggcttaaacgaagtagaggggtcccccagtccacgggcccgtgatacgtggccgacgactagcgacacttgggactcgagagggtcgcctacaacaagttcgcccccagatagcggcccgacaagagtgtcgctataactagactactcctactcccagaggacgacttcacgactacgacggcttacacgaccagcggtcgccacacgcgcaactgcgtggcgcacccagggcgcctccccattggccacgacggagcggtctaggagcacccgagtatcgcaccaccccgaacggcggggggataacaagggggcttacaccaagaacagtcaccgcggaggaccaacacgtaggatctaacccatgcgtggggagttggcctccaaaaaaagcgaggcaaaaaggcggggggaagagcccccccaaacgcacgagttcgggccaaaaaatggggcaggggtgggacattttagaaaaaacccccatacccgccccacaataacgacc

SEQ ID NO: 480817 - DNA, 243 bp, Homo sapiens
tgtccgcatctggggaccgctctgcttcataccaggtctcacatgaagttgatctcctctgtacagaatgtctagcctatggcttgcagttcaaccttgatttcatgttgggtgcatccacttccttcgtacagagtcaccaattcattctctgctgctgtgcgcttcttgatttcatccatcctatttatccttaacagtcctccaccatgtcctgcatgtttctcagcattcctcgcaaca

SEQ ID NO: 480818 - DNA, 259 bp, Homo sapiens
attcgcggccgcgtcgacttttttttttagatggagtctcattcactctgttacctaggataaagtgcagtggcctgatcttggctcactgcaacctctgcctcccaggttcaagggattctcctgcctcaggctcccaagtagctgggattacaggcacatgccactatgcctggctaacttttgtatttttagcagagatggggtttcaccatgttggccagggtggtgtcgacgcggccgcgaatttagtagtagt

SEQ ID NO: 480819 - DNA, 314 bp, Homo sapiens
acgatcgcttatgtcgcgtgcatgttggagactctcgtcgtatccccccgaagggcgtgacatcaccgtacggaccaagccgtccagctctacaggtcatctttgcaggtggtcaggacaggtacagcacaggcagcgacagtgcgagctttacccacaccaccccggtcatgtgactcaaacctgagctggagggaccacctctagaggcctataccattcaaggacagtatgccattccacagccagatttgagcaagctgcaccagttggtaatgcaacagtctcattttcccatgacacatggtacgcgg

SEQ ID NO: 480820 - DNA, 400 bp, Homo sapiens
gaaacaagccctcccatgccatgtccccgtgggcccccccttatgtaagaatatttccatatttcagtgggccctccccaccccagcacttgtccgtagggtcccacgcgtgccccgttgttgaatgtatgttgggtatccccaggccctgaaaaggtggaaaaaaaatcgggtccatttggatgataaagagaaattaacttttcccaaaggaagttttgcccttaacccccctttttcctaaaaaattgttcctaaatgggattttcaaggggaaaattgtgagaacgccactcccgtagttgatgttgtgggctgtaaaggattttaggaggaattttaaaccggaaatttaaaaggggggaaatttttaaaaagcaataaacattcccggatttga

SEQ ID NO: 480821 - DNA, 1338 bp, Homo sapiens
tcacaggatttttatttataaaatttaagtgggtaggggggcgcccgacccaaaagaggcagagggggtgggggggtggggcaccaactgcgagggcgacacacacagagaaaacacacaacaaaacagtgtggccagaggcccacacaaatttcttctgtggcgggggggaacagagagggagtgaaaacaacaacaaacacgccgggcgctgcgacacgcgcggggcgtgacaaagagggcggagggcggaccccagcggggcgcggtttctcccccgcgcgccccccgagagaaaccacaccccttgagccgcgcggtgacacacctctctcgcacgcccacgcgcgtgtgcccccctataaaaagatactcacatctctctttcatgcgtgccactctgcggcgccccctgcgcgggggctcttctctcctcgcgtgagcccccccctgtagagacatgtcttcccccgcgcgagacaagaatcttcccccgaggcgagagacgacacaacaggtctctcgaggggccgctgtgaccccccccaaacaccccccccacaattaacccccactcttttttgtgagagggcgggcacaccccccctgtgtggccgcgggccccgtgtgtgtctgcgggcccccccccctctttataaaaaccctcccacaccgcgcgtgtgtccccccccccccgtgtgggggaacacaccagcactccgtgaaactcccgctcactctcccatctacccactctccccatccccctacccccccgcgtggggacacacaacaaccaccgagggagcaaaaacaaaaagaccccacaaaaccaccccgcgggggggagcgggggcgcctcacaaaccaccaccgcggcgcggacacacactcgccctgtgcaacgcgaacacacaaaaacacaacacccccaccgacacaaaacagaacgcccccacaaaaccccccgcggcaaaccacaccgcgcccagcaagcccccacccacaaaggcaagcaggcggcaccccgggcacaatgcgcagcgcaccccgccgtcccctggccccccccccgccccccggggcacaggggaccacccaccaccacccccggggcggccacatgaccagcggagccgcaccacctcaaaaaacaaggcccccgcaacacaccacccggcagacaccaccgacgaaaccccgcaaaaaaaacatcccccccaccacacgaagaagcaccccggcgagcacacaacacaaccgccgccacaaacgagcacacaccaccccccaacaccactctgctccaccccgcccaagagactccccccccgcaca

SEQ ID NO: 480822 - DNA, 380 bp, Homo sapiens
cagcttatcaacagattcacttagagctacagacattttactctacattaagcttctcatctttcacttctgtagtgaaggtcgctcttatctttatcctctgaaatcataaacaatgcaaaaaagaaaaaaatatatagctaccctctatatagtgacgttctactcaatctctggcttaagagccccaaaccatgaggagtaataatagaaaacctaagactaaaatgtaagttatcacagccatacagtcagtgacttccataaatcttttaatttgccctccactttaataatcacctcactgaattgctatgttcaacaggctatactagaactagatctaattattgaataaaaatagaatgtatcaggccggg

SEQ ID NO: 480823 - DNA, 231 bp, Homo sapiens
aggcatatccaggataaagagcatcccctccgaccaggcagaggctcatctttgcaggccagcagtctggaagatggccgcactctttctgactacgacatccagaaaagagttgaccctgctcctggtcctgtgtctgagggttgtctgctaatatcttcagtcatggcattcgcagtgcccagtgatggcattactctgcactatagccattggccccttatcgattgg

SEQ ID NO: 480824 - DNA, 102 bp, Homo sapiens
cgtgaggttattgattctccaagaagaactgaggttgtggagcgggcaggtaggacctattgttcccgttgcgtcttggctgctgtgggatgctgttgattc

SEQ ID NO: 480825 - DNA, 214 bp, Homo sapiens
agccaatagatactatgatactatacatatgtagctaggcgtagccatggcgcaagtagatactacctatctagcatacctagtcgggacaatagccatgggtaacataggtaggtagcctgccagaaacatgcactagtgtataggcgtaacagtgtactattggcgggatagtacccacgctacacactatacatagatagggatattcgaa

SEQ ID NO: 480826 - DNA, 598 bp, Homo sapiens
cgctcgcgtggcctggagatttaccagaggaaaccgcttttaccgttgttacgggtttcttgggcaggcatttaagaggacaaacacttattgcccatttttccacatacacgtggagcagtttattagaaaaacaaaacttaaacacaagattctaaatgcgaggggcagtttaatggataaaatatgacctgtggcgaaacaagcagctagctacaaaatccatcaccaccaacagtttcaatgttagcactaagtattaaaccaaagtaatgcatattctgggttagcttcttcaagaacagcccgtttattctggttcaatctctctgaacaatactgggaggtaatagctacactgacaattctcacaaaaaaacagtgttgggtcttgccatcactgaatttatagtataaatctcccaaggctttaatctagttcatcagtgcagtttagataagagagccatacaaacaaatgggcatactgtcagttaatgagaaatacaactgcacatgcacaattaatattactctctcttaatctactaagagaacagtttattagtagatttaacaaaaaccatctctagaattg

SEQ ID NO: 480827 - DNA, 748 bp, Homo sapiens
  misc_feature (207)..(207): n is a, c, g, or t
  misc_feature (276)..(276): n is a, c, g, or t
  misc_feature (312)..(312): n is a, c, g, or t
  misc_feature (384)..(384): n is a, c, g, or t
  misc_feature (401)..(401): n is a, c, g, or t
  misc_feature (408)..(408): n is a, c, g, or t
  misc_feature (413)..(413): n is a, c, g, or t
  misc_feature (418)..(418): n is a, c, g, or t
  misc_feature (426)..(426): n is a, c, g, or t
cggccgctcggcggaggggacgggccgggtactctcctccttcctccccgagctccagctgccggcaggacctttctctcgctgccgctgggaccccgtgtcatcgcccaggccgagcacgatgccccctaaaaagggaggtgatggaattaaaccacccccaatcattggcaagatttggaacctcactgaacaattggtattgtnggattgccaaactgtcgggaaatctactttcttcaatgtgttaaccaaatagctcaggcttcagccagnaaaacttcccgttctgcactattgatcctaatgagnagcagagtacctgtgccagactgaacaggtttgacttctctttgtcaagtaccacaaaaccagcaagcaaanattcctgccctttctanaatgtgngtggnctatngctggccnttgtgacaggagctcacaatgggcagggcctggggaatgctttttatctcatattagtgcctgtgatggcatctttcatctaacacgtgctatcgacagcactgatgactattccacggcccgggttgcaagggacagatggtagcatccctatcccgcagccatatcagacaatcaatcacatgaacgaagcttccagttcaacgactgccggcacatgatcggcgccaatactgctcaatacacaaaggtggctgtgacacgcagggcgtacaaacctcaacccgaccatgataccacgccccagccaactctgggcacc

SEQ ID NO: 480828 - DNA, 563 bp, Homo sapiens
  misc_feature (254)..(254): n is a, c, g, or t
  misc_feature (316)..(316): n is a, c, g, or t
  misc_feature (321)..(321): n is a, c, g, or t
  misc_feature (325)..(325): n is a, c, g, or t
aattttccatggagctcctggaaacctcagagataaaattatccacataaacctgtgagttcaagggaatgatgagacgggtccagaaattaagcctgtcctcgttctgatatgcgtattctcttggtccctcggtaaaatacctcccttcccatgcctggatttacccttccgaatgccgtgtgaggttcactcacttttatgttagaaaggacctacacctccgagtctagaaagaaacatttattcatggnagagcacaagcttttgaatttgataaactagattccaattaagctgtggcagtcaccagctngggcnggtntgtaacagaatatccatatcacaagtataattgtgtaaaagaaaatcatgatatctacacacaggatgttagaaggagtgagagagaatttatgtaaagtattgtgctgtgtctgaaatgagtggttcacaatatatgttatttcccttctttacatcctcctttctgctaaattcagtccaccaactcgggtctctgaatcccactcaagtcaccatttgcccgactcaggtggtgt

SEQ ID NO: 480829 - DNA, 199 bp, Homo sapiens
agctcaggagtctgagaccagccttgcaatgtagtgagactctacctctcccaaaatatacatataaaaaaaattagccaggtgtggtggcatgcacctgtagtctcagctgcttgagaggctgaggcgggaggattgcttgagcccaggaggttgagactgcagtgagtttgtttgtaccactgcactctagcctggg

SEQ ID NO: 480830 - DNA, 447 bp, Homo sapiens
  misc_feature (288)..(288): n is a, c, g, or t
tgccacatgaagaaacccaaaggggagaaacataaaacctttatatgtcagtgatataaaattctagaaaatgcaaactaatccatcataaaggaaagtaaatcaacagttgtctggaggaccagagagagcaggaggagagagattattaaaggggttaaagtaaatttgggagtgcccttccatttttaaatactatgaaaatgaaagtaaaggcacatgcatgttgtaaactaatagtaacaaacagaatgggttggagtggggtgttgtctggggacatcattncaaaatgtaagccagtttatctaaattttgaaaagcccgtggactctgatctgactgatgaatgttggaagagataagtgtgctgcaaatgggggaattaataaaacagctgtatatagactagtcatccctgtcccccctgggtcataaaaccaaaaa

SEQ ID NO: 480831 - DNA, 348 bp, Homo sapiens
  misc_feature (281)..(281): n is a, c, g, or t
tcacacacacacacacacacacacacacacacaccacaatttcttcattcatctgtatatgggcactatagcctggttccatatcttgactatgtgtgaataatattgaatgaccaagagagaccagatatctctttgcacatatttattccagttcctctgtacctttttgaggaccctccatattttggttattccaaaatagctatacctatttatattcccaccaatagtgtctaatggttcccttttctccacatccttcccaacacttgttatcntgtgtctttttgagcacagccatcctcacatgtgtgaggtcacagctcagtgtggttttgattctca

SEQ ID NO: 480832 - DNA, 711 bp, Homo sapiens
  misc_feature (352)..(352): n is a, c, g, or t
  misc_feature (520)..(521): n is a, c, g, or t
  misc_feature (532)..(533): n is a, c, g, or t
  misc_feature (541)..(541): n is a, c, g, or t
ttcccacgggggtatgggcccgcggcttttcccaggccacccttggggcttccccctgcggggcctttggggtttgttctcgcttttacctggtgtgcggtttgcccggcccccatggggcgggaaggcggttttctcgggggttttccgtttcccccccccttcggctatggggggtttgtttggcccccaaccccgggcctttcccaaatttgtttcaacccccccccctttccccaaaggggggggggggggggcggggggggggtttttttaacaaagcctttttttttaaccccccggttccccgggggccccccccccccttttttttccccccttaaaaaacccnggggccgttccccccccgggttttttacttgggccgggggggggttaccttttttccccgggaaccccttttgccctttgggcctttttgggggcccctttaaaccagttttgtccaaaaaaccggggggggccgggccgggatttcccgggtttttttgccccgggnncccccccgggnncccccccngggtcccaaaattcccaaatttttccggggggggggggggcccccctttttccccccccctttggggggttggggcggggaattccttttacccccgggggcgggggttccgggtgggggggttcttcccccccccccccccccggggcccgggggggggttgggtttta

SEQ ID NO: 480833 - DNA, 521 bp, Homo sapiens
ctgcaacaaatgcccatggcccaactatatgacctctatccttggctgaccacagccctgcccacaggcgagaatccatggtgctgattctatccagttgtcccgaaacaaattttcaatggaaatctgaggccccaaggcttcccttgtagggcaggtcactgataaggttccacttgcctcaaccagcctatagctcttggacatggggagacagagtcagacgcaacacctgtcctgtgtcccagacagtgggggatggaggacacctggggccccagtgctcacccgtggcacaagccctgatacgttagctcttctatactaagtgcaccaggcttgagccccacacagggaacaagggagtgggtgggctgaggccttcagctacctgggagcccagcagtgttctcggccagacatgaaaatgctcctttaaaccaaaaatgtcatggctctgcccccaacctgcttaggcacggagggtgaagcctggaggggggcaattcctatgctccaca

SEQ ID NO: 480834 - DNA, 675 bp, Homo sapiens
  misc_feature (352)..(352): n is a, c, g, or t
  misc_feature (520)..(521): n is a, c, g, or t
  misc_feature (532)..(533): n is a, c, g, or t
  misc_feature (541)..(541): n is a, c, g, or t
ttcccacgggggtatgggcccgcggcttttcccaggccacccttggggcttccccctgcggggcctttggggtttgttctcgcttttacctggtgtgcggtttgcccggcccccatggggcgggaaggcggttttctcgggggttttccgtttcccccccccttcggctatggggggtttgtttggcccccaaccccgggcctttcccaaatttgtttcaacccccccccctttccccaaaggggggggggggggggcggggggggggtttttttaacaaagcctttttttttaaccccccggttccccgggggccccccccccccttttttttccccccttaaaaaacccnggggccgttccccccccgggttttttacttgggccgggggggggttaccttttttccccgggaaccccttttgccctttgggcctttttgggggcccctttaaaccagttttgtccaaaaaaccggggggggccgggccgggatttcccgggtttttttgccccgggnncccccccgggnncccccccngggtccaaacccagggaggggcggggggggggggcgggggtttggggtttgggtttttttttttttccccccaaagcccccccctttgcccgtttttttttcccacccagggaataaaggggttctttttttta

SEQ ID NO: 480835 - DNA, 159 bp, Homo sapiens
acgaaaatgggcaagaacataattgccttgccgatgaaaaaatagtggtcctgccaggctataaaaagcagcggtgcaaaacttagtcctatgcccgcccacgctggcagcttgcgcacggcccacaaaaatatattgaacaaaatgagcgagtgaata

SEQ ID NO: 480836 - DNA, 755 bp, Homo sapiens
  misc_feature (352)..(352): n is a, c, g, or t
  misc_feature (586)..(586): n is a, c, g, or t
  misc_feature (588)..(588): n is a, c, g, or t
ttcccacgggggtatgggcccgcggcttttcccaggccacccttggggcttccccctgcggggcctttggggtttgttctcgcttttacctggtgtgcggtttgcccggcccccatggggcgggaaggcggttttctcgggggttttccgtttcccccccccttcggctatggggggtttgtttggcccccaaccccgggcctttcccaaatttgtttcaacccccccccctttccccaaaggggggggggggggggcggggggggggtttttttaacaaagcctttttttttaaccccccggttccccgggggccccccccccccttttttttccccccttaaaaaacccnggggccgttccccccccgggttttttacttgggccgggggggggttaccttttttccccgggaaccccttttgccctttgggcctttttgggggcccctttaaaccagttttgtccaaaaaaccggggggggccgggccgggatttcccgggtttttttgccccccggggcccctttttttaatttaaaaaatacctctttcccggtttggttgggggccgggaattaaccccncntatatggggcccatttttctgggcccggccttttttaataaacccggggtttttttccccccccctttggtttgggggaggccccaaattggggggggggtggatcccggaagggggtttggggggtttgattttcccccccctttattaattttttctttttccca

SEQ ID NO: 480837 - DNA, 594 bp, Homo sapiens
  misc_feature (352)..(352): n is a, c, g, or t
ttcccacgggggtatgggcccgcggcttttcccaggccacccttggggcttccccctgcggggcctttggggtttgttctcgcttttacctggtgtgcggtttgcccggcccccatggggcgggaaggcggttttctcgggggttttccgtttcccccccccttcggctatggggggtttgtttggcccccaaccccgggcctttcccaaatttgtttcaacccccccccctttccccaaaggggggggggggggggcggggggggggtttttttaacaaagcctttttttttaaccccccggttccccgggggccccccccccccttttttttccccccttaaaaaacccnggggccgttccccccccgggttttttacttgggccgggggggggttaccttttttccccgggaaccccttttgccctttgggcctttttgggggcccctttaaaccagttttgtccaaaaaaccggggggggccgggccgggatttcccgggtttttttgcccccccgggccgggggggttgttcaagggcctccccctcctttaatttaaacccccctttttttgccgggggggtttttta

SEQ ID NO: 480838 - DNA, 765 bp, Homo sapiens
ataagatattataagaaatctagtaaatgatttaaaagcatacaggaggatgtgcatagggttatatgcaaatactatgctatataatatatgggacgttgagcatttgtggatttcgatactgggggcactcctggaaccaataccaccttcatggaatgccaaggatacagactgatatgttatactattctccattcacatacggctagttgattgaaccaccaatgctcagataagtccattaatgcatggaatatggagccgtgtgaaaaacatgtctcttgaagtttggagtccgcgtggtccaccataaatctaccttcaatatcagaggtccatataaattgatgcctaaaccatacaggaaacattagagtcagaaattcttctttagaaaatattcaagatgtgttggtatcccgatgggattattctgctatcaccacaggagtgtaaaaaaatccactattaatgatccatctaagtatagtgctcattgggtccttatctgaatgattgacaggttctttgtcaggtgtatcatatccgtcagtcctgtcaatagtaaggactcatacctgaagagtactgaatgcaggacttctggtcagaagaatgctcctggaatctgggtttgaatgtttttgacaaagtacgtattggcatgtccgtcacgagagtgtggggtaagagtgaccttgtgcggaccggcgtagtacattctcaaatgttcctcagggtctttatctcgtgtactattgg

SEQ ID NO: 480839 - DNA, 1224 bp, Homo sapiens
  misc_feature (391)..(391): n is a, c, g, or t
tgacggccggtgagattggaagtggcggcgtgcggcaggcggcaggaggggagtcctgaggttatgcgttcctctagaatgagtccctgcggaagatagcgcttacgggcgtctaaggaacctagcaggactcaggggttgtcgtaccgtggagtcatcctcaagagaccacagtggtccttgtcccactgcaagcatgactggtcatgtagacagtcgagcgagcatcgcgcaccatcctaggaggcaatgattccgtatcacgacggtatgttcggcaacgtgctcggattaacaaacgaacctgaaagatccctaggaactcattgtagacagccttataagtgattgtgggattgtcagtaggaccactttatacaagttgcggtantctttatcaaagtagcttcatcagacgaggccgttgccgtctagtgagtttagaccaaggggcaagtccgggactgtaatggaactagttcttacaattccgtcgggaatacctatcaggtagaacacaatggcgcgtcctgcgtgggcccgttgagcttgtgccctggtggtgttggctggagtgcacaaagccagcactgcgttgctagtgttcgattgttgcgcttccctggattaggctgtagtggttacattcgtctgctcgtcgtctctacagaagcacagaaacgtctcaatgtttgcactatttcccaagagttttactgagatgactgatagcttagaccaattacgtgcgtgcagtcccctggtttataccaagtagcaaaaatttaggtaccggtcagttggccaatggatggagtaaccatgtgctggctatatggggccagagaatgcacagactggtagtagacagagggaatgacccattcatggctaccttcagtcattcttacatccaggaaataaccataaaccagattgcgaagtcaaaatggacttttcctaaagggacaggatgggaggacccctgtagaaacaaagggacaccatatcaggaccgaacagcaaatacacagattaacggcagacaaacgcgttaccacaaagaaaaggggaagccaaacaaaatcaaagcaggaggaggaacaaaaaggaggggacgggaagcccagaagagcaaagaggaaagaacgagcagaacgagacagaagaggcggacggaaacacagggagagacaaggaaccgaaaaggaaggaaggacgaag

SEQ ID NO: 480840 - DNA, 155 bp, Homo sapiens
acgcgtcacataacctatttttttctctattctctccaatttatgtttaaagaataatgtccaaagtcagatctggtctagtttaacctagaattatttttgtctcttcagagcggtaccgatgctcgatattcgtgactctgttgtccattgct

SEQ ID NO: 480841 - DNA, 529 bp, Homo sapiens
  misc_feature (175)..(175): n is a, c, g, or t
ttatttaaagatgtaaaaaatgcgggagccttgagaagaaaggccctggaaggccccctcgatggatccctgataaatcccccagggattgttgatccatttcaaaaacttggggcagcaaacaaagcggttccccttttcaaagtggggaaaatgaagccaagaactctttttnctggaattattttccccccttcccccaaaaacaaaatttcagggggtttgaaaaaatttgggatctccgccaaagccccttcaattttaattgtttcccttgaagggggggaaaacccaataaatcaagaaaccccaatttttcaaggagaagggcctcggggttttttgaaaaatcttcccgaaaaaatgaatattcccgggggccaaaagaaaaataaactcttttcccaaaaagaaaggattgggcccttattgggggctatcctttggagaagggcccccaaaaatgttttatgaaagggccgaaaaattacccaaaattttcggccttaaagaaaaccttgattttcca

SEQ ID NO: 480842 - DNA, 106 bp, Homo sapiens
tcgtgggcgtccgcaagaccgggcagatctggcccaacgatggcgagggcgccttccatggagacgcaggtaaaagcccgggtcttaggctaaatcacaatgggga

SEQ ID NO: 480843 - DNA, 143 bp, Homo sapiens
acacgtgaaattcaacaactgaacgtactggtactctaaatcccaatacagcaacttcatgtacgaaacacctctctttccaataccgaagaaatatttagctagtatttagaacaaagtatcataaacattaaaaagctgtc

SEQ ID NO: 480844 - DNA, 273 bp, Homo sapiens
gtatatgtaccatttggcgcaggtatcaccaggaatgccagtgtacactatggaaataatttcacaggagtattactacatcacatataaacgtgtaataaaatcagtgttaaggagcaaatcagtgtttttaacacatctaataatgagcccaagataggcttagaataagaccaacagagagctcactaaagaaagggataatttatctaaaactggttcagaagaaaacgggctaaaattgaattttctcatattgttacatattacggg

SEQ ID NO: 480845 - DNA, 116 bp, Homo sapiens
aggtgccccgccctgcgcgtcactcaggcacagtctcagttctcctcgggctgtcggctgtcggtccacaaggctgaagcatcttttccatcatgttgaagcggactcgcgctttg

SEQ ID NO: 480846 - DNA, 198 bp, Homo sapiens
cctttgggggggagggggggggccccccccccccccaggaagggcctttttttttttcgggggtttttttttgggggggggggcccccccccccccccgggttttttgggggggggggggggtttttgggggcccccctttttttttttttcccgggccccccgggggtttttttgccccccccccccccttggggga

SEQ ID NO: 480847 - DNA, 447 bp, Homo sapiens
gaccgaatttgcgcgtctctccagctgccctttctgacctgcctagcaggccacataagccaattctttgcaataaatcttatattacagatgtctacggttctgtgtctgtggttaatccaagactaacacagaatgtgttggagccagcgtggtggctcatgcctgtaatcccagcactttgtgagtttgggttgggcggatcacctgaggtcgggagttcaagactagcctggccaacatggtgaaatcccgtctctactgaaaatacaaaaattagccgggcatgcacctgtagtcccagctacttgggaggctgaggcgggagaatcacttgaacccgggaggcaaaagttgcagtgagctgagatcatgccattgcattgaagcctgggcaacacacagagactctgtctcaaaaaaacaaaaaaaagaatgcgttggaga

SEQ ID NO: 480848 - DNA, 304 bp, Homo sapiens
tacggttggcactccctgaagctccctggtcacgacgttggatcaaaacgtggtcgtgtggtgacatcaggtcgtgactgcgagacaaccctagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgc

SEQ ID NO: 480849 - DNA, 287 bp, Homo sapiens
acctatcagtcgataagctataacgaggttgtcccagttctttgtaaactatagccatgaatgtaaaacaactgatttttacaacagaattgtataaccctgcacaattaaaagtacctattattaaaaaaggtaattatgctgtaattagtttgacacaagacattaagcagattattatcaaagccagggaaatagtaacttcaaagcaatttcccttcttgaaagaggcatttacatgctgccattggaacatgatccttactcgaggcactttttaatgcagg

SEQ ID NO: 480850 - DNA, 682 bp, Homo sapiens
gccgggggccggttgggagggagtgcgcccctgccccccctccacacgtgtcaccacagttgcaccgccgctgcctggaggccccactatcccgtcgaccccgcgggaaggtcctgagggcgtgccgaccagtcgttcccccgatatggggccgcagggtgcactgactgcacagctccctatactaggaggggccggggcctggagggtatgccataggcccaccagaccaccatgtcaagtgcgtggagatgagggaagatgagaagcccctggtgctggagatgctcgaagtgagtcctcaagcaccctgggcccagaaacagagttcctagccgaggggaggagcctaggccctactgtccagcctgttcagcagtgtgaagttctagtagtagtatgagacttcctcagagtggaatgacctcctatataccttcctaggccctcgggagggccctctcagatggtcaaggcctactccaaatacgccgtaacgcatacaacgacatccagtggtacttgcacgttggatggaaagcgctacaccacgtgggtagatagtactcggcagaagggtcgtagtagcgtggtagacggtagcacgccaagggcctagggagcagaagactaatctagggcgagcagggcggcgcagacaggaaggcccgagctccaggag

SEQ ID NO: 480851 - DNA, 103 bp, Homo sapiens
gatacgacttgagctggtacctgaacattcgtgtcgtccgtagttgggcacgagtttagccgggtattgctctccatcacttgaggacacgaatgttcagtgt

SEQ ID NO: 480852 - DNA, 770 bp, Homo sapiens
  misc_feature (65)..(65): n is a, c, g, or t
agcgcgccaccccccgccacacccgcacactaacactaacagtggcggcgggccagcgtaactcncaccctccacacgcccctcactcccccactccctccacaccgccacccccgggcataatcaccccaagtaatgagtcccagaccctgccttgatccaaatttcattctggaaagaaaaatcattctacaatgataggcctaataatagctatactcgctttgcctgggagatgcactgatcagctaaatgtaaatataagaactttcaaaactaaaatgacgctccttaatccttctctctgctttaggactcatgcttttttaggaacttaaagatttggagaatcattcctgactgtcccaccttcccaggagcataaccattcctgtggagctctaaggagagagtgcatggcagcagtattcctaaaaactcatactcagcttcctcatgtgccctactccgaccctttctctatccacattgctctaaatcatatccttccctcaaggtgtacaaggatgatacaaaggtgccaagcggcgcacacaagagcgatgagccctctcacagcggaatgcagcgagaagctttctaacctcataaactgaaggctatcttcagcctctccttcatatatcgtactcgcattaaacctcatataaccccaagaggacaattaacacaaacatcctccaatactggtgagaacagcgagacacacgaatcacctcttccaggaacaaccagtacggcagcctccg

SEQ ID NO: 480853 - DNA, 750 bp, Homo sapiens
gcgttccctgcgccgaagtgagcagtagccaccatgtcaggggggagtcatattacaaaaccgagggcgagtgaaggacaggcagaggaagaacgagaagagaacccgttgaagcacagtgggagactataagctatcccggaagagatcagtttgatattgattaggttgagtgcctccaaggctatgtgtgaatctcagagtgaagatgagtggacaccttttgacatgagcatccagtgtatccaagggtgtgtacatcagtaagatcataagcagtgatcgagatctctggctgtggtgttctatggtaccgagaaagacaaaaaattcagtgaatttcaaagaatatttacgtcttacaggagctggatacatccaggtgcaaaatcgaattctagagcttgaccagttctagggggcagcagggaccaagagaacgttttccaagacatgatgggccacggatctgactacgtcactcagtgaagtgctgtgggtctgtgccaagctctttagtgatgtccaattcacagatgaagtcactaagaggatcatgcttgtacagccaatgagagacaaagccccatgggaatcgacagtgccaaaggccagccgggccaggaccaaaagccggtgatctccggagatacaggcatcttccttgatttgattgcacctgaagaaatgctggggggctttgacaatatccttgttcctacaaggaggatatcaatcagcatagacaga

SEQ ID NO: 480854 - DNA, 975 bp, Homo sapiens
  misc_feature (355)..(355): n is a, c, g, or t
  misc_feature (380)..(380): n is a, c, g, or t
tcctgccactcggggccccgttccccctcccggcggcggggggctgcccccggggggctggcggagctgggccgcgggggccccgtgtggccggccggtgccgggcttcatcgggatgatgcgtgacgcaggtgtctgctggtggctagcgcacgtatcggtggcctatcgcgcgtgcaagctctgtgagcttcttcatttaccttttgcgtgaggcagatccgaacgggtacattcaagtaccaaactgttcgatatgatatacctacccctttatcttcctgtgtcccggaatcggctagcccaggtgaagaggaagatcctggtgctggatctggatgagacacttattcantcccaccatgatggggtcctgaggnccacagtccgggctggtacgcctcctgacttcatcctcaagggggtaatagacacaacattctggtcggttttttggatcactattagaagggcccactgtggatttacttcctgtgaaagtggtgagagccagtggtacgaagctggtggtgtttacacgcaagcactggagatctatgggtctggtgtggcagatataactggacaatagcagaagcattcttaaagaggagatattacacgacacggactggaacttggaggttggggagactacatccaggacctctctggtgggtccaaagatggaactcatcccagacattgtgatcctggataaatccccagggggcttacaggaggcattcagacaatggcattcccatcaaaatctgggttcagtgaacccagcgaaacagaccttctcaaactggtcccaatgctggatggcctcaggttcaccggtgatgttcggtccgtggtgagcgcgtaaacttcaacaacatcggatctggtgacaggtggtcccccttcaactgagttggggtggaggggaaagggacggggagcccttgggatttgcgctgatgcctg

SEQ ID NO: 480855 - DNA, 123 bp, Homo sapiens
caagttagattcacgccgcatgaatcatcatcagtgcaaatggattttggcgtaggtttggactagggtgtagcctgcagaataggggcaaatcagtgaatgacagcctccttatgcatggca

SEQ ID NO: 480856 - DNA, 120 bp, Homo sapiens
ctcgttgtgtacggcccggcgcgagatttacaccggctcgtggcgtggctctttgggcggctcagcgtgtgcctaccctatgagccccgcgatgagccacccaaagagccacaccacgag

SEQ ID NO: 480857 - DNA, 172 bp, Homo sapiens
tcccaacctgatgtagtattgacattttgggtaggataattcatatgttgggggagatctagtgctatgcattatagcatatttatgcagcatcactggccttatacccattagatgccagtagcgccaccccatgattgtgatgatcaacaaaatgtttcaggctattacc

SEQ ID NO: 480858 - DNA, 106 bp, Homo sapiens
ttctctcctactgtttgctgctgttactccttctaggaagaagatgccaagttagaagtgcatatagctctcttgccacaggaggcctaccatgccgccactttgt

SEQ ID NO: 480859 - DNA, 733 bp, Homo sapiens
gagagagagaactagtctcgagtttaggtatatttttctattcaaatttaccaaatttttttttaaaaaccaaatacaagggttaaaaaagtccttacatttccaaccctgcctgggggtgtgggtgggagaattaagaattaagctctcaaaacgggtgccataccttccttctccgtgcaaaggagacacggcagagctcaagagcgcaggccctttgcccttttcgtgccctgtgccatccctccttcaggatagcttcaaattgcgctgcatagagaagataattaatatgagcggccaagagatagatgtgtttgcgagaagtgtggtgaagcgccgagagaaagctgtgcgctatatcttgtagacagtatcaagacgagagagagatcttccagaagactgtaggttgcttgatgtccccccttttgaggaaagagtatacctcggtgaaagagccccatcaacccatctgtgggcgaaaccctcccccgaagggggacgtagggagaacgggggcgcactagcgccgaaggggccccataagacaaggggctcctaacgagacccctactacgatagagggagatataaattgtgttgaaggacaatacgaaagaaacccaccgcgggagaaggctatttatctcttaaaaaggggtggccctctattagtgtgagaaaaacccgatgaggagggtgggccggagaatcagtggggggggaaaaa

SEQ ID NO: 480860 - DNA, 414 bp, Homo sapiens
tttttttgtttattatcccgacccttcgggttaaaatttttgccaacccaacaacttaaggggttcccgtgggttggggccggaaccaactgggcattttccttaccatggcggtggggggggggcaacctatttttattttatgggtccccttccccctggtgcggttaggggggccccttaacctccccctttttttttttttttttggggcccctttggccccccaaatttttttctgccttcaggcccccaggttccccccgtttggccccagggccccccccccttcccttttcccccccacccccccccccaccccaggtgtttaaaaattttccactgcccaggcccccccccccgggggtggcccctttttcaaaaaccattaacccttattgggatggggtggga

SEQ ID NO: 480861 - DNA, 391 bp, Homo sapiens
ccccgcgacccggaggcccagcccggcccctctgcggtttgggaaccactcaggcccctctgtggcgcgggcgggaaaagaccccgcggcctccttggcattctaacccgtgtccggaccctcgagcccgcccggtctcacccaccgggagggcctgggagggaaccgtgtggcccggggccagcagtgtccccatcgggctccgagagagcaaagctgtggccttgaacttctccccgaagctcctgtgccctgagtcggggaagcaggaagttgttgccaccgggaaggaagagagcgcgctcggagctgggcagcggctccaggcaccgcgcccctgcccatcccacgcctccccgggcaccgtgaaccaccccccaacccaactcca

SEQ ID NO: 480862 - DNA, 178 bp, Homo sapiens
tagtgtatgaacaggtctgtctagacatgtgtgttgggctatgttatgcttgaagtgtcggtagggtgactgtgttataagtctggattgaagtcagagctgaagatgcaaattcggaggtcattggaatataggtgcttttttttttaaattatacttttaagttctagggtacatg

SEQ ID NO: 480863 - DNA, 200 bp, Homo sapiens
tcccagctgcattttttcgctgacaagagagtttgcttctttccttaaacctcatgaaccagcctctgctagtttccaacttttcttctacagcttcctcacttctctcagcctcataacttgtttaatggaggagagtaaagccttcctctggataagcttggctaaggaaatattgcagcggtgtgatcttctatcta

SEQ ID NO: 480864 - DNA, 159 bp, Homo sapiens
gttcgcatcgggaagccccgagtggactgttacactgaatagatacacatactatgcttctcgaagataaacttgggcatctcccggaaagtagctttaaggcgaagtctgaggtattctcccatctgtctcactcaggatgaatatcacccattcatc

SEQ ID NO: 480865 - DNA, 153 bp, Homo sapiens
aaaagggggaggaattgggctggtcccaaattttggtggccccccctcccgggaaggggccttggtaaagaaaaaaacattttcaactccttttggatttttccccccaaaaacccttttttccctgttataaaacaggggggttttttttga

SEQ ID NO: 480866 - DNA, 418 bp, Homo sapiens
cgatgtagatcacgagaaagctattccaggggcaccactcgagccacctgtcctaaaatggccttcgatacgggataatgctattcattacctcagaagtattatttatcattcgcaggattttcgtgagccttgttaccactccagcctagcccctagcccccaatgttaagagggcactggtcccctgactaggcatcatcccgcgtaaatcccctataaggtcccactcctaatacacatccggtattaccttcgacaatctaggagctatcaagtcatcctgaagcttcagccataggtctgaatagaataacaacgcgaaagccatgataattcaacgcactgcttattacaattttactgggtctctattttaccctcctacaagcctcagagtacttcgagtctcccttca

SEQ ID NO: 480867 - DNA, 150 bp, Homo sapiens
  misc_feature (104)..(105): n is a, c, g, or t
gaaaacacatccgtagaaggcagcgcggcgccgagagccgcagcgcgctcgcctgcgcccccacccgctgccccgccgtggaatttaacgccccctgccctgannataatcccctcaccccccctccccccacccccccacccccacccc

SEQ ID NO: 480868 - DNA, 187 bp, Homo sapiens
tggtaggatttttagtattttaaaataatacagttccaatcagggggtttgggtcatttaaattcctttactggcaaaccggggggcagggactggtttagtttctctgccttctttttgtcagtgataaccaggggggaaagggatttgctgcatcgaactttaaactttacgttggccttatttt

SEQ ID NO: 480869 - DNA, 239 bp, Homo sapiens
aaccatgtactataaaaaacatcacatatgtcaatatggattcatttgccacgacacaggtctgacaagatactcaaggtttacagagtagttctctttgcaagatagcatttaaatgtatcctattagcttatgtgcattttctattttattctacagttagcatgtatcactttaagattccgccatccttcctatcaattcactgcaatttaggaaagaaagaggtaaacatgtat

SEQ ID NO: 480870 - DNA, 157 bp, Homo sapiens
taaaccaaggggcatcaacccaccaccgacaagctaagaatggtttttacatctttaaatggttgaaaaaggaaaaagaatgtttagtgacacgtgaaaaatacatgaaattcaaacttcagtgtctacaaataaagtgcattagcacacggtcaaa

SEQ ID NO: 480871 - DNA, 3748 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgagcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacagtcttcctgtcaccagcccttcctcagcatccacaggtcacaccacccctcttcctgtcaccgacacttcctcagcatccacaggtcagacaccacccctcttcctgtcaccaatgcttcctcattatccacacgtcacgccacctctcttcatgtcaccagcccttcgtcgacgcggccgcgaatttagtagtagtagtagaccgccgctc

SEQ ID NO: 480872 - DNA, 118 bp, Homo sapiens
tcttgtgtggcaggcctcagcacctgctagatagtaggacaaggctctgtctcctggaagcaacatcgcctctggtgaggaagtcgccatcaagctggagtgtgtgaagacaaagcac

SEQ ID NO: 480873 - DNA, 102 bp, Homo sapiens
  misc_feature (13)..(13): n is a, c, g, or t
gatataacccttngttataaagtactatcaagaacttacactataccaggcattctagtagagtatacaggatgcctcaagctcagcactatggacagttcg

SEQ ID NO: 480874 - DNA, 3648 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgagcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacagccacccctcttcctgtcaccgacacttcctcagcatccacaggtcacgccacccttcttcctgtacggacacttcactcagcacatagttcagcgtctgagcagggatcct

SEQ ID NO: 480875 - DNA, 91 bp, Homo sapiens
ggggcccccccccccccctttttgggtgaaaaaaaaaagcccccccaattttcccccaggggtttttttccattaaaggggtttgggccca

SEQ ID NO: 480876 - DNA, 3320 bp, Homo sapiens
  misc_feature (3259)..(3259): n is a, c, g, or t
  misc_feature (3261)..(3261): n is a, c, g, or t
  misc_feature (3264)..(3265): n is a, c, g, or t
  misc_feature (3267)..(3267): n is a, c, g, or t
  misc_feature (3271)..(3271): n is a, c, g, or t
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480877 - DNA, 270 bp, Homo sapiens
ggggtgagtgtcgccaggccctgcggtgggctgtatgtgtgttgtctggtattgtgcaggtcgcgggatgatgttctgccagtgccgctgctgtgatgtaggcctggaattgctggcttgcggccttgttttcattggcgcgccacttgcgctttggggcccaatgtggggtttccccccgcggggcgggggcgactttggcacacggggcctttttcccgggtcaccccccgagaggggggtggcgcccgcaccccgttttccgcgcgg

SEQ ID NO: 480878 - DNA, 3669 bp, Homo sapiens
  misc_feature (3606)..(3606): n is a, c, g, or t
  misc_feature (3613)..(3613): n is a, c, g, or t
  misc_feature (3617)..(3618): n is a, c, g, or t
  misc_feature (3621)..(3621): n is a, c, g, or t
  misc_feature (3629)..(3629): n is a, c, g, or t
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgacgcttcctcagcatccacaggtgacaccacctctcttcctgtcaccgacgcttcctcagcatccacaggtgacaccacccctcttcctgtcaccgacacttcctcagcatccacaggtgacaccacccctcttcctgtcaccaacgcttcctcagcatccacaggtcacgccacccctcttcatgtcaccaacgcttcctcagtatccacaggtgacaccacccctcttcctgtcaccggcccttcctcagcatccacaggtcacgccacccctcttcctgtcaccgacacttcctcagtatccacaggtcacgccccacccctcttcctgtcaccgacacttcctcagcatccacaggtcacgccacccctcttnctgtcancagnnctncctcagcntccacagtatcctcgactcccctctgaagtgtacgttatg

SEQ ID NO: 480879 - DNA, 494 bp, Homo sapiens
tcaatcacgtgagatcacattcaaacaacatgttttttccttcagaaaaaaatggggtccctgttccaatgcctacacattttccatccatcttcagaggtgacaaaaaccaaagagaaagaacatcctacacacagtcctgaaggatcgcttctatgtaagataggaatatcttcactaggtatgtatctagagcaattctgatagaagtataccagaataaatgcacagatgatttctcagcaacattattttaacagttccaggaaaaaaggctttccagtttggggtgtttttgttttttgtggtgtttttgttttttgtggggtttttgttttgttttgttttttgttttttttggctatgaaatggccataggagaaagtataaagaaaataagttgtggtcccatggtggaatactatacagcagtgaaaatgaactgtagctacatccctcagcataaataagtctcaaaactataatattaaatg

SEQ ID NO: 480880 - DNA, 828 bp, Homo sapiens
  misc_feature (79)..(79): n is a, c, g, or t
tcatggagtccttctcgggaagcgcgtccagtgcgcttggctactccggggaatttccggccatttatggggcccgggnactcttttagatttatagataaaatagaaatcatagaaaatatagaagaatatatgacgcataacaaagcataatagaacaatagaaagagcaactacatagaccaagaagagaatatggagccgtgagagaattttaagtcctcaacgcctttgggctatcttcccgctttttgctctccttggctccggttcttttttcttgggccggttttccctttccggcgtctcattgcgcccatttgccgttttcgccttttcggggggtgttcccctttgatttgccggagttttaccccctttgtgcctgggaacctctgggttttccccacttaacggttcttgctctccaccctcttttcccccggggtggctactgctaagggccccggtcgatctgctgttcctagcggggtggtaccttgtttgcctggtggatttttatcctttcttttggatccagatgtggcacctcttttgttcagacggcaccttttgcgccctgcgtggtgaattggcttcatgcttttgttccctatcccagaacgccgtctgtggattgaggggtcttcaattcggtactagggccccgttttgggcgggggccttcaccctgtacggggtggatacgcgcttttttgggtgagtgccccttttgggagcccctcccttttcccctggtttggcgctttgggctcctatgggcctttttcggccccttttggggcccccccgctttggggtttggct

SEQ ID NO: 480881 - DNA, 3424 bp, Homo sapiens
  misc_feature (3363)..(3363): n is a, c, g, or t
  misc_feature (3365)..(3365): n is a, c, g, or t
  misc_feature (3368)..(3369): n is a, c, g, or t
  misc_feature (3371)..(3371): n is a, c, g, or t
  misc_feature (3375)..(3375): n is a, c, g, or t
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480882 - DNA, 161 bp, Homo sapiens
ctctagagatccatgtatcgccacacaccataagagtaggggtgagataatttattgagcatggatagctgtcagtggagggatgatgcttgggtgtttctctcccatgtgctgagtctaggctttattggctcagaacaggggaggcatgctgatttggt

SEQ ID NO: 480883 - DNA, 4755 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgctcagcatccacaggtcacgccacccctcttcctgtcaccagcccttcctcagcatccacaggtgacaccacccctcttcctgtcaccgacacttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtagcatccacaggtgacaccacccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgacgcttcctcagcatccacaggtgacaccacctctcttcctgtcaccgacgcttcctcagcatccacaggtgacaccacccctcttcctgtcaccgacacttcctcagcatccacaggtgacaccacccctcttcctgtcaccaacgcttcctcagcatccacaggtcacgccacccctcttcatgtcaccaacgcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcgtcacaccacccctcttcctgtcaccgacgcttcgtcagtatccacaggtgacaccacccgtcttcctgtcaccagcccttcctcagcatccacaggtcacaccacccctcttcctgtcaccgacacttcctcagcatccacaggtcagacaccacccctcttcctgtcaccaatgcttcctcattatccacacgtcacgccacctctcttcatgtcaccagcccttcgtcgacgcggccgcgaatttagtagtagtagtagaccgccgctc

SEQ ID NO: 480884 - DNA, 169 bp, Homo sapiens
ataagatagtatagcctgatatgctactatacatgacagaagactttaaaaaataatcactgcacacaatgtaaagggtggggttatgctgtgatattaattttacctcaataatgtttatcttgactgtacaagaacaaattaacagtttccacggccaaatttgttt

SEQ ID NO: 480885 - DNA, 3107 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctccccttcgtcgacgcggccgcgaatttagtagtagtagtagaccgccgctc

SEQ ID NO: 480886 - DNA, 3050 bp, Homo sapiens
aaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacagttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcacaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaacccagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggttcttcctgtcaccagcccttcctcagcatccacaggtcacaccacccctcttcctgtcaccgacacttcctcagcatccacaggtcacccttcgtcgacgcggccgcgaatttagtagtagtagtagaccgccgctc

SEQ ID NO: 480887 - DNA, 1090 bp, Homo sapiens
  misc_feature (360)..(360): n is a, c, g, or t
  misc_feature (578)..(578): n is a, c, g, or t
  misc_feature (797)..(797): n is a, c, g, or t
  misc_feature (844)..(844): n is a, c, g, or t
  misc_feature (881)..(882): n is a, c, g, or t
  misc_feature (939)..(939): n is a, c, g, or t
  misc_feature (1027)..(1027): n is a, c, g, or t
agcgggggggtggaggcaccggctggcgggcgggggtacaggcacggggcacggggctcccgctccaggttccttgcaagcacttccgaccgggcaagcccggcgcgagaagtcgagctaacccaagagctcaacaagcgagtcgcgcgacgagggcatgccggacgtgatgcggagcacgccgggccagacgcgggcatcaggagcccgggtctccgccgtctcgggacccggactaggcaggcagggtgggggcgcgtcgatcgttccagctgctactcccccgtggtaggcggtgcaaccagtcatgctgcgaggaagcatcgtaacaagtcgcacactgctacgtcatgcgtctangcgtccccagaggaagatctacgcgctatagctcctggagcgctggtaggagcctgctagcgttgggacagcactaactctaggcatcctgtggcagctgtccctgtagcgaaactattttgcccagtccttaggtcagaagttaatcgacatacgcgtatggtacattgacgtgatgatattgcaacattgcagcgtgcgtccccgtgcgcaggagnaactaggcaaagctatcgaatggcccaggctgagtggatagcgtagaatcgttgtactcggagatagtgacgacttgctcctgtacaccattcctacgaaagaggctaattctaccattctgatacaccagtcgagctcgctaaggatagcgctgtaccttcgaggccgtgggaaacccaccactggaatcttatgggtgggcctacgaaagaagtctntcttcactggtagaccttgacttgcacacttgtcgagacagttggtncttttgccttgtgagactaagtgcaccatgcgttcanncttacgaagattcttcgtaccgtggataagaattatttgggccagatccttttgagntaacccctggcgttgtcactggcgtagacctcgatgcagcacgaactcccttctggtacgagtaatctttggcctgaacatcgtcgtntagccactagacgtggcggaagggacgtaagaaagtacactgtgaatttgaagcgaaaaatga

SEQ ID NO: 480888 - DNA, 985 bp, Homo sapiens
gcagccggtggcggtctgagccgctcggagcgcaaagctgctgagcgggtccggaggctgcgggaggagcagcagcgggagcgcctccgccaggtgtcacgcatcctgaggaaggcggctgcagagcgcagcgcggaggagggccggctcttggccgagagcgaggatctggtgaccgagctgcagggtcgaagtcggcggcgtgagggcctcaagcgccgccaggaggaggtgtgtgatgacccggaggagctgcggaggaaggtccgcgaactggccggagctgtccgaagtgccaggcacttggttgtctacacgggcgctggaatcagcacagcagcttctatcccagattatcggggtcctaatggagtatggacactgcttcagaaaggaaggcctgtgagtgctgccgacctaagcgaagcggagcctaccctcacccacatgagcatcacccgtttgcatgagcaaaagctggtgcaacacgtggtgtctcagaactgtgatgggctccacctgcggagtgggttggcccggaccgccatctcagagctccatgggactatgtatattgaagtctgcacctcctgatccctaacagagagtatgtacgagtgtttgatgtgactgagcgtactgccttcaccgacaccttgacagggccggacctgccacaagtgcgggaccagcttcgggattccattggtgcacttggggagacggcgactttgggcagccttggaactgggaaggcagcgaacgagctgcgtcgcaagcagaacaatcggtgtttaggggcccgcctgaaggtctaacgaaaaatcccgacttggtgagtaaaacctccaagcggctgaccacactttttgtggaactgcttggccgcacagatatgtgcgcgctcacccgggagggcgtgatgtaggcctaaaaagcggcgaacggtacggggagcaccttcgtggaccccggtgagaacgag

SEQ ID NO: 480889 - DNA, 1494 bp, Homo sapiens
  misc_feature (5)..(5): n is a, c, g, or t
  misc_feature (28)..(28): n is a, c, g, or t
  misc_feature (31)..(31): n is a, c, g, or t
  misc_feature (1433)..(1433): n is a, c, g, or t
  misc_feature (1435)..(1435): n is a, c, g, or t
  misc_feature (1438)..(1439): n is a, c, g, or t
  misc_feature (1441)..(1441): n is a, c, g, or t
  misc_feature (1445)..(1445): n is a, c, g, or t
ggtcnactactactactaaattcgcggncgngtcgacccgccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatccacaggtcacgccacccctcttcatgtcaccgagcttcctcagtatccacaggtgacaccacccctcttcctgtcaccggcccttcctcagcatccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480890 - DNA, 1166 bp, Homo sapiens
  misc_feature (1105)..(1105): n is a, c, g, or t
  misc_feature (1107)..(1107): n is a, c, g, or t
  misc_feature (1110)..(1111): n is a, c, g, or t
  misc_feature (1113)..(1113): n is a, c, g, or t
  misc_feature (1117)..(1117): n is a, c, g, or t
ctcggtacccgtcagacgctgaactatgtgtccacaggtcacgccacccctcttcctgtcaccgacacttcctcagtatccacaggtcacgccacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480891 - DNA, 750 bp, Homo sapiens
  misc_feature (2)..(2): n is a, c, g, or t
  misc_feature (71)..(71): n is a, c, g, or t
  misc_feature (84)..(84): n is a, c, g, or t
  misc_feature (87)..(87): n is a, c, g, or t
  misc_feature (96)..(96): n is a, c, g, or t
  misc_feature (117)..(117): n is a, c, g, or t
  misc_feature (129)..(129): n is a, c, g, or t
  misc_feature (145)..(145): n is a, c, g, or t
  misc_feature (157)..(157): n is a, c, g, or t
  misc_feature (164)..(164): n is a, c, g, or t
  misc_feature (169)..(169): n is a, c, g, or t
  misc_feature (189)..(189): n is a, c, g, or t
  misc_feature (205)..(205): n is a, c, g, or t
  misc_feature (212)..(212): n is a, c, g, or t
  misc_feature (265)..(265): n is a, c, g, or t
  misc_feature (277)..(277): n is a, c, g, or t
  misc_feature (285)..(287): n is a, c, g, or t
  misc_feature (293)..(293): n is a, c, g, or t
  misc_feature (301)..(301): n is a, c, g, or t
  misc_feature (306)..(306): n is a, c, g, or t
  misc_feature (333)..(333): n is a, c, g, or t
  misc_feature (338)..(338): n is a, c, g, or t
  misc_feature (342)..(342): n is a, c, g, or t
  misc_feature (351)..(351): n is a, c, g, or t
  misc_feature (353)..(353): n is a, c, g, or t
  misc_feature (357)..(357): n is a, c, g, or t
  misc_feature (362)..(364): n is a, c, g, or t
  misc_feature (378)..(378): n is a, c, g, or t
  misc_feature (388)..(388): n is a, c, g, or t
  misc_feature (397)..(398): n is a, c, g, or t
  misc_feature (402)..(402): n is a, c, g, or t
  misc_feature (435)..(435): n is a, c, g, or t
  misc_feature (440)..(440): n is a, c, g, or t
  misc_feature (461)..(461): n is a, c, g, or t
  misc_feature (738)..(738): n is a, c, g, or t
gntcctaattcgttataggtgtacagttccgtggcattacctcccttcccattgatgtgctaccctccctnccctctatctccnganctgtttttncccttgagatttttccttttnttgagatttttntttatttacctttttngagataggtgcncccctcnctgtngcccaggcctgcctcccccnccggcttccccggtcncccctcnccgcctcctgagtggttggccctacaggtgaatgccactgtgcctggcttacnctaacatttttnaacttaannntatganatattacngttcnccgggacatccgatacctttttcctcntgccntttnccttccccntntgtngaccnnnttccgccccgaacntaccattggngtattaacnnaccntttgggcttggtattccctcatgcttgtctaanccacnggcctcctaagtccaacctcnccgcgccgtgtcaccctcggctgcctttccctcccacagcgccacccttcgccgtcctaaaagttcaattttacaaacctagaaaagagatttctgacagcatagaaaaccagacattctcccttcactggctaactcctatgggaagaaaaataggtggtaagaacacactttaggctggcgcagtggctcatgcctgtaatcccagcactttgggaggccgaggcgggcggatcacctgaggtcgggagttcgagaccagcctgaccaacatggngaaccctgtctc

SEQ ID NO: 480892 - DNA, 342 bp, Homo sapiens
ctatttggtctttacggcgtagttaaatatgctccttaaaacaaatacttctaggtcgggcatggtggctcacgcctgtaattccggaattttaggaggctgaggaggaaggatagcttgagcccagaagttcaagaccagcctgggcaacacagggggatccaggctgtacagaaaataaataaattagccaagtgtggtggtacacacctatattcccagccacttgggagattgaggtaggggaggatagcttgaacctgggaggtcaagcctgcaataagcagtgattgtgccactgcactccagcctgaatgacagagcaggaccacatcattaaaa

SEQ ID NO: 480893 - DNA, 849 bp, Homo sapiens
gccccctccagtcagccccacccagtcccttgccaggtcctggacccctgctccagtacctgatcctgcccttcttccgagagatgaagtgtggatggggactggcgccccgcttgagagagcccagccctgctgcacccccagattacatggatacccggtcgctgtcccagctcatctttccttcgattctccagaaacgccctcgcatgatatccccgcagggaatcacttcctggggactgtggtaggggctggggccactgcagagcccccgttatacagaccctggctgacctggacacctgagtggagtcgggctgctgccaggccttctccctgctgaccctcgaggcagcctcacagaaccagagcagcgggcgaggcagctgcttcgttcctgcggtcccctctccacagcccctctctgctagggaggcagctacacctcagccctgctcccaggagacaccagcagctgggcagtggacctgagagatggcccgaagggagcagtgtggtgacagtcagcaagaggaaggaacacatctgtggacgagaactatgatgtgggactccagaattccctggggacatgtgatacttgctggagagtttgcacctgggcttggcacagctcccggctcgagaacctgaagctgagtcgagagctaggtgtgaagactccagatgagggtggcctctgaatgctgcccatgtactggcctgaggccgtgtgtgcccttcggaggaatccggcttcgcgcgcgaatgtactagggcggtaccactacgaaagcagtcccaaccgaaggccctttggcatccaaggagcggaaggttgcccca

SEQ ID NO: 480894 - DNA, 533 bp, Homo sapiens
ctccttcgcttattacggttagtgaggctgcgtatgacatgctgggttgagacttcttagacttctaagaagtgttgtatattggctcccactctattctggcttgtagggttactgcagagagatccgctgttagtctgatgggtttccctttgtgggtaacctgacctttctctctggctgcccttaacattttttccttcatttcaaccttgatgaatctgacaattatgtgtcttggggttgttcttcttgaggagtatcttagtggtgttctctgcatttcctgaatttgaatgctggcctgtcttgctaggttggggaagttctcctggattatatcctgaagtgttttccaacttagttccattctcccggtcactttcagggagaatcaaacataggtttggtcttttcacatagtcccctatttcttggaggcttagttcattccttttcattcttttttctctaatctcgtcttcttgctttatttcattaagttaatcttcaatctctgatatctgttcttc

SEQ ID NO: 480895 - DNA, 160 bp, Homo sapiens
gctgagtgatctaaggatcccgcgctagcggcattaagtgaacgcttccttaagcctagtctctgtcctgggtttgcatgctgactgtcctgttcactaacagacagttgtcctgggtaccttgaggctcctgggtgtggggtcagggccagggtgaggc

SEQ ID NO: 480896 - DNA, 227 bp, Homo sapiens
  misc_feature (172)..(172): n is a, c, g, or t
agtagtccaaaaagagacttcagagaagacatggcttccagaaaagagaatgcgaagagcgcaaacagagtgctaagaataagccagttggatgcacttgaaactaaaacaagggcctggagcagctagttttggtccccagtttatttcagtgctttcatgtgatttaaancctgtggctgttaggctctgctttgagccatgaaggtgaaagcgtgcttaatggg

SEQ ID NO: 480897 - DNA, 238 bp, Homo sapiens
tccgtactgccgggatcgccgcagacatcgatcaggtgctgctggtgtttggcctggcagcactgctgggcatttgggtggtcggcgcgctgattgatcagcggctgcgggccttgttggtgatcagttgcgggatgttcgcactctcagcattggcgctggcgttctggattacctcgccggccgtgatctacaccaccgtgacgttatgggggcactattctttacagagcccagg

SEQ ID NO: 480898 - DNA, 254 bp, Homo sapiens
  misc_feature (235)..(236): n is a, c, g, or t
acccttggatccagtctgggcatggcccaaaaaaccttcttggaggggggtgaaactggcggcttgccaaaacccttaaagccctccggggggttttcccagccccctagggtttcaaaaagggccccgcggttcccaaaaagacccccaaattgggagaaatttttttttgggaaaaaaggcgcgacaaatgggggccaaaaagcgggcccccccccccccctttttgttgggnnggggcccccccccttttg

SEQ ID NO: 480899 - DNA, 513 bp, Homo sapiens
tgagaaataatccaaacatacatctgcagtaaaattttcatataaactgtgacatattcacacaatggaatacagtatcacaatacaagtgaatgaacacagtctacaggcatcaacatggataggtctcacaaatttaatttcaatgaaaagaagcaagtggtaaaaatatgcatatatcgtgctgtcttctatgtaaacttcaaaaaatgttttgcgtaaattgcaaacctaagcaatatatttcagtacgtatactatatcagtgacccaataatgttttaaaaggaaagaaagtgatagacacaaaatgttgcagtgtttctctctgtcatagaaggatgaggtagaggaaagcgagtgggggaggagcagagtgggcttcaaagttgttgatgctttatttcttaaataaggtggtaaggacatgaatgcgtgttttggtcattattctttgaagcatgcaaacccctccatcctttttaatgaacaattcatatcttagtaagtagt

SEQ ID NO: 480900 - DNA, 232 bp, Homo sapiens
ttactaaacaaaatcacgacataaccagcgctaccggggaccgcttgtagaagggcagagaagcgatacaaagtactaagtagctgggcgagcagcgtctgatgctgcgtctgagggctataggctcctgagcctccgctagctgcccttgcccaagctcagtcgccctccaggtgcaaagagctaggttgttagaatcgatggagccaggcttggtgatcttggtgagtca

SEQ ID NO: 480901 - DNA, 270 bp, Homo sapiens
aagatgcccacatttctgtttactcacagttgttgtatattattcaatttcaatattgaaagtaaactcaatcacaattagttttcccatttttaccttccactacctacttgtcaagacaaaaaatatagatgtctcttaaaacacaatccaacgaagccgtctttcctcaaaacatgatcttattgacatgatggtaggttgatgcagcggtatgttataatataaatagctctcaacctgcatcattatttatactatagttgagaa

SEQ ID NO: 480902 - DNA, 315 bp, Homo sapiens
  misc_feature (301)..(301): n is a, c, g, or t
aggccaaggcgggcggatcatgaggtcaggaaatcgagaccatcctggctaacacggtgaaacctcgtatctactaaaaatacaaaaaattagccaggcatggtggcgggcgcctgagtcccagctactcgggaggctgaagcaggagaatggcgtgaacctgggagggagagcttgcagtgagccaagatcgcgccactgcactccagcctgagtgacagagcgagactctgtctcaaaaataaataaataaataattagctggattaggtggtacatttctgtagttccagctattcangaggctgaggtgga

SEQ ID NO: 480903 - DNA, 485 bp, Homo sapiens
tctctacctctctcaaacactcataccttctttgctgcatagccacttaaaatttcagactatttttcaaaaccaaataatctgacaagcaaacatttcttggcacttaggagagaaaaagaggttcaggttaaagtgtttgaccactttgttttcttccgtggcataaaaatactttaaaaacctgctgaattattgaaatacttgagataaattctgttatgtctttgtcacttaaatctgttttctgttaagatattcattatgatacagaatgtaataatagcaaaaataaatcacaagaccaaatattttgatgcagtattgaaagattttcttgtatcttgttccatagtcaggaaacatatgtatcaactaacaccttaataccagccttcatgttgttatttgaataaatgcatatactattacttctgtataaatagaaaatttttgaaagaataaattacaaccctttcatgaaa

SEQ ID NO: 480904 - DNA, 526 bp, Homo sapiens
ttcctgctgctcatcccagaactgactctccatgtatttactcttattttgagagaagggggcatttccaccaccagaagggaacttgctgtcttggtagccattgtcccctgacacctggcacatctactctatacagtcaccattcaagtggatgttgaatgagtacacttgtttcacagtttggttgggtaagccccaaagcttggttcccggtaggatcaggctttatgagtgggctgagtttctataaaagtctccctaccagtttccaatcttggtgaaactatgtctgtgggcacaaatgagaaaacttgccattcgtatcaccggttacccagctgtggaccatgtgggccaggtccacagaagagccttatcctactttcactttttatttcctgcagtcatggggacagtggggcaccaccttttcagaaactctaagaaagagtgttcatgaaagtggccagagagttttacaattttgccattaggaatgattaaatatccatgactaataaaa

SEQ ID NO: 480905 - DNA, 827 bp, Homo sapiens
cccgtcatctactctaccatctttgcgggcacactcatcacagcgctaagctcgcagcatgattttgtagcctgagtaggcctagaaataaacatgctagcttgtattccagtgtctaaccgaaaaaaagtaaagccctcgtcccacagcaagctgccatcaagtacttcctcacgcaagcaagccgcagtccactatatccttctaagtagctatcctcttcaagcaattatactctccggacatatgaaccattaatccaagtactactcgaatcaagtactcagtcatctacataatcattaattggcttatagacaactaaggacgtaggcaatagccccctttcacttctgaggtcccagaggttacccaaggcagccctctgacatccggcctgcgttcgttctcacattgaccaaaacacgtagacccctcatcctcaagtcatataccagatctctccctcactaaacggtaagccttctcctcactctctcaatcgttatccagtcatagccaggcagcacgaggatggagttaaagccaaagcccgagctacgcaaagtcttgagcatactcctcaattagccacataggatgaactaatgagcagttctaccgtacaaccctaacataaccatactcagtttaactattatattatcctaactactaccgcattcctactactcaacttaagactccagcgagcactgacctactactatctcgcacctgagacaatgctaacatgactaacagccttaattccatccaagctcctctccctaggaggcctgccccggtaccggctttttgcccaa

SEQ ID NO: 480906 - DNA, 159 bp, Homo sapiens
cattgagcccctgtgatgcactgtgaggcaagccaagtcacatacacagaggaaggccgtgctcagcagcaccagcatctgtccagtgcgtagtagtccctagcatgttgcaccagcacagcggtatgaggtccgatccttaaaagctgcttcattttg

SEQ ID NO: 480907 - DNA, 634 bp, Homo sapiens
gtactttgggaggccgaggtgggtggatcacgagatcaggaggtcgagaccatcctggccaacatggtgaaaccccatttctactaaaaatacaaaaattagccgggcgtggtggtgggcgcctgtaatcccagctactcgggaggctgaggcaggcagaatcacttgaacccgggatgcagaggttgcagtgagccgggattgtgccactgcactccagcctgggcaacaagagcgagactccgtctcaaaaaaaaaaaaaaaaagggaaagcaaaaatcacgttgctgaagagggccgagggcaaaggatagcacaaacccccaagatactggagggacactcatatgagcgtgctgtaccaagctgggaaacaggccgtatctcacagaactataagcagcgcgtaacgtgtgagcaaacgggtctaggaccggggatgcacggggaaacagagaaccattgtgagactctcaggcaacgtgtgggaacaggccgtgagcgaggaccacgaacaaagcaaaggctcaagcgagaactcgagacaccagccgcgggacacaacaaaggggaaacaaccgggggctacaccaacacaccacccaacacacccaaaccaccaaacatcccacgc

SEQ ID NO: 480908 - DNA, 238 bp, Homo sapiens
tctctctgggcattatcatagtcagtcgggtactgcgagtccctgcctcctccatggagagccagcaagtgggatataaaacgaggatcatcgaggtatgctatgtcctgaaggcagaaggaaggtgcagacgggggttaggggggatgtccaggtcggctcctgcattatagctccgtggcaatgacacattcattcctctcctctgatatcaaacacacagactggtacaatgaag

SEQ ID NO: 480909 - DNA, 913 bp, Homo sapiens
  misc_feature (852)..(852): n is a, c, g, or t
  misc_feature (854)..(854): n is a, c, g, or t
  misc_feature (857)..(858): n is a, c, g, or t
  misc_feature (860)..(860): n is a, c, g, or t
  misc_feature (864)..(864): n is a, c, g, or t
agttaaaacaattttttaagagaaaggagataaccagagcatagccagcagaaggactcgcatgaggtttggtgggactgcctagggagaaggaggcagctggctgcgtgacagagcccagtgataggggagggcctgtgaccccttaaggagctgagacgctgtcacagagcaatgggagcgctgagtgatggagctggatttgtgcttttagaaaagctttgttggctgctgttgggagaatggattggaagggggtgagactgcagtcagagactcccataaggtagctgttactgtaatcacaacaacagatgcctacactccttcccaagacttccctctctgatcttagaagcattgtcaaatctgggttcccagcctgccatggcaagctgcttgctacttgggagtgaaaagcccttgtggagctttttcttattcggtgactgctcataaagtgccttcacctcgcttgccttattacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480910 - DNA, 1181 bp, Homo sapiens
  misc_feature (1120)..(1120): n is a, c, g, or t
  misc_feature (1122)..(1122): n is a, c, g, or t
  misc_feature (1125)..(1126): n is a, c, g, or t
  misc_feature (1128)..(1128): n is a, c, g, or t
  misc_feature (1132)..(1132): n is a, c, g, or t
acccttgggggggcagctgatgaagttctagctgttctaaagattgaaaagctgcgggacaaggaaaggcgaggggagattgacctgctgctgggtcaaactcctttcacccctcttcctgtcaccagcctttcctcagcatccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480911 - DNA, 583 bp, Homo sapiens
ccttcttcgttcttcccagttagaatggagttgtctaggttttcacctggccagcattgagcatttaccaccaggctgcagttttgagaacattcattactctaaccagtttgcttcatccttgggacatggaggctcggcatggagtcacccaactagcagggacagaccccgaggctcctcctttctcccacccaaatggtcatgaatttgctttggcaggtggatgaagactcaggaacttcccagaatactgcctcaaccaatgagccaggcccaggttatggggcactggggctaagcctaccaggtgggtacttggtcagaggaaggaagcattctatgctgggcctttggggaactggcagaaccacatgctgccctaaaggtaggtcaggggtggggaggaaggaaagccagtgtcacttgaggtggtagttcatcatcaaccacaaaatgacaagagttggatggttttctagctgtgtgtgtatatgtatgtgtatagcagcaacaaagaacaaaaatagtagcctcatatttctgtaacaattgttctactttccagatagataactgggag

SEQ ID NO: 480912 - DNA, 1097 bp, Homo sapiens
  misc_feature (1036)..(1036): n is a, c, g, or t
  misc_feature (1038)..(1038): n is a, c, g, or t
  misc_feature (1041)..(1042): n is a, c, g, or t
  misc_feature (1044)..(1044): n is a, c, g, or t
  misc_feature (1048)..(1048): n is a, c, g, or t
tccagaccattggcaaagcagcaagcctgaaggtcctatagacaagatcccccagtgtccacaggtgacaccacccctcttcctgtcaccgacacttcctcagcatccacaggtcacgccacccctcttcctgtcaccagcctttcctcagtatccacaggtgacaccacccctcttcctgtcaccgacacttcctcagcatccacaggtcacgccacctctcttcttgtcaccgacgcttcctcagtatccacaggtcacgccacccctcttcatgtcaccgatgcttcctcagtatccacaggtgacaccacccctcttcctgtcaccagcccttcctcagcatccacaggtgacaccacccctcttcctgtcaccgacacttcctcagtatccacaggcgacaccacccctcttcttgtcaccgacacttcctcagtatccacaagccacgccacctctcttcctgtcaccgacacttcctcagtatccacaagccacgccacctctcttcctgtcaccgacccttcctcagcatccacaggtgacaccacccctcttcctgtcaccgacacttcctcagtatccacaagccacgccacctctcttcctgtcaccgacacttcctcagcatccacaagtcacgccacctctcttcctgtcactgacacttcctcagcatccacaggtcacgccacccctcttcctgtcaccgacacttcctcagcatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480913 - DNA, 779 bp, Homo sapiens
gtaagtcagctacgcgtaatccgtggctagaattactcgtgcctacataatgatattagctagacactggtcctggctttccaacaataatgtatagaatacgaatcagaacgcccatcgatgaatggagtagttgttaggatcgtctatctactgttgtacagtaatagtcaatggaatatgtatttggttgtgcactcaaactatatattctggagcctgtgggatatcaccctccatagataggtgatgtaccgtgacgtgtgacctatcggaattgtgggaaggcaacgtgtacttatctggaatgaatgactatgacgaagataaactgctagactgttcgtatatctaatatccgtaattgtgtgctaccttaagtagttgagtactacagcagaccacagggagacctgagtttctgttaattatgaataatgatttctgttgaaaaggcaaattgtagtcccctatcttggttataatggagccgatggaggataacagggagaaagggcctgaaggcaggtcacttgttgcgtattactacagcctagtaggtgcgcttgactgattcatcgtactgtattatacaatcacaagagcctaaggtctcacttgaagattctgatagttcactctacactggccaagaattataaggtcctgagccagctgttgagatgatgaggttaaggaatgagttttatggtaaagatacttctttaaggatccaacttgaatggataccctaagggcctggtggaggcccgatggtg

SEQ ID NO: 480914 - DNA, 177 bp, Homo sapiens
ccgtccctcgaccgctctctgatgttcattttttcctggtactatgtcatcgtagccatggtaatagctggtatgatgtacaagtacattgagtaccaagggcgagtctgtggataccacctggatcactgctaaaactattgaaactagctagttttgttagagccagtctggtga

SEQ ID NO: 480915 - DNA, 703 bp, Homo sapiens
  misc_feature (5)..(5): n is a, c, g, or t
  misc_feature (28)..(28): n is a, c, g, or t
  misc_feature (31)..(31): n is a, c, g, or t
  misc_feature (642)..(642): n is a, c, g, or t
  misc_feature (644)..(644): n is a, c, g, or t
  misc_feature (647)..(648): n is a, c, g, or t
  misc_feature (650)..(650): n is a, c, g, or t
  misc_feature (654)..(654): n is a, c, g, or t
ggtcnactactactactaaattcgcggncgngtcgacccgctcagcatccacaggtcacgccacccctcttcctgtcaccagcccttcctcagcatccacaggtgacaccacccctcttcctgtcaccgacacttcctcagtatccacaggtcacgccacccctcttcctgtcaccgacacttcctcagcatccacaggtcacgccacccctcttcctgtcaccagcccttcctcagcatccacaggtcacgccacccctcttcctgtcaccgacacttcctcagtatccacaggtgacaccacccctcttcctgtcaccgacgcttcctcagtatccacaggtcacgccacccctcttcctgtcaccagcacttcctcagcatccacaggtcacaccacccctcttcctgtcaccgacacttcctcagcatccacaggtcacgccacccctcttcctgtcaccagcctttcctcagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480916 - DNA, 293 bp, Homo sapiens
cattcatgatgagggcacagagcttacccaagtcttgagagcccaagttgaatcaccaaccagagggttgcagcgaggaacaggcaacaggcagaggggaaaggcacggatctgcagtgaaggggactgatatcaagggactgctgaggaccagcagtgtctcctgaaagcatgctgcatcctaaggactcctcaggactggatggagtcggaaatctgtgtgttgagccgatcacatctatatagcaactttaaggaggcgcttgatgtcaggcacaatgtagatggtagcg

SEQ ID NO: 480917 - DNA, 492 bp, Homo sapiens
  misc_feature (5)..(5): n is a, c, g, or t
  misc_feature (28)..(28): n is a, c, g, or t
  misc_feature (31)..(31): n is a, c, g, or t
  misc_feature (431)..(431): n is a, c, g, or t
  misc_feature (433)..(433): n is a, c, g, or t
  misc_feature (436)..(437): n is a, c, g, or t
  misc_feature (439)..(439): n is a, c, g, or t
  misc_feature (443)..(443): n is a, c, g, or t
ggtcnactactactactaaattcgcggncgngtcgacccgccctcttcatgtcaccgacacttcctcagcatccacaggtcacgccacccctcttcctgtcaccagcctttcctcagtatccacaggtgacaccacgcctcttcctgtcactagcccttcctcagcatccacaggtcacgccacccctcttcttgtcaccgacgcttcctcagtatccacaggtcacgccacccctcttcctgtcaccgacgcttcctcagcatagtatccacaggtgacaccacccctcttcctgtcactagcccttcctcagcatccacaggtcacgccacccctcttcctgtcaccgacgcttcctcagcatccacaggtcacgccacccctcttcctgtcaccagcccttcctcagcatccacaggtgacacacccngncgnncntacngtcccttccgtcgcagtagtctggggagtcctctagagtcgcctagatg

SEQ ID NO: 480918 - DNA, 281 bp, Homo sapiens
tgcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgggtgacagagtgagactgtctcaaaaacaaaacacaacacatgaatgttaaacatttagtgaagtgactggtagctagtgagggttcattaagcgcttatatgacgctgggtaccg

SEQ ID NO: 480919 - DNA, 531 bp, Homo sapiens
agttaaaacaattttttaagagaaaggagataaccagagcatagccagcagaaggactcgcatgaggtttggtgggactgcctagggagaaggaggcagctggctgcgtgacagagcccagtgataggggagggcctgtgaccccttaaggagctgagacgctgtcacagagcaatgggagcgctgagtgatggagctggatttgtgcttttagaaaagctttgttggctgctgttgggagaatggattggaagggggtgagactgcagtcagagactcccataaggtagctgttactgtaatcacaacaacagatgcctacactccttcccaagacttccctctctgatctttctgtcatttcacaactgccaaaatggggaatttacccaaacttgtgattgacttccaaccccaggagggtaaagtaacagagattaccttcaataaacccaggacacagaaacaccagggcagatcctcctgccactcctcaatcagacagcagcagtcagtacagctccttccggt

SEQ ID NO: 480920 - DNA, 112 bp, Homo sapiens
taatagtacatagctacatatcggttctgtatatatctctctgatctatctgtaatatactatacttgacaagaaaagatcagtcatatgtagatgataatcgacatgaagt

SEQ ID NO: 480921 - DNA, 145 bp, Homo sapiens
gattcctggcttttgcaaggctgtggtcggtggtcatcagtactcttgaccaggtacagcgagccttttccctgggtgttgcagctgttgttgtaccgccgccgtcgccgccgtcgccgcctgctcttcggggtcatggtgtcct

SEQ ID NO: 480922 - DNA, 196 bp, Homo sapiens
tttttaagtgttaatagggattttttcagcttattttgggtgcagtttccaatttttaaaaatgttgaggtaatctttccccccttcccaaacctaatttttgtaaatgcattagtgttgaaccaatgctttttcatgtttcaattctttggaaaagcatttttttcagatgtattaaacaaacaaaaacccttca

SEQ ID NO: 480923 - DNA, 242 bp, Homo sapiens
aaaaagagagacagatacgaatcgagccggtacccctagtctgagaatgtttcaatagcatggtcacccttctctccataacagcattcagtcattctctaggtcttggtattcatcacctcaagcatttattcttggtgtcacaaagagtcccattatactcttagttattttagaaagtacaattaaattattatggactatagtcacccggtggtgctatggaaacttctaaaactagg

SEQ ID NO: 480924 - DNA, 169 bp, Homo sapiens
tcatgccttagtcaacaggcaactaattgggggagggattccatgggttgaaaacatggctggggcagcgatgaagttaagatgaatgtcccaagatgtcgcaacgaacatgcacgttccaaggacgtgtattctctgtcagtggactaaagatgagacagcacgctac

SEQ ID NO: 480925 - DNA, 895 bp, Homo sapiens
ccagcacataataaacaactaataaatgtcagtgtttattatcacaattattaaaactacatataactttaatttgcttgtgtaaaagcagtgtgcttgcaggcaattcttcatgcatcagagtaggatgttcaccaatcaaggctgaaatagagttcatttcgtgtaaaatctaaaagcatgattcaatgcatacagcaatccatgaagaagcaaaatagagtttttatggaaaatgtgtgtcctgcggcacaattttagtgaaataaaaagcagactctagtgctgcaccctatccccacatgggagggtaaagtagtagaagctccaattcttaactacttccccgggccgcttaataatggagtagtacaccctaccttgataaaagctattctgaaagcaactgcatttattttacctcctgtgctatttgggagaagagctgaacagtagtttgtcttgctggaatgaactaactttatgaattttaatgtgtgatataatattaacaagctaaacaggattaaagaagatttttgtactaagctaaaatagtacttagtagagtgaggtattcaagatttggtgcccattttacctggggaaaatcagtttcatatttggaaaggtgtcaagtcagtttccttagcaataggtgtgttaggaacaaaaatgtgttcttagaatctaataggttctattgatagatgggtttcgggcacaaggtagaaactcctacattttaaggtgtcggagattttcattggatgtaagttcccctttttttaaaaatcggtcttcctgcggaggggcaaggaagtaagagggcgtggcaacaaaagggggcaagtaatggggaagaggtagactagttcaagggctggtttatacg

SEQ ID NO: 480926 - DNA, 118 bp, Homo sapiens
atgcttacgtctgcggatcttacgggccggtgttgaaccactgtggcacgcgcgctgcagtccttgtggaagtggggcttcaagaccatgccattccggctggcgccatggctgccta

SEQ ID NO: 480927 - DNA, 204 bp, Homo sapiens
acagtcagctgattcgagcctctgggttgcccatcttaatcgaccttctgacttcatgctgttgaggctgtattgaggtcagcacagcttgcggaagctcgggctctcggtcaggctccttgtcactacagcactgacagcactgtcccttacactgacaggtgttaggtcgagttgtcccatggccctccagtgtgtttggac

SEQ ID NO: 480928 - DNA, 111 bp, Homo sapiens
catataactcattagactggaacttgaactgattcacatctcatttttacggaaaaatgagatgtgaatcagattcaagttccagatctaatgagttatatgccactccag

SEQ ID NO: 480929 - DNA, 132 bp, Homo sapiens
  misc_feature (121)..(121): n is a, c, g, or t
cttgtagtgagtaggtgattagtatgactcgcttggtcaggattctgtagctctgagtagtggatagggagctgcacagcgtggtattttgatttagagagaagtgttacaagttgcaggntgattgaatct

SEQ ID NO: 480930 - DNA, 654 bp, Homo sapiens
  misc_feature (45)..(45): n is a, c, g, or t
  misc_feature (222)..(222): n is a, c, g, or t
  misc_feature (238)..(239): n is a, c, g, or t
  misc_feature (245)..(245): n is a, c, g, or t
  misc_feature (248)..(248): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (261)..(261): n is a, c, g, or t
  misc_feature (266)..(267): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (278)..(278): n is a, c, g, or t
  misc_feature (294)..(297): n is a, c, g, or t
  misc_feature (299)..(301): n is a, c, g, or t
  misc_feature (304)..(304): n is a, c, g, or t
  misc_feature (312)..(313): n is a, c, g, or t
  misc_feature (320)..(320): n is a, c, g, or t
  misc_feature (329)..(330): n is a, c, g, or t
  misc_feature (337)..(337): n is a, c, g, or t
  misc_feature (347)..(348): n is a, c, g, or t
  misc_feature (356)..(356): n is a, c, g, or t
  misc_feature (361)..(361): n is a, c, g, or t
  misc_feature (367)..(367): n is a, c, g, or t
  misc_feature (371)..(371): n is a, c, g, or t
gctatgtcaagaataagacacaggggaactatatcttcttcaaangcacatggacacagccctttgacctggcaagcaccagggaggagaacttctatgtggacgagacagctgtggtgaaggtgcccatgatgttgcagtcgagcaccatcagttaccttcatgacgcggagctcccctgccagctgggcagatgaactacgtgggcaatgggactgtctncttcatccgtcggacnnggggangangancncngtcatnggtgnncngnggcgngncacgagtaacaggggnnnngnnngcntgaccagnngccaggnggacctgtnnattcaangggcaccatnngtggagtntatgncctcgnagangtgctggaggaaatgggcattggagacttggtcagcgaccaggcaaatttctcacgcatgacccaagacgcccagctgaagtcatcaggggtggtccatgctgggctgcaactcaatgaggagggtgtggacacaggtggctgcactggggtcaccctaaccggacgttcaacctatcatcttgcgtttgaaccaggccttgatgatcatgatcttcgaccacttgcgcgggagcaggctgtgcgtggcggttatgaccccagttgaggagagccgcggccgg

SEQ ID NO: 480931 - DNA, 588 bp, Homo sapiens
  misc_feature (85)..(85): n is a, c, g, or t
actaatttcattgaacacttttcattgcatgttgacaacttttgaatagctgcatgaatataatttatttaaaattgccaaaccnctggtcttgttcaagtttaaactaagataaagcttaccaatcagtaattaaggggaaggatccacttgatttggccagttagaatacttcaaatataagagacatttccacaagatattacttatatcagaattgatacctgaaatttaactattaataaattctctaatttagctcttttgattctgaaatgcagatataaaaaggcaggaagcatctgaagagtttctcattctggagatcaacctgtttctccaacctcatttgtttggaaggaaagtacacagaagcagcaaacctcagcctctgaaggggcccaactcctgactctacatggctcaagggttatttcttagcaaagaatatgtataggttacaaccaacatctatcaaaaataaaaacaaagcaaattcctagtaattggtaaatgcgtggtattttctattgactccttcctctgggccatgattattttgttaataaattgtacttctgaaggaaa

SEQ ID NO: 480932 - DNA, 111 bp, Homo sapiens
  misc_feature (86)..(86): n is a, c, g, or t
  misc_feature (94)..(94): n is a, c, g, or t
tacgccggtaccaaatactgggtatatactgcagaaaaggaatgcagctgttttccacagtgttgtccccaacttctgttgcccanagaatccntccgcccacagatcttc

SEQ ID NO: 480933 - DNA, 636 bp, Homo sapiens
  misc_feature (45)..(45): n is a, c, g, or t
  misc_feature (222)..(222): n is a, c, g, or t
  misc_feature (238)..(239): n is a, c, g, or t
  misc_feature (245)..(245): n is a, c, g, or t
  misc_feature (248)..(248): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (261)..(261): n is a, c, g, or t
  misc_feature (266)..(267): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (278)..(278): n is a, c, g, or t
  misc_feature (294)..(297): n is a, c, g, or t
  misc_feature (299)..(301): n is a, c, g, or t
  misc_feature (304)..(304): n is a, c, g, or t
  misc_feature (312)..(313): n is a, c, g, or t
  misc_feature (320)..(320): n is a, c, g, or t
  misc_feature (329)..(330): n is a, c, g, or t
  misc_feature (337)..(337): n is a, c, g, or t
  misc_feature (347)..(348): n is a, c, g, or t
  misc_feature (356)..(356): n is a, c, g, or t
  misc_feature (361)..(361): n is a, c, g, or t
  misc_feature (367)..(367): n is a, c, g, or t
  misc_feature (371)..(371): n is a, c, g, or t
gctatgtcaagaataagacacaggggaactatatcttcttcaaangcacatggacacagccctttgacctggcaagcaccagggaggagaacttctatgtggacgagacagctgtggtgaaggtgcccatgatgttgcagtcgagcaccatcagttaccttcatgacgcggagctcccctgccagctgggcagatgaactacgtgggcaatgggactgtctncttcatccgtcggacnnggggangangancncngtcatnggtgnncngnggcgngncacgagtaacaggggnnnngnnngcntgaccagnngccaggnggacctgtnnattcaangggcaccatnngtggagtntatgncctcgnagangtgctgagggggtgcatgggggcgtggttaaccagccggcggagttctgacgcttgaccagggcgccagcttgagtagtcaagggggtgcataagggtggctggaacgggggggggggtgtgagcaggttggttcggtggggcacctaagcgtgggggggccgtagatgtgggttgcgagcggggaggggggtggtttggccgttacggggggggggtttgggtcgagggttggggagcccgggggagaccggggcgcggggggg

SEQ ID NO: 480934 - DNA, 150 bp, Homo sapiens
cctgagtggatggagagggctgggctagggccatgtggagcaggcaggctcgggagtgcaggaggaccctgatggggcacagcagcacaggagcctggggacctgtgagacagaggaggtcaggacgaaggtggggaccccagtgccacg

SEQ ID NO: 480935 - DNA, 108 bp, Homo sapiens
gagacctactaacagaacgggacttgccccggctccggctcctgctcctgcggttcttgaccggctgtcaggatttggcgattacgggcactgggatcggctactaga

SEQ ID NO: 480936 - DNA, 176 bp, Homo sapiens
ccacaggaagaaatagaaactggctcagagagggggaagaccatcaacagaacaaagaaataaacttacacgccctcctatccccatccagccagggatacgtaccttaccccaacatccccagggaggcagaagtgacgtgcagcaccgagatgtctagctacttcccacttgct

SEQ ID NO: 480937 - DNA, 435 bp, Homo sapiens
ttttacgtacttcaggattcccgctcggctgccgctgcgatgctctcggtactgggccctcttttcttccttggatcctcggcgcctagggcgatcatgcccccgtgtataaacaggccaggtgccccatcttgtggtccagaatcccctcctcgccactcgtgcaatgtacgtcagccccccgaggagagacattcagcaagtaggtctctatcgcctccaaggcttcagtatgtacagtatatttagcctccatatctgtctggcccgacatcaaccaggatttgatcaaatattcataaaaattgtccccgagtcctccaattgagacatggtgttgaacccagttcccactcactgggctgaggaagtaggggtagaggccaaagggcttctcgatcttcctgaggaccttgcggatgttcctgaccctta

SEQ ID NO: 480938 - DNA, 381 bp, Homo sapiens
tctgctagtatctctaagattcccactatggtcgcgtctgcgtgatgaatgtctttttgcgatgcctactggagactttgattcgaatgcccagttgggccgaccagggtgacggacgaggcgggacggacgactaatgtgtcaccagcgagctcctctaggtggatccctctggccacagcgttacaccagccccagagcctggggctactgccgggacgctccactgccgtcctcccatggagtgtcatcatcggtaaacataaacgacagtgactgcactacaagtatagtatgaggcatggcatagaagttcaagtattgttccgcatccttcagtgattgagtacccgtcacaggcttcatcaggctgctcgcaat

SEQ ID NO: 480939 - DNA, 591 bp, Homo sapiens
  misc_feature (162)..(162): n is a, c, g, or t
tgggtttgagcacaggggtacttaattggatgggtacatgacaaggggcggctccctaggccccccccctcttcagggggtctactgggcaactgtgaggaggggaaatccagggtggggggggactgagtgtggcagggactccccagcagtgagggtctnctctcttccttctggtggctcatgtgctgggggcggggggctccagtgggtctatactcctggtgatggccatgtgggccattgaggtccaccacccctgtgtgctgtagccaaattcgtggtcataccaggaaatgagcttgacaaagtgggtctgtggagggcaatggccagccccagcgtcaaaggtgggaggagggggtagtacgctgtagaagtcaagaggaaaccaccgggggctcaggggtagcccaggatgcccttgagggggccctccgagccggtttcaccaccttctggatgtcatcatattgggcaggttttctaaacggaggtcaggtccaccattgacacgtgggcatgtggggacactggaatggccaggccagggagctccccggtcagctcagggatgactctggcccacag

SEQ ID NO: 480940 - DNA, 957 bp, Homo sapiens
ctgggaaccaaggggagggccaatcaccacagtccgcgaaaaaggggccagggtccgggccgcggcgagaaacccgataggaagttctagtcagcacgaggtcccagaaaggaatagggagatgtctgagagggaaaatatcaatggaggggaatgtgaccagacccggagggatgacccagtaacagaaaagacaaacacctcaagggaacaattacagaagagtctggcagaaccgttctatgaaaaagtgcgtcggtcctgccttttgaatgccaggtcattggatgggtctcaagtgatatgccgaaaatgtttcggttaaagttcgctgaatctcagagcttctcttggacactgtcagtctctcaagctagccaaacggaactcggcgggactgactggtcctaggccggtagcacatggctaaggacggagttcaccagtggaggtccgggacagagactggatagaggtcgcaaaaaagcaagccagctgctgttttgctgatagacatctcggaggatgatccgattccttcgtgtatgccacacgaggcactccgggaatcactgtcaggttgttatgcacagaagagacctagattgctgggaccagcaaggccgtgtgatgcctgatggccaagacccagatgcctgttgttttaagttgggcagcagggacatcagctggcgattgtaaataggtttccaggatctaaactaacctttacagccagtattctcagcgtatcgagcagcatgtggtagcaaacaaccatggagatctcgtggcacatagccatatgatgaagactgtggtagataagatgttcctgtgaagtaccaaccaaaagggtgtggcctccagccaaaagaccatagagattcgttacctctatgctaagtttgtgttcgggtaccctcctaggtaggcatcgataactctgagctgtgt

SEQ ID NO: 480941 - DNA, 614 bp, Homo sapiens
  misc_feature (210)..(210): n is a, c, g, or t
  misc_feature (341)..(341): n is a, c, g, or t
  misc_feature (369)..(369): n is a, c, g, or t
  misc_feature (504)..(504): n is a, c, g, or t
  misc_feature (570)..(570): n is a, c, g, or t
cagattcctctccccactgggtcccctggggcctgccacctgtccccacgctgcccttgatttggggttggggggacacagccttctccctacagaggttaggctcatctacattagtgttcataatcgaatacataagaccctacacacaggtacacacagagtttccccacccactggcataggcgctggcccagctcacactccctncttactggaagcgaaggccttcccaatgctcccaacttggaggaagttgtgcaaaatatctgtagcccaaagtagaacgagaaagtcctcaacacacaacagaaaggaaaaagccaagttctgcaagcgangttgtagaactcacattttctgagtggnaagttttcagaaggttagaggacaccgggagggacggcccaggaggccccagagtccgcagagcctcagtccccagccttcacgtcgccgccgggtactgagcacagggatgaaagaggagaggagcccgcccgnccatggccgcccccatccctctcccctagtcctgcgcggcgcggacgggtctctgccgctcttacntgccggacccgcgcgctcttccatgctaggctccccgcggtcgc

SEQ ID NO: 480942 - DNA, 164 bp, Homo sapiens
cccgagcagcacccccagaaccggcaaggcatatcaacccagcgtgtttgtccctgtgagctccggtccggcgggtctcaggggaacaggtgaggcccccccagctcctgagtccagccctaggtctgggcggctccttaggcgggggcctgtgccttgggggg

SEQ ID NO: 480943 - DNA, 842 bp, Homo sapiens
agcggattattgctgtaggtttatgtccacccccttccctcctgtcgctctctctccttctcgtctctctctctctctctctttttgtccgccgctagctggggctgctcgttgagagagacgacggaagagaagagacgaccagagagatcgcatacaatccggatacggttcgttgacaagtgccctaactagctaagaccagcgacagcggatgcacccgttctcagatcttgcaaaggaccaaaaagacaaaacaggaagaaaagagaaccccaaggtccccttccgcggtcagctgtccttgaggccgttacacagcttgcgcctgcttgcaaatataacttgttgttcccgaggagcagcaggatgttcgtgtatgcatgtgctgcaatcaacagaatatgtcacagcatgacgataccggagcagggactattgacgggttcataagcgcattgcggtgacagaaccacagtgtgcaattcgagagatggaataaaataaattgagaggaaaatacatcgggagagacaagtcgagtaaattagggtgttaggaatcagcgaagatgcacgagaaccaatgccgcacaggagattgtgtgaaagtaaaaagcatatacacagttgctgtgaaatgcagaagtcatagagacaggaatccgcccactagaattagataggacgaagggacgagtacatcactcttgtcgttgggaaacgtacgaagcccattcagaagctcttgacacacctcttccattagaatacgacagttgtgtgaagcagctttcagtaggctccctttgactttgccataggatttcgtatttccacata

SEQ ID NO: 480944 - DNA, 150 bp, Homo sapiens
atctgattagatctagaggatcccgcgtgggtccttgcaagacttggccatggacgggactattaaggaggctctgtcggtggtgagctgacgaccagtcgctctttgactcagcgtacggagcggcagcccatctccccgaaggcctga

SEQ ID NO: 480945 - DNA, 664 bp, Homo sapiens
agcatctcagtctccagaagcttgctatcttcccaactgaaactctgtgcctgttaagcacgaactctccatctccctatccgcccagccgcgggcacccctgcatttgaatttttgtctctggtgagtctagactccttttagagcctcgaatgagggaaccatacagtatttgtccttttgtgactggcctatttcacttagcagcaaggtcctcagggttcatccatgtcgtagcttgtgtcagaattttattccttttgaaggctgaatagcattctattgtatgaatggaccacctttgcctatccgctcgtctgcccaatgacacttgggttattgagaactatgccactatgaacatgggtgtgcaaacagagtgactcttttagaacacaggtcagtccgtgacagtcctctgttcaacccgggccttcctgttctctcagtggagaagcccaaagcctttatgatggtccccaggacctgtacaccccaccccatcacgtcctgcagccacactgagctcctgctcttgctcagacacatgggcacactgccgccttatggcacaggcacaggctgctctcctgtcccctctgcctggacacccttccccaggcgtcccatgctgtcctcaccaccctcagtgtttgcccagtga

SEQ ID NO: 480946 - DNA, 284 bp, Homo sapiens
  misc_feature (58)..(58): n is a, c, g, or t
cactacagcagctatcatgcagatgtatgagtgagtgcagatgacaacttcagtgtanccaacgaaagtcagaaacagatcccccattatggttattggtttttactaattggcacgtatttaatgaggaaaggtaattctttcaataaacagtgttacaatgactggatacttgtatgggggaaaaaaagaacctgatccataattcacaacatacatatccattccacggtagatccccaattataaaaatataaagtttatataatcagagccggaatatc

SEQ ID NO: 480947 - DNA, 387 bp, Homo sapiens
ctacggcaggttgtactgttccatgggtgaaggctctaacacggccctgtaaaaactgggtaaggagatgtaagagacatgggccaagtgctaaatggaggaagagggtaatggcaggcctaggaagggcagtagccaggctgcccaggagttacgaaatcacctgggccgggaacctgaaaggcgctgcctgatttcagcagctttttttttttttttttttgggagatgggagtctggctcttggtcgccagggcgggatgtgcgggggaatcatctgtgctcagggaaagctcggcctccggggtccacccaaaaggcaattctcgggcctcagcctctggagtagctgggagattacacccggcgggggggggtgaccggagc

SEQ ID NO: 480948 - DNA, 393 bp, Homo sapiens
cacgagggaaatctttgagttatgtgcacacccgcaggcatattaccagatataaaaacattttggcaagttttatatgttttaactttccatcgctgttctcgaatccctcaggaaggcgagctcaggcagcatccgccgaagcctggggagatttttccagccgaattcatccgaccttcgaagtaatacataaaaagaataaaaaaataaatctctattctttgaaattatataacttgcggttatcctgatctccgcccgagcgtgcgtcgagccccttttgctgcgtctccgaacaaatcgagcatgagccgactggatgatctgacccttcccctgagccgggagaaagccgagctcctccgtcggcttgtggaagggctttccccg

SEQ ID NO: 480949 - DNA, 91 bp, Homo sapiens
tgtgtttatgtacgtgtgtgtgtgtgtgtgtgtgtgtgtgtgtgtgtttatattgtgaatagagggagaggattatatgtgtatagagaag

SEQ ID NO: 480950 - DNA, 577 bp, Homo sapiens
tacgccaggcctggcgttacatctgatgagatgaaagggctggatctggttcttgatctgcataagccggcccagggcccgatccacgatggtggggaagtcgagcagcctcagggtgtggcccgtgggctgcctgtgttaaataccaaccgaccgagtaagttcatgcccattcaccatgcctcatcgtacctcgtgaaatacattcatggcctcgatcgcactgccaggatagatcgccctcatcggcccggccgccgattcgctggtgcgcttctctctaagagtccgagctggcagtgccatagcctaggctgtgcgtgactggcccgtcgttcttacaatcatcactgagcgtagggaaacatgggtggaaggaaaccaaacaataaaaaaaaaaacacccaacccttccccacacaaacaaaaaccaaacacaaacacaaaaaagcgtgaccgactcccccaacgcccccaccagagcaatttcacagggggtagaactagcgacggggagagcaaaagcgaccaggaaaaagaaaaagacgggaagagcgcaccaggccgagcgtaggaa

SEQ ID NO: 480951 - DNA, 359 bp, Homo sapiens
cccaaagtagtcaatgcaaactataacatatgattaccacatatcatgctgaggcataaataaaactatgcataactgttgggctcaaaactgatgttcaagcaccttaattccattgctagataatttgttggttaacttttgcaaagtggagagaatagtaacatcacttcaaaaatgaaaagatgggttgttattttgttgtgtttttaaaaaaggaaaggaataatgcatgggttatttttatatattaagtaaaaaataatataacattttattactaaagaaactaacattttcttactaaaatacatttcatgcccttaagctattggtaatatgcaaagttattgagaatg

SEQ ID NO: 480952 - DNA, 422 bp, Homo sapiens
gaattcgctctctgggaggctgaggtgggtggatcacggtcaggagttcgagaccaggctggccaacatggtgaaaccctgtctctgcaaaaaatacaaaaactagccgggcgtggtggtgcacgcctgtaatcctagctactcaggaggctgaggcaggagaattgctagaacctgggagacggaggttgcagagagctgagatggcaccatcgcactccagcctgggcaacaaagtgagactctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagca

SEQ ID NO: 480953 - DNA, 278 bp, Homo sapiens
tataataccacatctccctgtctgctattctgtaatataataccacatctccctgtctgttattctgtaatataataccacatctccctgtctgttattctgttgctggggataatgcacattcaccatgttattctgttgctggggataatgcacattcaccatgttattctgttgctggggataatgcacattcaccatgttattctgttgctggggataacgcacattcaccatgttattctgttgctggggataatgcacattcacgtcgacgc

SEQ ID NO: 480954 - DNA, 246 bp, Homo sapiens
  misc_feature (159)..(159): n is a, c, g, or t
  misc_feature (177)..(177): n is a, c, g, or t
  misc_feature (217)..(217): n is a, c, g, or t
ccaatgatggcaaacatgaggatggcaaagaagagaagcagcccaatctgcaggagtggaaccatggccttcatgatggacttgagcaccacctgcaaacctggggccagaacagggcaggtcaggaagcaacgtgggcagggtagggcaaggaatttngtgggggcagggacagancagcaggaacctagcagggacagcaaggtgctaagcagtnagtgctttcaagggcaaaggttagagctg

SEQ ID NO: 480955 - DNA, 111 bp, Homo sapiens
aatataggggggaggatgggactcttcttccaaatggtgcttgtccgggaaccggggtcccggggagctggggcctggtccacatggaccccctccacctccccacatacg

SEQ ID NO: 480956 - DNA, 323 bp, Homo sapiens
atccagttggaccagcgggctacgaatcgcatctacgcaatctgagctgatgcacgtgcagactcagaactgtctcgtcgaggatcttccacttgaaccttctgtcaccacagcagacaggcgtcacttgatagtgtggcacgtgctgtatggcaactgagtgagcccatgcgaaacaggtggagctggggaagccgtctcttctgcatggtttattttccctctatccttttatttactgctcttttgtgagataacgtttcaccacataatgtgtgagccttttttcctggtaactttatattacaaaatccgttctacca

SEQ ID NO: 480957 - DNA, 1336 bp, Homo sapiens
  misc_feature (323)..(323): n is a, c, g, or t
  misc_feature (924)..(924): n is a, c, g, or t
aaagcggtttgtgtgtggttgtgttgtctttagttgtagtgtgtgtgagtggtgtgatgaaaagaaaagaagtaacagagcttacgattaatcaaaaagcgaccatgatatgaccacggcggggtctgtaagctcatcatctgtgtctgcgccgtgctcaaacgatctttgggggggctcttttgtttaggggggcaatactcgccgcggggggggccccgtctcttcggcgcctcgctgctgcgggaagttctttgagtgtggtcgaagatgccctccaatcttgtttggggagatctcttctcccggggaacacatggggnctgccattgtccacacagaaatggtgtgtctctcacaagggatgttgtttgtcgcgggccaacacacttgtggtcggggggcccacgccgaattgttggccccccccgctggtggatcgcggctggggcttacaccgtgtcttccagggtgatttgttccctgggccccatttctcggtctcatatttgctccctcggcgttattggccccctttggaattgggaatttggcccaccccccggggctcaccacttgtggcagtggcacaggtgttggccttgacagctgtataaggatagaacggtttgtgttccccctttttcggtgtaaaaaagcctggaaagattggcccctccaattttctctgagaagttctcgcgtgaatggctcgcccatctggttagaataattgggtgccctcggcacaggcgccccataggagtgtttgaagaagctcttctcacgagctatgaccacccctttgggtcgctcttgctcgtttctgaatatgaggagcacgacacagtttcggtgggtgtcaatccaaagcacagtggacccaagaacaggcttgctggagagctggcacaaggtctaccnccaagtttgccccaggaaagctcacgagaaggctataaatggatatttattcccttaatacctgccacacccacacttcttgaatcacgtggtggaagacgcgttctcacgggactgtgcttggtatcaaaattggccacatgtataggttctatgtgagtaaaaagaactggttataatgagtaaccacaatgcactttgtataaaccctctcacgaaaggagaaaggaggaaatgttttgtggagccacccttggttttcttttttgcgtgtggccgagtttaagattattagatttttgaaatccagatactttttaatgggaaccaccttgaccccaaaaattgtccccagaattgttgagaccccctttaaaaaggtttaatgaggtaaaacaaaaaaaaaaataaa

SEQ ID NO: 480958 - DNA, 416 bp, Homo sapiens
gacgcccggacaagttgtgtatcctgccctccgaacatcagtccggttgggtgatcaacggcagtattcgcctggctcacctgtatttcagcccggaacagtttgcgctcggttgtgtgacgctgttggaccgtgagccccgtgagctgcagttgcaggaacatacttttctggatgacccgcagcaggccctgcgcatttcgccaactgatcagcctggactgggatgaaccgggagagcgcctgctcagcagcagcctggcccatgagttgctcggccatacgttgctcaatcaggtggggatgcgccagggcttgcgattgaaaggcggtttggcggccatcagcacggctgttggtggagtgcatcgacagccgcttggaccagccgttgagcctgggtgagttggccgggt

SEQ ID NO: 480959 - DNA, 323 bp, Homo sapiens
agaagaagagtaggagagggtgatagttgttggcttaacaaagaatagaatagcgagagcgcggccaggggaggtagttaggtcaagtggatatgttctgtaccaaggacacagcaaaggtcctaaggcactgattcacattacccgaagtcaccaaataataaagttgtttccgtggctgacatttcttaaccttgccctcaaacttggcaggagggaggcaagctcgtttaaaaaaaggaaaggggaggaaatccaggcaattggcctaagggttggcttcgagagaaaataggttgacccttcctccgaaaaaaggaagg

SEQ ID NO: 480960 - DNA, 1070 bp, Homo sapiens
  misc_feature (4)..(4): n is a, c, g, or t
  misc_feature (6)..(6): n is a, c, g, or t
  misc_feature (12)..(12): n is a, c, g, or t
  misc_feature (74)..(74): n is a, c, g, or t
  misc_feature (104)..(104): n is a, c, g, or t
agcngngggcgngggctgacactcattcagccggggaaggtgaggcgagtagaggctggtgcggaacttgccgnccccagcagcgccggcgggctaagcccagnggccgggcagacaaaagaggccgcccgcgtaggacaggcacggccggcggcgtgcgacagtcgtcagcagaatggcacgggactgagtggggctagcgcgcatgcatgagcttcatgatggctggtggacacgtggtcatgccatgacagggtggcttccttgggctgccagaaagacccaggtagcccggggcgcccgcaggacgaggcatgaggcggcgccaggcaggatgctagcaagaaggacggcatctccttcgattaccagccgctaccccggagcttgcgcgaggcggctcgtgtccgtgtgggcttgcggttgcaccggaccagtcacgcaggatttacacgcgtggggcagcagtcttcgatggcgccgggatgctcctggtcgtcgaggctgtcacggaacaagctcctggcggttcccattgaggctctggtgtgtcgtcgctgacagtttgagacattaccatttgggcgagatattggccacttgggggaaattggatgggccttggtttggcacggaagtacagctgcttcaatgctctctttgtgccccaagctaccttatgcaaaacggaataccacgaatggtgggaactggaaggacaattttgtcaaacgcgtggattctcactaggttacctccgcgaagtttcgaccgtttcaattggccctttccccttggaaagccccaagaacttgagctgtttgaacgaaaggggacaacggcggttcttacaagccccttggggtttggaaatcgttcgactgtgaacccttgggatttggcgtgcgggcttccgacaaggccaaagttgacccccaaggggaagactatagattttcttggaaacccccgtgagaactcttttttcccatagtactctcttggcgttttaacgggaactaagggtggtaaccgtttgaacctttggaaagagcaagaacaccggggtg

SEQ ID NO: 480961 - DNA, 708 bp, Homo sapiens
  misc_feature (4)..(4): n is a, c, g, or t
  misc_feature (6)..(6): n is a, c, g, or t
  misc_feature (12)..(12): n is a, c, g, or t
  misc_feature (74)..(74): n is a, c, g, or t
  misc_feature (104)..(104): n is a, c, g, or t
agcngngggcgngggctgacactcattcagccggggaaggtgaggcgagtagaggctggtgcggaacttgccgnccccagcagcgccggcgggctaagcccagnggccgggcagacaaaagaggccgcccgcgtaggacaggcacggccggcggtggcggagcgcagcgtatggccggtgcgagggggctgcgctctgttggctctgtgcggggcactggttgcctgcgggtggctcctgggcgccgacgcccaggatgccctgtggtcgcccgcgtgcgggcattgatggcggtctccggcgtgtgatgcggcaagtaggacgtgcattcttcctttcgatgtacctacccgtatactcctcgtagctgcgcgtaggcggctcgtgtccggtgtggtcctgcttgtgcaccgtcatctgcaggatttacacggtgtggtgcgcatccttctgaagggccgggcagctccttggtcatccgtacgtctgtccgtagaacccttgtgtgtccagtgtatcctggtgagcctgaattttaaagtacattgggaatatgcatgggacactgaggctgttggacgagaacgtggtcatctttcttgggccaggtacctatgcaacggtataccagcaaggggaactgagacaacttgtcaatcctgatcctacagtacccgcaattcgcatgcatgcctttccctgaaacgc

SEQ ID NO: 480962 - DNA, 340 bp, Homo sapiens
  misc_feature (169)..(169): n is a, c, g, or t
  misc_feature (198)..(198): n is a, c, g, or t
  misc_feature (245)..(245): n is a, c, g, or t
cagagtgctcgatctcagctgcaacagactgaacagggcggccgaacctgacgagctcccgaggtggataacctgacactggacgggaatccttcctggtcctggaactgccctcccccacgaggctcaatgaactccggcgtggtccagctgtgcacgttcgacctgnggtgggggtgtcgggaacctggtgctgcncaaggggccgggggtttcttaagatcaagacagataatgaatggacncaaactgccttgggttcaggggagtcccgtcagacgttgaggacttttcgaccaattcaacccattgcccacctttattaaaatcttaacaacga

SEQ ID NO: 480963 - DNA, 349 bp, Homo sapiens
  misc_feature (2)..(2): n is a, c, g, or t
angagcatcccaggtgaaggacattctacaaaattccggaccagtcctcctcataactctcaagtccgtgaaaaacaaagaaaggctgagaagctgtcacagacaagaggagtctcaaggagtcctgggcaataaatgtaatacggggtcctggatgggatcccagaacagaaaaaggatgtgaggtataaaaaccagaaattcgaatcaagcatgaactttagctaatagtaacatataactatcagttcactaattgtaacaaatgcaccctactcatgtaagatgttataacaggggagactggggcagggcaggtgggaactctatgctatctttgcagtttttc

SEQ ID NO: 480964 - DNA, 109 bp, Homo sapiens
attaggatgccgcttacccctccgacactcaagctatacatgttccaaagcagattcatgggttgagcccacgcctttcacttcagacttgcattgccgtctgcgctcc

SEQ ID NO: 480965 - DNA, 344 bp, Homo sapiens
  misc_feature (87)..(87): n is a, c, g, or t
cgttaaacacgcaatctttattaaatgcatgatccaggatggatttagatcttgtgaaagcagccacatccatggactgcacatagntcctcaaaagcagtgatctgctcctccagcatatctggtccaactttatcattccttcaaataaaacactgtatttgaaggtttcttaattccggatcccactggaactagtttagatgaaggcccagaactaagccgtctggttgaatggttctgacgcactcctctaatttcgccatatctgtctcatcatcccaaggtttcacatctagtaagatggaagacttggcaacaagtgcaggttttttggctttctt

SEQ ID NO: 480966 - DNA, 1237 bp, Homo sapiens
tccaactttttttaaaccaaatccagtaattttatacaaggccttacaaaggggtcccctaaaaaactgaaccttcatttcgggcagggaaaaaaccagggctctcgaggatcatgactgaagttgggccagtgtcccatcatataagttgtcccaacatcaccagggacacaaagctcagcagtgagggcttcatacccaaatcctccctagcgacgaggtacttcttcaacttcttctccaccacctcttggagaggcctcagggaaaattgagagattggggcgtgtggtgggcccctttcttataactccccagtttccagaagcctccgcaacgtgctatgccgtctcgcgggccgcaagcagggttacaccttcgaaagctgtgccccctcgcgggagcattcgaagcgggtgtccacccattatagcgtggaagccctcgtgggggccctccgagggcgcacaggcgcctggtggctatcaggggccgcgcggagcgtatgtgacgcccccaataggaacgccgttcagacaatagtgtgccaagagcctcgaataacaaagggggtcgccttccctcacatttccctcccccgcccagatttccgcccaagattatcactactcagcaatctcacacggagaatacgggggggaaccacccggggggccatcaagcactatatacagccttctcctctcccccgcggggggaacgcccatgggcggcacaaaaaaagccccggcgccagaaaaattggcaacggcggaaactgtggggtgggcaacagaaggaattacggaccagcactgttgctcacgaaaaccaaagctttcacaggcccacacctcgagtgcttgcccgaaaacaaaggccccccaaagattagaggcccccccaaagataaagaaacaccagaagtgtgttaccccgagcatccccaggggaacagaaacagccaataacaggctcgcggccaggaggcttttcgggaatccccgtcatgggacaccagccggtgtggaaagggaggccccgaattatgcgcaacccctcaaagtgaacacgcgcggctaacccaaggggccccaggcaggtcgtctcgccaaggggagcacattccgagaaaaaccccgaagggctaatgattatcctatacccacgcgcggggtctccaaaagcccaagtagaagaagtcgggcccctgaaacccgtggtacccacattcgcg

SEQ ID NO: 480967 - DNA, 117 bp, Homo sapiens
  misc_feature (94)..(94): n is a, c, g, or t
agtgcactgtaccttcgatagcagttcctgagccaaatgtggtgttgatgatgcaaattgtctctgatgcaatgcggcccattgtgagctcgantaagaaacttgctcagatttgca

SEQ ID NO: 480968 - DNA, 103 bp, Homo sapiens
gacgtagagtgcagtggtggtgtgatcacagctcattagcgtctactccaggctcatgctatcttccgcttagatccgagtagttggactacaggcatgtgct

SEQ ID NO: 480969 - DNA, 174 bp, Homo sapiens
  misc_feature (92)..(92): n is a, c, g, or t
tcgtcggcctgctccggtggtctcctcccattctagaactccactgatgtatactgggctgttttactaagtttcagatctcttactttttnttttattttcttcttctttttcgctcctgtaggaacaccagggctattcctctgctgatattctctcaactttttcttcgct

SEQ ID NO: 480970 - DNA, 1551 bp, Homo sapiens
tgggtgttctcgtggcgtcggtgtcggttctgttgtggtggggcccgtccgtctttgtgggcttgtgtgtctagtctcttggcgggagagatagagacgaagaagaagaacagaaagaaagagactatcacgcgaaggaagaagagagagagcgagaaagagaaagaaacaagaagagtatcaggtacagcatgctgcctgtggtcccggctccgtctggtatcgatgctgatgtcgactgccttgactttcgctgttctcgttggtcggtttcctgacttgctctcgattggttcagtcgttcgtttagttttgtcgatcttctgttggtgtgtaagttattctcgtctgcgttgtgtgtgctgtcgtttggtgtggtgtggtgttggtggtgtgtgtgtggtgtgtgcgttgtggcttggattgctttcgtccgcgcttgtgtttgttgctgtgatgcgtaagtatgtgtgttgtgttttggcttgggttgtgtggtggtgttggctttgtttgtttttgtggttgcgccttcgtgtgttgtgggtctgctgtgttagtttggttgctgcgttcgcgtctggttgttttgtgtctatgtcgcattgctctgtcgtgtcatggtgttgttgtgggtcagtttcggtctctttgctgtgtcgctttttgttcgctttggtcctccggtttgtgttctctgtgttgcgcattagtgttgttaggggactttttctgtaagctgagtgtagtttttctggcggttgaggttgtcgctcgccgatgggcgccgtttgttcgctgcagggtggtctcgtgtttggagaggtgtatcgtcgaggtgaggcgggatagttttgatgggtcccttttggtgtgttcatccatgcatgcgcttcgtgttgtgagtcttagttgactgtcggtatgtcctccttcgcgacgctcctctgcgctggaagttggaggctcagtgcctttgggttgcttgttctgttttctactgctttgcgctataccacgagctaacgcgctcaagtaagtatgcaatgtcttcgtctctcggtcttttagccttgccataggggcttgcagagttggatgataggtatccactagttggtccctggattgtgtgtcttctccgtcgccctggatccaacgtttggtcttgaagttcgtgcacggttaccccagtcagtgtcgtgttgtgtaaatgctgactatccttttgtattatctccatatatgtttgtgctccttgtatgtgtgtcccctctttatctcgactctctcgatacctcgcttttaagaacccttcctcgcccggttatgttcacattgtccatggtacttttaatataactatgatatatatacaacagaatagactaatagatacatactatgagatacttacaataaattgaatcaatacatatagaatacaaatatcgcatgaggagaagtgcaactcaacaatacagaatgaattaactgcatgaagcatatgagaaatacaagaacaaacagacccaacaatgtccacaaaat

SEQ ID NO: 480971 - DNA, 649 bp, Homo sapiens
  misc_feature (33)..(33): n is a, c, g, or t
  misc_feature (292)..(292): n is a, c, g, or t
  misc_feature (611)..(611): n is a, c, g, or t
accgttcatagaggacccccaaggtccttagcntctaatcccctcacatcacctgacaaaggcccacctcttaatgccaacacactggggattagatttaacatacgaatttggagggacacaaacattcagaccacagcaccttctgatttgtgtaacatctgatatgaagtttatttataggtggtcaggagattggcatacatgaaataaggtaaagaatggaagcttttgagatggaaaggcagaaatggaaaggatgagaaaaaggctgactgagtaatgaaggatnatgaaaagccatggccaagtggaattttctactctctgctctcgtcctctctcagtactctctttagactggccttgagacctgtattctggtgagccctgtctggttctgctctgacagtgtgacttcccatgatgcaaagaatccacagagccaagatgtgctcacacataccctgcctttagattacattttttttatgtccatatttacatatatattcacatgattttcttttaaactaaaattgttttttacaaaaactgcagtggtttattttttcctgtgttaattcaccaatttctcagctcttcccatnttagattcctcatggaatgaatcctgttcatctatctt

SEQ ID NO: 480972 - DNA, 805 bp, Homo sapiens
  misc_feature (573)..(573): n is a, c, g, or t
gcctgctgaccggtttgcagagtaccatcttccctgcaatctctgaaggatggacttaaccaccaccatgtcgagcagaagaacaaagagcaagacaagaagcgccctcagcgtgcaacatccaatgtgtttgctatgttgaccagtcacagattcaggagttcagagaggccttcaacactgatgatcagaacagagatggtttcatcgacaaggaagattgcatgatatgcttgcttcatgggggaagaatccaactgatgagtatctagatgccatgatgaatgaggctccaggtgccatcaatttcaccatgtgcctcagcatgtttggtgagaagttaaatggacgagagatcctgagagatgtctatcagaatatggccttgtgctgtgttttgatgtagcgaagacaataggaccatacaggaagatttacttgagagagctgtgataaccagtgggggatcggttcacagatgacggacgtggatgagctgtaccagagaagcagctatggtaacaaggggaatttaagttacatcgagtgcaactgcattctgaatcatggagncatgagacatagcatgatgaacatgaattcaaatgccatgccaaatgtccattgtggcacttagggtaatctgagattacctgttgcatgccttagattaaaggtttggatttgctgtggtttatctcggccataggctatgtgttttatactgaaggaacgggctttataaaagttggcccgaaaggggtgctaatgcgggttttcccaaagggggaagcaatttggcagt

SEQ ID NO: 480973 - DNA, 365 bp, Homo sapiens
  misc_feature (291)..(291): n is a, c, g, or t
ccccctcgaaggacaggcccttatggccggatcctctgtccgacacagctgacttgtgggatgcaggcccggctgctggagcagcggccctccatctcactctgtcctcaggtgccccgggccttgctggagttcccgtcggctgggcgctaaatcagaagagggccctgcatacacctcatttatttaggaaggggagcaccaaccacagagcccaaaggttatagagttaaaaccacccactgccttgtatgtccatcttcttctctcttatgccctatttaattttcnccgatccgcaggataggccaggcccggcgggctcaggcctgtgctccccgccccttgcgaggttgcggcgttct

SEQ ID NO: 480974 - DNA, 382 bp, Homo sapiens
  misc_feature (243)..(243): n is a, c, g, or t
cccccccccccccccccctaaaagtaaattctccaaaagggggagggggggggcccccccccccccccttttttttaaaggtttgggaaatattctcttctaaaaaaaaggccccctcgggattcaaaagttttgaaaatttttttaaaggtggccccgggccccgggtttttatatggggccgggggggttttttattggccccccccccccctgggacccaaaccccctgggaaggggcgntttgttttaccccccctcgaaatttcccttttgggggggggggggggtttttttttcccaggaaactttttttttttcggggttttaaaaaaagggggggacccccggggggccccaaaaaaaaaagttttgggcccca

SEQ ID NO: 480975 - DNA, 1094 bp, Homo sapiens
  misc_feature (475)..(475): n is a, c, g, or t
ggttccgtgtcactatagccaggttcgggtcctgtatccgctgccatcctcctccaggcgcggcctcggatggcctcctgctcctcctggacgctgaggcagagcccacactcgtgtgtgtgcaacggtaggacaccgaggtggtgcattggagacccccatcttgcggctgtggcacgacagacattgagatgtgacctagcagctcgccgcgcgcgtgtcgaggagtcggactgcgttgttccctggttgtccgcagggtgtggcgtgctcggccacgtgcctggagcaccgtacgctgcggggtctcggacgtcctagacggtctcatcgggccttgcctgggggccggtccatgaggtcctcttcgatttaggacagaatgccggggcgtcatcgacagtgcggtctccgggtctgcgatctgatcagtcgaagcagcaggaggctatgaacgtggtgcctctactctgtntccgacgacaaagggcctaaggaatgatcgcgtgttgcgatagggacattcaatgcctatagagatacctctaggcgcgctattgtggaacatgggaccctgggtatatcggggtatggaaggcggagatgaaggccatcctctagtagaggcggctggcaagtgcctcctgcgattaagcaggttcacaccaggccctggaaggcgcaaacagttactccaattgcttaagctgggccacaggtacagagcagagacaaagcacgagaagaagcacgagactgtggcccgggccgaggaacgaggctgtgggcaccgggacgtcccacgaggagacaaccgtccattcagcaggagttacacgccagaccttggtggagaacagaaagctcagcggtgtgtgcaccgacgggatcgcacgagcggtgctatctgctgccggtagaaagggggacgcacgtatccaggaaggacgaggggttgtcaggacggcacggcctcacagaacggacaagctgctcaggggctgcgccacgacgagccgaggggcacggcacatggtcaccaaggaaccacgggggttaaaaaccaaaagggaagacggcgaggagaagatatt

SEQ ID NO: 480976 - DNA, 131 bp, Homo sapiens
tcacaaagtgtcttcggaacataagggatattaaattttaagtgatttttggatgttattgatatctttgtagtagctttttttaaaagactaccaaaatgtatgttgtcctattatttttatgttttatt

SEQ ID NO: 480977 - DNA, 465 bp, Homo sapiens
tctggtaaacagtactatgtaacacatcatgacagtgataatggcaatccactttggaaaacaatttggcagcgttttttataactataaaaaacacatatctaaggtcttagcagtcacaatgcacttaggcacaaaggacatggacaagaatgtccactgtagccctatttgtaattgcataaaaaggaaataaaccacgtgtctgccagtaaggaaatggcaatacaggtcataggcaaatccacactactggaacgctggctccacaaggcacaggtttatgtgtgatttgtccatggctgtagccccaaagcctaaaacagtaactgatacacagctggcactcagacatttactgaatgcatactatggcataccgtgcagtgcttaaaacgaataagggatgtgtagtatatattatatgcgcacatatatgtatgtgtatatatattatatatctat

SEQ ID NO: 480978 - DNA, 105 bp, Homo sapiens
actaccagacaaccttagcaaaccatttacccaaataaagtataggcgatagagattgaaaccgcgcgcacatagatatagtaccgcaaggcaaagatgaaaatt

SEQ ID NO: 480979 - DNA, 624 bp, Homo sapiens
ctgagtggcatggtattagcaaactcatcactagacatcgtactacacgacacgtactacgttgtagcgtcacgttccactatgtcctatcaataggagctgtatttggccatcataggaaggctgtcagttcagctgatttaccgcctgattgctcatggctaacaccgctaggaccgaaagcctaacgcgcagaaaagtccgatgttgcagctattcatgattcatcggtcgctagacaatctcaaacttgtcgttgcccagcgagacactgtgtctcggtggctattcccggagactgtccccgagcgttactcggactaccccgatgcatagcgaccacatgaagacatcctatcatctataggctcagttcatgttcgtctaacagccaggtaatatgacagtaagttgtcagtgatttgagaagccttcgcttcgaagcgaaaagtcctaatagtagaagaaccctccataaggctggagtgactatatggatgcccccaccctacacacattcgaagaacccgtatacatagagatctagactaacaaaggaaggaatcgaaccccgccaaagctggtttcaagccaaccccatggactccatgactttttcgaaaa

SEQ ID NO: 480980 - DNA, 181 bp, Homo sapiens
tgtacataatcagctcggtaccggttcgcatgttccctctgctgggaatgcctttcttttcccagcgtttgcaaaatccttcccagccttcaaatatctgaggcaagcctgggcacagtggctcacacctataatccctggctcacacctataatcccagtatttggggaagcttaggtgg

SEQ ID NO: 480981 - DNA, 125 bp, Homo sapiens
gcacgagtaggaagaaagagaggaaggaaagaaaggaaaaagggaaagaaaggaaggaagaaaggaaggaagggacaagaaagaaacaaaagctgatgttctctctctccagaggcaccagggag

SEQ ID NO: 480982 - DNA, 1027 bp, Homo sapiens
  misc_feature (743)..(743): n is a, c, g, or t
gaactggatcagaaaaggttctgattgcccaagagaaaagtggcaacgaacacagtttatgtgtttgccaaaaaggattctaacatagtgcctagcacaggagagtgtacgatccatgtctatgagaattcttcccgagccacctagtagtatagtgggttatacactgctgtcaagaggaggacagggtgccaagaagagtgctactggtcagggcagttgtggcaactcgtaccatatagtcgagggcaagaagtcccatcagttattgtcgtctcaagaagcgagttcagagtcatgagtgttcccgagcaagacgcactattgttacgagagcatgatgtgatctctcactgaatttctcgaaggacgccacgacgactcatggaaatgggtccaagatctatcatctcgaatgaaagctatgttgtgcactcccttgaatcaagaaatgtgtgaccgcgtatccttgtgcagtcggtatgcaaacgaggaagcaagagcgcatcgcgtgttgagcataactcgatacaaagaattaaaatgatcggacatacggaagttactatcgagaacaagaatgtgctgcagcatgcattgtatggtgtcaacgctgattgcgggtagataggcgaatctggcgtcaatggcatgtgagggatgacagtgggtgacgagcagagggtgcactgtgctaggatatgcattgggcgtaggaagagaaagaaacttacgaattgacnaagagatcacagattggagaatccaagaagatcggtgatctatgattggggacagtatgcttttggcattctttattcgacgagggtaatgctaatagagacactctgggcttcaagaagcaaagttggcgagatactattgcacgagaaaatatgattgggattcgaggggaaaaggatttataacctttgggaggtagggcaaattaaagaacacggattcaatatctggatgagctacaaatactcgttgagctctgtgaaactggggtgagtacaaaaaa

SEQ ID NO: 480983 - DNA, 255 bp, Homo sapiens
  misc_feature (86)..(86): n is a, c, g, or t
  misc_feature (88)..(88): n is a, c, g, or t
  misc_feature (103)..(103): n is a, c, g, or t
  misc_feature (130)..(130): n is a, c, g, or t
  misc_feature (188)..(188): n is a, c, g, or t
  misc_feature (204)..(204): n is a, c, g, or t
gccctccgcccttggaatagttttttggaagccggcctgtttccgccttcagacctagggagaggttttaacctttgttttcagantntggaaaaggtttttnaacgggttggcctgacctcagttcttngcattccctccacatttcaagacaccaacccagggatgcaggacagacacacagacantcagtgagggtcaaanatttttaaataaagtgccaggaacaataaatactgtacaggaagagagtgc

SEQ ID NO: 480984 - DNA, 887 bp, Homo sapiens
gccctggtgtgattccgtcctgcgcggttgtctctggagcagcgtgcttttatctccgtaccgcttctctcctacctaagtgcgtgccgccacccgatgcagattcgagtggacatggtacattgtagccccctgaggccccgagaactatcttatcggttgtgaactataggccgacaaagattatcacgtttaaggtgcctaattgtatgaacttgagcaccagttatctttaagacccggtcagttaagtgggctgtgtgcaaaggctgagctttgcccatgttgacacgcagaggcaatgatttacgaaaggcagtccatttacagtaacactggcaattttgaaaatgtctgtatcagccaatggttacccttgggggctttgataataacagcagcagtggtcttaaggttgactgtgtggttcacggggcagtgcaatattagtggacaggacttagtagctgtggaggaagatgcagagtcagaagatgacgaggaggaggttgtgagactcttaagtatatctgaaagcggtatgcccctggaggtggtagcgaggttccacagaactaagttaaacttggttgctgatgaagaatgatgggatggtgatgaagaggatgtgccttcagatgctgctgatgattggtttggatgaatccagaactgaaaaaagcgcagtggatgaatttttgtgatgtgcgacaaatgtgcagctcaatagatggtggaattggaagtcctaggccggggaagggggagttcgaagggagatctttggagcaaggtttttgtggattaaaaccgggtgaaaaggttccaggggaacatgaaggggggggggccactcggtgtaaaaagacttttttttaatggggtgt

SEQ ID NO: 480985 - DNA, 144 bp, Homo sapiens
ggttcttgcccacaggttagaattgctacatggtttttttttaaaaactgctgatgcctgaaccgagttattattgctaacaaataacagcccgtcagtattcagattcaaagcttctcagaagattttaatgtgtatccagag

SEQ ID NO: 480986 - DNA, 344 bp, Homo sapiens
cagcggtacctgcttatgaagtcgcggtcgtaggtgggactggagggactttaattttgttgttgtttttgagacagaatctctctgtcacccaggctgaagtgcagtggcgcgatctcggctcactgcaacctccgcccccaggttcaagcaattctcctgcctcagcctcccgagtagctgggatcacaggcatgcaccaccatgcccagctaattttgtatttttagtacagagggggtttcaccatgttggccaggctggtcttgaactcctgacctcaggtgatccgcccatctcagcttcccagagtgctaggattacaggcctgagccactgcgcct

SEQ ID NO: 480987 - DNA, 358 bp, Homo sapiens
agaaccggtcaatcattgctggtgtgaatacaaactcgctcagccaccttgaaaaacagtgtgtgaaaaaacttacataactaagagatttcacctctacctaagctgttccatcacctgttgcttgtcctggagtccctgctgggaatgctcccaggctattagagagtgtgcgcgtgagtgccctggtgtgactctagtgatctacgtagctcggcttttttggcacatggatcaacaaaatcggcaaggtctcagggaccttgttaacagcggagtaactattcagattatgagagcatcagagttttatcactggtggaggaattttgtcaactacccacctggggatgaagct

SEQ ID NO: 480988 - DNA, 489 bp, Homo sapiens
  misc_feature (489)..(489): n is a, c, g, or t
ggcaagcgggtctagcaggagaattataagctgcgatatcagaacgacgacttgaatgggcagattttgagcctcagactctacgaagcaaccgtctcgcgcgatgagctaatggaagccctgaaggagcaggaggagatcaactttcggctgaggcagtacatggacaagattatgctcgacatcctggaccacaatccctccatactcgagatcaaacactaaggcacggtgctggctgcagagcagccttaggaccctgggaccaagggcagaccctgtccaaggatgcacgactaagacgagcctcacactcacactgttgtctatcttgtcaccatgcgttacgggtacccgtgtatatgaggggaggctgtgcacactagcgaggggtgagtggacgaggctgtgggcaagaagcacacggttagacgtgcatgcactttgtggtccctttgcatggtgcagaggtacctgaagtgggaggtn

SEQ ID NO: 480989 - DNA, 924 bp, Homo sapiens
  misc_feature (6)..(6): n is a, c, g, or t
ttcggnttggcgtctgatcattttggcgtcgcgacataatcgggggggtcctactgggtcgcgctgctgcgcgggacaaagggatttttctggaggcataaggctataggctgtgcgttagggtgtcgcggttatatctttgtagcgcgtcaagcggtgggttcgattgacgggggcgctatggggggttctctatgagccgagaacgggcggtattctcaaaggggggttcaacacgccgcgcgtgatctgcacgcgtgggtggaacgcggccttctttgtgggtcgtcgcgaaagcacaagagcttttgttggtgtggtgctacatactatcggtccgcggtggctgtttggtagccgtcccgttggtgggtggtctttaggcgggcggggtgaccccgtcccttgccgatgcgccccgtgggttggccacgagaggaggcgggtttttttttctcataggccaacatagggcgccacaacgtgtgtgcgccctgtggtgggaacccgtttgggcgaatgagttttgcgcgcgcgaattatttgccgtccacgggggggcacagtttgtcgccgccgccttagaggcgagcgtagcgatccacggcggaatgtttctttgttggacggggaggaatttggaccccccttctcctgggcttagacgccacgttagacgtgcgctgacgcgcgtgataaacaccgaacacgtgttcttctccggcggcgtctagaaggcgcctattttgttataaaagcttggggcggtgacccataaggtcacaccgccacaaggagcttcagctcgttgtttttcaaagactaggactcccacatgggcggcgcatctctgggtgcgacttctaacgccgcgacctcatctgagtccccgaaaaaaaaaccaattggaaccccaaaataaca

SEQ ID NO: 480990 - DNA, 149 bp, Homo sapiens
ctgtatgatcatggccgtcgggatctcgatgatgcgtttggcgcgcgcggcgacttcgcggtcgtgggtaatcaggatgacgacgtggccctggctcgccagttcatcgagcagtgtcatgacctcggcgccgctgtggctgtcgaggg

SEQ ID NO: 480991 - DNA, 1432 bp, Homo sapiens
  misc_feature (632)..(632): n is a, c, g, or t
  misc_feature (863)..(863): n is a, c, g, or t
  misc_feature (870)..(871): n is a, c, g, or t
  misc_feature (874)..(874): n is a, c, g, or t
  misc_feature (884)..(885): n is a, c, g, or t
  misc_feature (888)..(889): n is a, c, g, or t
  misc_feature (892)..(893): n is a, c, g, or t
  misc_feature (900)..(900): n is a, c, g, or t
  misc_feature (910)..(912): n is a, c, g, or t
  misc_feature (918)..(918): n is a, c, g, or t
  misc_feature (926)..(926): n is a, c, g, or t
  misc_feature (928)..(928): n is a, c, g, or t
  misc_feature (931)..(932): n is a, c, g, or t
  misc_feature (936)..(937): n is a, c, g, or t
  misc_feature (939)..(939): n is a, c, g, or t
  misc_feature (944)..(944): n is a, c, g, or t
  misc_feature (991)..(991): n is a, c, g, or t
gcgggatgcagtagtgatggctgaggtcgtatcttggaaggagccagagcccagtcagatcaaagcacatagtgatacaggctgatgcccaccccgtaatagaattaatgaagagaccccagtgtactttgtctcgagatacagcctgcatggacctgtagagcagaatgggtgagctgcttcctgaagctgtttatcaatgatgtctaattggctcacctgctacagggtctgattgagggtctcaggtggctgaagcccagaggtggtcgttcgaatgtgtgctgggcgttgtctgccagtctggctgaagactgcttatgaagctgcggacgttgctgatgatcaggaagaaccagctacttactgtgtatcttcgttcgaattctgaactcactagttcagaagctcctagagactacagacagatctgatggacaccagaacaaactgaggagttctgtatatgaatctctgatggaacacttgtgagaaacagctgccaaggaatgttaccctgctgtccagaaaaacgaccttggtcatcatggaacgactgcaacaggttcttcagatggagtcacatatccagagcacatccgatagaatccagttcaatgaccttcagtctntactctgtgcaactcttcagaatgttcttcggaaagtgcaacatcaagatgctttgagatctctgatgtggttatggcctccctgttaagggatgttccaaagcacagctgggtctgggggagtacaagaggatgccctgatggcagttagcacactggtggaagtgtgggtggtgaattcctcaagtacatggaggcctttaaacccttcctgggcattggattaaaaanttatgcnnganataccaggtnngtnntgnnagcgtgngggcattagnnnggaganctttgtgngntgnnctgnnantccancatcatacctttctgtgacgaggtgatgcagctgtttctggaaaatnggggaatgagaacgtccacaaggtctgtgaaggcgcagattctgtcagtgtcggtgatattgcctggtatgggaggagagtttaaaaaatacttagaggtgtatgaatactcttcagggaggctccccaagcccaggtgacaacgtcaagactatgacatggtggattatctggaatggaagtaaggaaagctgttggaggctatactggaatcgggtccaggattaaaggggggatcaggcgaacgtcaaccggatgtgatgctggtaaaccagggtagaaattatctgtttaatgacacattggtggagagaggttacacagatggggaaaagctgtgcttgggaaaaagggactttgtaagctggaagtgtctgaataaagagggcaagaccgaatgtaggggggcgcggaaaaataacttcttgcaaaagtgatgaa

SEQ ID NO: 480992 - DNA, 277 bp, Homo sapiens
aatgtttacgaccctcctcagctccaaagtgttaggtttataggcgtgagccatcgcgctggccatcctttgtttttaatagcatattccttatttgaggtgtacctgcttttttctcatgattagatcaggttgtacatccccagtggaatactgtttaagcatgttatgtccttctcaaggtatcatatccagagtgattgatagtaattttgagaatctagtcaaagccacactgtatagtgtattgtttttcctcttgtagctaatagccatt

SEQ ID NO: 480993 - DNA, 590 bp, Homo sapiens
ggtcccacgcgtatacagaccacaaatccatattgaatgtatacagccggtgcagtggttcacacctgtaatcccaacacttagcggagcggaaggcaggtcgatcagttgaggccaggagttcaagaccagcctggccaagcatggtgaacccatgtctctagctaaaaatacaaaaagtagccaggtctgtgggggggcgcctgtaatctcagctacgggggaagctgaggcaggagaatcgcttgaattggggaggtagaggtaccagtgggccaagatggtgccaccgcaccccagtatgggctacagagtgtgagccaccgcgcctgggccgccttatataagtattgaaaaaaatctgtctagattcatacatcctgagatgtgggttcatccattcagtacatttattttaaatattggtaatgtgtacggcatggtgctaagtgtcaattggcgattcataattgggtgaaagaaaccagacataatcctttgcttgggggagctacgtattgtttccatttagtagtatcaacttgcttggccgttcatcctttggggggggggatagaggtatctttccc

SEQ ID NO: 480994 - DNA, 1170 bp, Homo sapiens
  misc_feature (153)..(153): n is a, c, g, or t
atcatgaccctgtgtcacattcgggaactgcttcgctcttgcctagttcccctagcttcatcacctagcaagttgcagcggtctggtccgagtagcaacgaccttctgggaactggcgatccagcgctgcgcgtcagcctatcgcgtctttgntaccgaattctggcaagatggctgctgtcgttggccgacttgttcgtttcctcacactggagaaagggcaggtcatctcatgacattccattggggatgttcattcgatatgcgaccaagcgtgtgagttgtggacatagcactagattaaggtgctaaaacgcttgatgaattgtcccgagatagtgccggcacagggacgaggtaagcaatagactacataggtttggctgaccctctgggcctggcgacacaactgtctgtaggctgtatgtaatggtctcctgacatgaccagttgcccgcacttagtgtggcctccgaatgcacccaggtggcccaatatgcagatcttcgaacctggcaatggtacaatcccagattgtaggcaaattaggacgtcaccacacgaaatttaagttcgtcggatccaatttaaccagtcagcttccagcggatcttggcatcgatgcgtactggtgcactcgactataaggcaacaagcttgcttgaatcgttgtaaccaataatcttattccgagtcagagttagatcactcctggctttgaatggttccctccaagtgttcttaacaaggggcctattgttcatttggagaaccttttcgtgccaaccttcttgacttccgctttggggcacaagttgtgggcacgcgttcttacttggggccccgaagccagggtggttaaccgagggaggcttggcgttgggcccctttcaagtcaaccttttgtagcccccctgggtagttggttcggccggtatggttccaagtaggttggcaccttcctctaaggggccttaggggatggtcctccaaggaacgcatgtggacttgcttacccttttttttcacccattgagcctcccacacttcaccaagagggtttctcaaagggtagaaacgttaaaaaaccaaggagtaatatctcggcgaaaccagttatgcacacacacacagacagcgacagcacaccacaaaccacaaacaagacag

SEQ ID NO: 480995 - DNA, 1580 bp, Homo sapiens
  misc_feature (585)..(585): n is a, c, g, or t
  misc_feature (795)..(795): n is a, c, g, or t
  misc_feature (1256)..(1256): n is a, c, g, or t
ttggtgtggcgggtggccgagtcgtttcgtcatgaatgtctggtctgctcgcgatgataattctgcctgcctgcttgatgagtgttgtgttggcctgccctctacgatatttgttttccgctgctgatttttgtgtgtgtgctggcgcacgagcgagggcgggggggggatggcggtgatatgatattattgtgatggtgagtatacgtttgtctgtcccctacgcctgtgcgttggttggttagtctgcaggcgaggccttgtccaaccagaaaggtgtgggagtaagacacctttgtgccgaccccccttttttaagggggtgtgagtgctagtagtatactgcagccaaaattcgcccgcggggattttttttaaagaggtgtggtaaacccagcgttaattttttaggtagaacctcttcctggatgaatggggaggtcctccacaccacatatgggtgttgttgtggtcaccgcacagataaatataaccctacagggggcttctgttggtctatgaagaaaacatggaaccttggcgcccgccacagaggggtgttacccttattttattcaccgcggnggtcctccctcctaataagggggttaatcacgtggaaaagcgccctcatctacgtggtgatcgcgccgctgaaaaatttttccgggacacccgaatggggggaaccccccttgggcaacgatccgctcaacgagagaaatgtgtgtgaactccccccgtatattgagacgacactccccgggagtttgtcgccacatctctaattatggnaaactccctcgtgtgtgtaaacgcgagagtgcgagagatacacatgggggtggggctcacacagagacagcgagattggtcccacacacatgcaccgtatagggcacaccccgcgagaggtctgtgtcacagagcacacacagagatatgtgtggcgccacacaccgctgtacacatggtgcacatgatacagcgcccacatggcacggtttcttttctctcataaggttcccacgagagggcttatacgtctgtataagtgagacacacacttttctcgccctctcggagtagacacacatgttttgtcgtaaaactcggtgataacctctataccaccacatggagtaggcgtatatctccacgctatattctgcccgtggagatatactcctttctagatgttggccacctccgcgagagagatatagagagcgcatagcacacacccctatacccgncgatatagccctgctcacagagagaacttgtgcacaggcctctggcgcctaaaagtgtttttggaggggtgagcgcgacacctggcgaagaactcacacacaagagaggggagaagctgaacacagaagaatacctacacagaacggagagtgctgtagcacacacctgtgtggcccgacacacaagaaaagcacgagaggactggggctgggtcacgcacaccgaattcccaatttagaggcggatttggtcgtggacgtggtcagaccacctccagtaaaattggagaggattctttttgccaattgaataaacttaccagc

SEQ ID NO: 480996 - DNA, 685 bp, Homo sapiens
ggccatgtgcctcatgcggctccttgctcgccgcagcgctccgccgcgcgctcctccgcgcgcggactccggcagctttatcgccagagtcgctgaactctcgctgtcttttgaatcccctggatcggatcaccggcgtgccccaccatgtcagacgcagccgtaacaccagctccgagatcaccaccaaggacttacaggagatagaaggaagttgtggaagaggccgaatatggaagagacgccctctggataatggcgaatgctagtgagtgaatagatggggcgcaagatgctgacaatgaaggtaaagtaagcaggaggatgaagagtgcgagagtgacgaggtaggtagagaagaagaagtgtgatgtgtgaggccaggtatgctctatgagatcgacgacgcctcgagactagacttactcggtcaagagacggagtcgctgcaagcattcgatggccgaattcttgcacacgctacaggtagcacaggctaacgcctcagacaacgcgagaagcggacgttcacctatgtatctgacaagcatacgggaccacaggagaagcagcattacggcatgatcatacagagggcccggcagatgtcaccaatgtcgcgcgtcgccattttacgctagtcgcgtcaaccgtacctccccggtggtacgcctctcgggctacg

SEQ ID NO: 480997 - DNA, 931 bp, Homo sapiens
ggggacctgtactatgaggggaaggagttcgagacacgactgaaggagaagaagccaggagatctgtctgatgagctaaggatttccttggggatgccagtaggaccaaatgcccacaaggtccctcccccatggctgattgccgatgcagcgatatggaccacccccatcgtatcccaacctgaaaatccctgggcgtgaactcgcccatcccatggagagctgttcctttgggtaccatgctggtggctggggcaaactctccagtggatgagactgggaaaccgctctatggggacgtgtttggaaccaatgctgctgaatttcagacctaaggactgatggaagaagagattgatcggacccctgtggggggaactggaaccatctgatgaagaatcctcagaagaagaggaagaggagagaaagtgatggatagacttggaccagatgagacaggctttatggagctcctgaagagcaggggtcgttattgactcctggaggctggttcatccaaggtgtctgctggaatggatgagccctggaagtcatggagctgaggaagaagaagattgaggaggtgatggagggaagtgagatactcagtcttcactgtgttggcagagaagagagagcactgttggagggggcatgatgggatcaatccaatttatgacctgtcatggttatgagccggaagggcgggtctgagtgaggtgtggaaatgggctggcgctggagagttggagtgatctatggcatgaccagagtttaggagatgtgggggcagggtcactgagagggatccggatgggggagagggcagagcaaacgtattcgcggaggggggggaaataggaattgccccacaacctttggccatggttggtaaaaccccagagaggtgttaagtggattcgcaaaaaag

SEQ ID NO: 480998 - DNA, 123 bp, Homo sapiens
acaccaagtacttctagtctaagttccaaagaatatttaaaagtctttttaaatgttcacagtacatatggagaaaaaagggtggtatagccctagtggtatagggtggtaggtggtatagct

SEQ ID NO: 480999 - DNA, 401 bp, Homo sapiens
cagagcatcttaatctatttggttaaagaggctcccagttcagtattgtaaattgaactccttaatctgacctttgtgttttttgtataagatagtgctattcttggcttcctgtgaattataagacagttttgaaaatctcaggttttctgtttggattgtttgaattggtatttcttaacacatttcttactgataaatcaaaatattcctgggggagcaggaattaaaaatgagggcaaaaatctgcctctaagatttttttaatccctagatttgaattaatatgcttgccttttctcatccatttttccagtttaaatgtcaaatgtgttggaccatttgtgttcatgtgtgggacatttagttgttagcaagttttttttgagacagagtctcgc

SEQ ID NO: 481000 - DNA, 738 bp, Homo sapiens
attgcagtcttgtgtgccggtacggggaccacatccttaatttctgctcagactggtaaagcacaatctaattgtaatctaaaattcgcgaatgtgacagaccattaatagatgctggttaaaggaatcataaacaggtataaaccttcttaagaaaaaaatatatgccttatgttatgagtgaaaacagatcctaatgaatataatgtagacttaaatgctgatatgataaaatattagagatgctaactttctactatctttagtcagagacactgaaagtgactgcttaactacaactattcaatgtgcctataaagatcatgcgaagactggtgcgacgaaagataacctactcaatacacactttgccagaatttgaacattatcatgaaggaactgacagttatgaactgactggctcatccataggtggactacaattgtattaattaatgaggaataatgccaaagaagatggactactcacataactatcttctatgcaaactttttgtggaactacatgtaaagctattaaaattacctacttgcaaactcatgacataggacatgtgatcattctccggattgaacgtacttttgctgatgcatgacagttcttgatcagagatagcctaattgcaaggacttgaacctaagcatcaatctggaggcttgggagctgctaattctggctgggggaatgccggggcctttttttgatatccttccgca

SEQ ID NO: 481001 - DNA, 207 bp, Homo sapiens
tgctctgtaccctgaggaacgcacgggctcagccgcgactcgatgacgcagtgagatgttgagcagctctaagttggatttcttgctgcgtttcctccatgttggaggagtgtctggaattagaagtctgagaagccgaaggagggccggggagtcatgccggaattaattcttcttgtccctttgttgatatatggctgtctttct

SEQ ID NO: 481002 - DNA, 124 bp, Homo sapiens
tagagggctgatgctaactaattaggctgtggtgtggttgtagttgattcaaattatgctgatgagtacggggacagtggacgcctactagcgcgtgtagaactaggatgtatgctgcctgctg

SEQ ID NO: 481003 - DNA, 244 bp, Homo sapiens
ggacgcgatcccagttattatgaactaaatgttgaagacagtaagcagaatcatgtaaaatgtgatttttacttccacttataatacttgtgattggggaggtcgtgcgaaattcaattatgatgaaaaacctatctttttgtaatgttggcatacttggggaatttagtggcaaatacattccccagcaggccttttgttggttgcactaactgcaaggttgctgggaagtagagtccatttg

SEQ ID NO: 481004 - DNA, 440 bp, Homo sapiens
aagtgatctcccgggatgccatgctcttctgtgactgcttactcttgatcacctctgatggctgctccatgtgcaggcagacacccccaaatgtcctctgtatccctacattgtccgccctttgccaccctctgtaatcagggctggtcatttccaccttgtttggttcacaggctccacgtgcatatggtgcatgtggcctggcctataacaggtgcacagtgtacctgtgctgtctacagctaggtgcctatcgtcttccgtaacagtagcgattccggtcagtgttcggcacgtgcaagtaggtgcttagtgagtggtcatcagactgagctgactgcagccgcgtgcaggcctcccaggaactcgcgtatccctgacatctgccctccctgcagccatgaggacgcccccgctcagcccctcgcactgccccgcct

SEQ ID NO: 481005 - DNA, 645 bp, Homo sapiens
gttgtaattgatggaagaatttatgagaaacaaccacaggcacacaaaattttatcaaaatcaaaataaactattttgagttgaaaattcagttgaaaaatcataataatcctaactatactataatgaagtctgactattaagagtacaaagctatagccaaggtaccacatttgtttacagtttaattctaagaatacagtttaaaaaaaagatctaagagaaaatgttcttgagggagacacatgtcaaattaagtctatagcggtaaactaagtagtttattctgcctttcttcttatcctcgttttctttttctgtgggtgtctgaaagcattttgagtatatttactgtaaactgacacttgtagtctccttacatagtgatattggaagcaacaaaaactagatgggaatggctaaggagaaattttggtgaataaaagcagataatacagaaattataattatataaaatgtttgtggtcacatgaaaattttcataaccagttatgaaagtaatgttcagttgtcaataattgagaaataggcataagaagaaaataaagatcaactgtaattacatcatgcagtaaaaatcacttgaaattttaatgttttttattttttttttgggtaagtaaa

SEQ ID NO: 481006 - DNA, 160 bp, Homo sapiens
agaagcagactgaagaacatatctatctcggatgacacaaggaaacccctaaaaggggagtaaaatactcggatagccttattgtggaggatagacccttcgctatacctagattatcgagactgacataactatcggagtatgatgctggaattgaaaa

SEQ ID NO: 481007 - DNA, 376 bp, Homo sapiens
gagacagagtctcactgtgttgcagtgagctgagatcgcgccactgcaccccagcctggcgacagagtgagactccatctcagaaaaaaaaaaaaaaaaaagtccaattaaaggttgtggaaataattctgtgaaggtaatgatggcttagacaaatgggtcagcaaactacagccgatagggcaactctggtctactgccggcttttgaaccgactaaaaatggctttaacttttgttttatcttttaaaaaatacatgacgtttttacctttttaagcggatggaaaaaaaaaatcaaagaaacctatttcatgatatgtgaaaattaaattcaaattttggtgtccataaatagagttgtattgaacacgcca

SEQ ID NO: 481008 - DNA, 141 bp, Homo sapiens
gagtattcggcaggagaaggaaaaccccagactgccgtgcgaagagggcatatcgcacgtgtatgtacacacaggcacctacatgtgcacatgcacaagagatgcacacggctgcaccaacacacatacattcatgtgcac

SEQ ID NO: 481009 - DNA, 149 bp, Homo sapiens
gggaaataaaatttccccccccaacttaaataaattttttttttcagggcaggccccccaaagaaaaaagaaattaacttcccccgggggcggccggcaattttccctttgggttgggggcaaaaaaaagtcctttggaccctttccca

SEQ ID NO: 481010 - DNA, 675 bp, Homo sapiens
ggcgccctcggggctgaaggcggtggtggcgggaacaccaattctgagcggagttattcggagtgtccagcaaggatggggagtggtcatcgtcgcttatcagggatctagcccaaggcatgctgcattcttgtcttcctgtctgtccaaaatgtctaagtatatcctggcgtgcaggagcatcgaaccatgtgttgaatgactatcataacaaagcggtcgtgagaactccatatcccatggtactggcaggtccattgtgatttgctgatgccccgacggcatgatagctcggatctcagggcccttgatcgaatagacttccaggggtaccccggactttcaccatactagaagcaggcccattatcttcttctagcgcgatctacactgctcgccgtagccccgtgttctagttgcaggctaagagcctgctcgtcgttcttggccatagagtgttgggtagacacgacggttcgtagagggaagattcagccgtgttgggcttttccgtacgccgcattaccgcagggcccctatggttgttacctcgccctcgattcgcttccccctaccattgcttcttacaggcacgtctgagcttgccccccttatcgggcgcaagagtgagcggcatgccgggggggttccagatggtcgtgtgggccagccaga

SEQ ID NO: 481011 - DNA, 324 bp, Homo sapiens
  misc_feature (5)..(5): n is a, c, g, or t
ttttntaaaaaaaaaaaatttttaacccggggttcccttttgaaaaatccgggttttagtccttaaaccccctccttaagaataattgacccataaagtttgctttccaaagccgttttccaattataatctcctttccatttataacgttttccgtcccttgttataattttcccttttcatgtaagtttaattatctgcctttttcttttttcctagtttttttaaaactaatgtttttttttaaaattccgttaaatataggataaaataatgcttttaaaaaaatgtttaataaaaaatttaaataactttttttggcca

SEQ ID NO: 481012 - DNA, 1313 bp, Homo sapiens
  misc_feature (559)..(559): n is a, c, g, or t
  misc_feature (1037)..(1037): n is a, c, g, or t
taaagggttatcaaaaccaggtttaaaacataaatatatgcagttagtattggtcaactaaaaatacaaatttaaatttaaacaaagtcatcttacttgcatacaggaaggggggcatgtgccaacaagtgaatcggtcctccctttcgtgaaaattcaggtgtgtgagaattagaactccgtgttcctcggaagaataagcagaagcccagggctcgttcgtgcgtgagaagcacattcgtcttgtgcccctgtggctctcccacgcatgtggaaccaaaagggacctgtggcctgtggaagtgtgaggcctcttgggtgaattttaaatatagctttttccacgccaccagcaagggcaggtgccagcaagttccccgtgggccccttaattatagctctgtgacgtgaccaccgaggggccaaggcccaggcgttcttgtgggtccactctgtggtggtctcgcgagggaacccgtgtgtgtgtgcctcagcaagcggctttcttctccgtagaagggaccctgtgacctttgcgggatttggcaagattccccancttctgtgtgtgatttatgagaacccttttgtgccaccgtgtgggatctccctctgtgggggggccctcctgtgcgaaacaaggcaatttggctccggagaagccagaaaatttcccttccagctgttgacaaggcaagaagggagggcctcatcttcgccaggggctcctttgggtgacaaagagcctccgtgtccagggcccttcgtgtctgtgttctccacgggtgtgtggccggttaactgggagcccagtccaggaattcccggacggtcaatacacacagcgcgggcgccggaccatctctgcgccaggacaacgtgcctcgggatcgagaagcgccgcggaataatccacaagcgcgtgccgagaaagcccccctggagggccacagggcgcggacaccgcgacaaccacgctctgtttgttcccccaaaaatatccggcgagagaccctgttgttcccaacacgaggggngaaactccccgaaaactctgcgggcgacgacactgggtcctcccccaccaagagcgaataactcagtacccccgtcgcgggagactacaccccgcaccggggggaaaacaacaagctacaatcgcgaagcctcgatgacccggcttgttaaacagacggcgacagaacccccagggggcgccgccacaaaaaattgatgcacacaaccaactttgtggaggacgcggcacaaaagcagcatcagccaacccaacacatcagtatactgacgagcac

SEQ ID NO: 481013 - DNA, 149 bp, Homo sapiens
ggggaaacccaaaaaattttttttccccccgcggggttttttgggttggccggggttttttttattttttaaaaacttttggtttccccaatttcccccccgggggggaaaggttttgtttttttttttaaaaagggggggggggccca

SEQ ID NO: 481014 - DNA, 759 bp, Homo sapiens
gaggcaggcagatcacttgaggccaggagttggagaccagcctggccaacatggtgaaaccccatccctactaaaaatacaaaaattagccaggtgtggtggcacactcctgctcgggaggctgaggcaggagaatcgcttgaacctaggaggcagaggttgcagtgagccggagatcgtgccgttgcactccagcctgggcaacaagagtgaaactccatctcaaaaaaaaaaatgcacagctgggtgtggtgtctcacacctctaatcctggcactttgggaggctgaggttggcagatagtttgaacccaggagttcaagaccagcctggacaacgtgataaaaccctgtctctacaaaaaatacaaaaatgggccctttatggtggcgtgcaccagtagtcccagctactcgggaggctgaggtgggaggatcccttgagcccgggaggtagaggctgcagtgagccctgactgcactctgtcataggcagcaaagcaagaccctgtctcaaaaaagaaaaaaaagcactatgtgatacatgcaacaatggatgaatctgaggttaatgctgagtgaaagaagccagtttcaaatgggttgcatactgtatggctccatttatgtgacattcttgaaagacaaaaaattatagtgaatcgagaacagggggttgagtgggagggtgttgacttcagaggaggtagccaagaggctctaagagctaacaggatgggactgctcatatcctaattgg

SEQ ID NO: 481015 - DNA, 410 bp, Homo sapiens
  misc_feature (390)..(390): n is a, c, g, or t
tttccccccccgggggggggggcccaaaaaatttttttttgggggggaggggtttttttccccgcaaaaaaaataatatattggggggggggccccccccccccaaaataaaggaaccccccccccaaaatttaaaaaaaaaaaaaaaggggggcccccccccccccccccctttttttgggggggggtttttttgggcccctcccaaaaaaggggtttcccccccgggggggggggggggttttttttgaggggccccccgcgccaaaaaattttttttttttggtttggggcccccaaaccttggggtttttaaaacccaaaaaaatttcctggcaaaggggggaaggtttccccagggaggcaaaagttcaggccgttaaagcaggncgcctatttgcatgcagcag

SEQ ID NO: 481016 - DNA, 348 bp, Homo sapiens
tcctagttactttctgtgcagtaactagtaaaagactttgaattagaggactccagaccagtcgtctcctgtcttcagctgagttttgatttgaagaaagtaaattagaatttattgcttacaatataaaatgagtagttttatatgaagttcattttcaagaagaaaaaaataggtgatctggcaaatttggttcatgtgctagtagaattgataacacttgtacatgttttacctaccttagccatttctcttacctagctagccactacagatgattggtttgcaacttcggtcaacaagtgaattattgaggtgtttggaaaaagagatcctatagagaaggaa

SEQ ID NO: 481017 - DNA, 305 bp, Homo sapiens
  misc_feature (143)..(143): n is a, c, g, or t
cttagtgaagcccctcgaaaacggcccaggcgctgggggcgacgaataggggtgaaattttccaccgcaaccactgacctccagttaccctacttggcgccgtcgtaagccttcccgaggaacacaacaaaaaaccctattcngccatctcacattatgtcttaaacacggccggcctggcccacaatgaggaaggatatttgaactaatccaccgaagacgacgcaatattgactaactataaaattcgactgaccgcagagtccttccgacccttagcccagcggctagtcgggctttacccc

SEQ ID NO: 481018 - DNA, 206 bp, Homo sapiens
  misc_feature (44)..(44): n is a, c, g, or t
ccttacagagttagaatcaaggaataaaaaacaaatattatganctgctggctgggcacagtggctcacgcctgtaatcccagcactttgggaggttgaggcaggcagatcacttaaggtcaggagttcgagaccagcctggccgccatggagaaacccagtctctaccaaaaattcaaaaattagccgggcgtggtggcaggcgc

SEQ ID NO: 481019 - DNA, 519 bp, Homo sapiens
gcggtacctcccatatagacatcattctagaacaggtaactaatctatggtgacagaaagtagatcactggtgtaaaaaaaaaaaaaaacgcagatcatgggttctctaggcacaagggctagggggtaagacagggccggattcacaaaagagccggaacaaccttccagagatgatgaatatgtccactatcttatttataagctcccaaacctaggggtgacagttggccagtaatacacttttgtcaaaatgggccataataatatactgcaagatggtgcagttaatgggtatggtaaataatcctccaaggttatttaacaaaattatccttaaaggctacaagctcggcaactcggatcatggatttaagggccaatttatgattcacaccacaaatctctataaccctggcaaacatctgggctagggattttaaaaaaatatataccttaaccgggtggatccctgggtgggccagaccgatgtcaaataagggaggggaccctcaagag

SEQ ID NO: 481020 - DNA, 160 bp, Homo sapiens
gccctggttatcctcctgtctgtgacattcccacctcggtactaaaaatgtcgccaccttcattggcaacagcacggcatccaggagctgttcaagcgcatctccgagcagttcacggccatgttccgcgcgcaagcgccttcctgcaagtggtacacgg

SEQ ID NO: 481021 - DNA, 939 bp, Homo sapiens
gcgctcgaaccaccacaaaggagccagtcgcagccgtgccccccggacctccaaccggggactgccggggagcggctcgaagcccgaggccgcacgggagacgcggaggtgcgccgggccgagcgggcggataggccacgctcacttccgaagtgccccaggctcggccagtgccacctcctgcgggggaggcctggcgtgcagggaggcgggtcagcggcctggcgggaggataggcgtccgcagcgtgcgtcccgaagtggggctcgcggccgggcggggaacccgacagtcggccatctgctgccccgcgggacgggccccggtcggctcgcggcctttggggaggttctgccttggggacacaggggacagggcgcaggcggcaccgagctccgaaggcttcaaccttctcttcgcagcttcggccctgagagcggctcggcaattcttggtaggagctttcattcaaaacgtggggcgccggctcggaccggggattaggctcatgtttggccccgaaggcccctggccctgcggccctgcgcgggcatttgggggccggcgctttgtggggcgcacggaaccctgaagcggcggtcctgacgtccgtgggggtccgaccccccggctgggggggcctagtggtccttggcgcccctgaagttagggccggtcccaaagcgcgatgtactggggcggggcgagcgcggcgtccccgggatctgcggaggtgtcgggccccttactttcgcaggccgttggggctcctccggagccgtggcagctttgccgtgaggagtttattcggggctcgcctggaccccggccgggactaggcctgggctgctgtggaggcgctcgagccggggagtttccccacgcctaacgcgagagcgggggagccgtggagcctctttgtgtgtccctttagaggct

SEQ ID NO: 481022 - DNA, 1067 bp, Homo sapiens
ggggctgtgtgggcaccggtgcggaagctgccttggaagaggtgggggcgtgcgacgggagtgggctggcgagcccccgggagcctgtggcgttaggcccgggctgtggcggtggccccgtgctggctggggggtctcctgtggcacccgcccaccaaccatggagccctgccgacccggaggtcgagtctcagatgactgaatctgggcaccgagacgcccctggtgtacctcgcagtggactgactgccggaggggcgagctaaaccggctccgacgcctcatcacgccgggaatccagacgccatacctggtggctgccttggacggagggtctgagagcggacgcggtcattggctcaaccatccggggaatttgaccaagacaagacactctacgagtggaccctgaaggagctcttcatgctaaatgcctcgaaccctggccgttgcgccaaagggagcgtcgtattcgaggcgaggggttctaacaaagggcggcaattcggcattacaacacaacaccaaacaggaagagttgcgtgggcccaattcgagagaattcattcaggaagccattggcagtgaaggcccagaaagtgcattagaaagactccaggagggtaacgaatttacaatgagaaggggaaggaaattaagagattaggttacccataccaagatgaggtatgaagaaaaagagaagcggaattaaacaaattaataggaagttaagactattataggagtgatcgaataaagcattaaggaaggaaggaaaccagaaatgattaatgggagatcaaatcaaatctgtgaaatacttaaccccatgtgggggcacaggacgggggccattaaaggacacgcttggcaactcttgctcttatagagcccgggggatacacccctttgctacgggcagaacgaagtccgcattgggccccagaggaaatctcctgagcggggcaaagaaccttccagcaactggggccacctggggagattaaaccgtggcaccacatcgcgagaaacgcaagaataaatcaaaccctgaaggaagaatc

SEQ ID NO: 481023 - DNA, 137 bp, Homo sapiens
tgtactggtgcagcaagtgcaatttatacagaaacgagtagcgaagctgaggcaggccctcagccgcattaccagtgatgtaagacagaacgggccttgaagagaatgccgcgtgcatttctcctgacttgagggca

SEQ ID NO: 481024 - DNA, 177 bp, Homo sapiens
ggagcaagaggtggagacagatgtttcacatcgattaaactaatttaattctctccctttaattttatagacactttaaaaaaatttgcacacgttttttcactagttcatatctaaatctaacttttcataaaactttacggtttttccttcactacttaatatgcagaatactgc

SEQ ID NO: 481025 - DNA, 203 bp, Homo sapiens
ggcacgaggtggttctggcacggtgggcacgggggtccgagcaggaagaggcaggccgaccctagcagacacaggcccctcacgcttctgtcccgagcctcctccaggcccctggtactccagctgcagcccctttgatgtctaggggactcggcagggctgctcctgcctcgcagggccggaagcctcgatgccggcactga

SEQ ID NO: 481026 - DNA, 934 bp, Homo sapiens
taaggagtgataaaaactttgtaaacccccaaaaaaagggccaaggggtggtgttgacaggccaaggtgggggtgtggttggggcatgatgcgaggggacaattgggcaggatgaaccagttgctatcaggcaggagtaggaaaaagaagataagcaggcgaagatgtagtgagggggctgccctgtgttaagggggtggtgaactcccctccagaccgcattgcctttgcgtggtgccctcggtcgtggtggttataaacacctcgggtgtccacctactcggaaaagctgtggcctgccgtgaagtcaggcgattcagaagaaacaaccgagaagggcggggggccctcctttttagtagagctggaatcctccattataggtgcgcaaaatattggagaacgttatgtgtgctcaggagaatgtttggggtggtgactccatgtctcccaccaggactggatgtgaaaaaaaaggagattgtaacgaaggagcaactccttcgggaggggaagagacgcagaattgacgaacctcctccaagatcgagcaaccagctatgggtgtgaaggaagtgatcgagccccgaacgaaatataaaggtccgagggagggcggtggccatcaaagggggccctcgggctcgggaacctgggcggcgacaagtcaaacttgtcggtcgagaaaacctcccatcgagagaggcaaacagagtatgccttaagtacacaaagaacacaccacaaggagggggtcccaaaagaacacgggacagcataaaaagatgagacagtagaccacccagccggtaagaagcacggaaaagagggggaaggaccagaggagaccactattagaatatgtaggcccaccccccaagatgaaccatagggaggcatcgggacacccaagaagaataggaggcggcacacg

SEQ ID NO: 481027 - DNA, 137 bp, Homo sapiens
atcacaggttggcctcgtacaccagggcccagtggtccacgatgttgaaggggatttccgggtcgtagcaggtgcgcagctgctgccagaccagtttctcgacgtcctcgtcgctggcgttctcgggaaggctcagc

SEQ ID NO: 481028 - DNA, 767 bp, Homo sapiens
  misc_feature (301)..(301): n is a, c, g, or t
agcttttggggcccataaccccattggggttttcccattggggcctccattatatgaaaaagttccaagattttccaggggcggaaacccattgccctctggtggaattctttacattcataaaattggctacaaggtacagcctcggaactgggtccggtttgcatgcccggcacaaattaagtagcccagctcatccagggaggccgggcttatcaaacacgagatgactaaacgggcatttgcataacaatggaaaaggaagaacaggtcttgaagggccagcattgccagctgctgntgagtcacagatttcattataaatagcctccctaaggaaaatacactgaatgctatttttactaaccattctatttttatagaaatagctgagagtttctaaaccaactctctgctgccttacaagtattaaatattttacttctctccataaagagtagctcaaaatatgcaattaatttaatactctctgatgatggtctcatctgcagcaatacgtatatcatctattagaacttactcaatgcaaaactgacgagaacaaaattcgtaaccaccagcacttaagtactcctgattctcaacatcgtctctaatgacccccagccacccaacagctggcccacctactcaaaatcttgtccccactgtctacaaaatcgttacctgtcgtcttcccctgcacgtgtatatactcagctgctgtacactaatggcactacatgcatttacaatatttgttcaac

SEQ ID NO: 481029 - DNA, 1333 bp, Homo sapiens
ggctatctttaacaacgtgccttaggggaaccctgtaccctcctaacaagtgtatctcgattaataacctgccagtcccagcatcacacatcatcatcgaagtcttccccagattataaagaggtcacactagtcgtgctgggctcgaggattctgtgcactccaggaccagggcgcaccaccctctcagcacccagactgtgacgcgggctgtgtggccacgagagaagctaggacacagcggcaagtgggacctagctagcagcgccattaatactatgaacggacctagatgctacctagagcgaggtacaactaagactataagacacatagtagactagcgaacacagacaagaccacatagagggtaccactactagcaagccagaccccaatgcgccatgcctcccacatgctcccaacaactgactgaacaacctaatcaataacatacagaatgggacacgcgcaccacagacatcggacgccccaaaatctaacgcacggaacatgactgagacctcgataaacacatgcactgacaactgcgagaaacaatcaccacataggacaatcaacctataccaccaaggagacaccacccagttacaagagcactcacacacacaggaacaaacatggaccaaacaacgcatgatacagccaaggctatcaatcaaccatgccgcacagcggcaaaacagggcgccccatgccacaagaccccactcgcctactaacacacacaattagccaaatggctaaagaagcggaacccgaggagaacgtaggtaatacccacataggcaacaatgagaaagcacatcgaacctggggccacaaactggcccaacaatccccacatataacagagccacaaagaaacaacagcaacaggacacccaggaggcaccccccaagagggaactaggacaccacggcatcgcgggacacaccggagccacctggacccacacaatgagaacataggagaaccccaccgagagcagcaccacggaaccgacacacacgccgacccagcggacaaagcgccagcaccacgaggccccggcgaaaccaagcgcgcctaacagacaacgactgaagacgaaggagaataagccaacagacacaacaagacgccacacaacccacaaacgagcacccagatacacaagcaccaacaaaaaagccaacaaacaaccacccaccacgacaagacaacagcgaaccaccacaaccacaacaagacacacctacaaacacccaagcaaaccaggaacgccacaacacgcacacacaccagcacagaccacacacaactacaact

SEQ ID NO: 481030 - DNA, 284 bp, Homo sapiens
gtctctacataaaatgttctaaaaattaggtcgggtgctgtggctcatgcctgtagtcccagcactctgggaagcccaagtgggaggatcacttgagccccggagttcaagaccagccaggacaacatggcaagacctcgtctctgctaaaaataaaaatttggctgggcacagtgggtcatgcctgtagtcccagcactttgggaggccgaggtgggaggatcacttgagctcagggttcgagaccagtctgaacctcatctctcttctgaaaaaaattgttt

SEQ ID NO: 481031 - DNA, 190 bp, Homo sapiens
ggcggtccctcgcgcctgtagccggtcgtcgcggcctcgggggtctgctgttcgaccttcctccgaccccggacggttcgccgtcgggtctggtgcccccctctgtgtgtcgcagttccgggcagcagtggtcctcatgtgttcctcaggccgcttgtagtggtgcagggggggctctctcgcgtcgcac

SEQ ID NO: 481032 - DNA, 151 bp, Homo sapiens
tgtctcaaggtctcctgcctcagcctcctgagtattgggactacaggtgtgcactacctggccggctgatttttaaatttttctgtagagacaggatctctctttgttgctcaggctggtttcaaacacctggctccaggagatattcccg

SEQ ID NO: 481033 - DNA, 254 bp, Homo sapiens
aggtggcatacggaagcataagcagtgaatggaaagtcgaaggtaaatctgtaatatctttctgttaggggcagcaggaagaaaaaaccttcaggatttgctgctggtggaatagacagaatgaattatgacagctacttggctcagactggtaaatcccccgcaggagtgaatcttttatcattagcatatgatctagaagcaaaagcaaacagtttgcccccaggaaatttgaggaactccctgaaaagaga

SEQ ID NO: 481034 - DNA, 481 bp, Homo sapiens
tctcggtaccaaagagtgttatctaagacgtagtgacccagaagcctagcctggggacctaggtcccacctacacacccagcgtcccacccatggtagagcaccccagttccttgttccttcctgctccttgtgtcctggtcttctcagtccaaaaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaa

SEQ ID NO: 481035 - DNA, 357 bp, Homo sapiens
gaatccccagatgcccaccgaagttactgtgctcgcctaatggcagctcgagtaaaatctgcaactatctcgtcctgactctccaggctgcaaatcccagcatccaggcgtgacttgtaaaaaccctacggatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggaggtgtctctctgtccaccagccaagtacagaaagaactccagagcatcaatcagaaatgggttgagctgactg

SEQ ID NO: 481036 - DNA, 915 bp, Homo sapiens
taaagggaagccagtcattgaccatttaaaaagtctcctggctaagtatggaaatcatggacagtaagagaaagccaaaaagcaatgcagagaaaggtgtccaagctgtcttcagccttccccagctaaagagcaggaggagggcctgggctacttgggttccccatcggcctccagcactgctccctcctcccactgcgactctgggatctccaggtgctgccaaggagtttgccttgattacagagaggggggagcctcccaaatttcgggcaactttgggaaggtccctttccgtgttttggaaagccatggggcccaaggaacccgggcaactggcggctcgggagaggcccgggtggggcctgggcctccccccggttcggaacctccaaggtggccttttttcggtttttcagaaggaagaaactagggaagtaaggggcgagagtttggcctggaaagctctgctgctggcttctcctgccaggaagtgaacaaatggcgggggtgtgggagacaaagggccaggagagcccgcgttcagtatgggttgagggtcacagacctccctcccatctgggtgcctgagttttgactccaatcagtgataccagaccacattgacagggaggatcaaattcctgacttacatttgcactgggcttcttgtttaggctgaatcctaaaataacattagtcaaaaaattccaacaagtagccaggactgcagagaccactccagtgcagacgggagaaggacttggtgattttcaaacgcagggtgggttttccaacccaaggcctctgagaaaccatttctttggtatcctctgcgcttcccaagtcctcttgggcgggggcaagcccaactgtgcgggtgttccgaagttcctcttgaccccgggggggtct

SEQ ID NO: 481037 - DNA, 390 bp, Homo sapiens
aattggaaataaattttaaaattcctttaaaccaaaaaaggaattaggccactgggaaacctttcaaactttcaattttttatatggtaataaataaggttaaatatatttaccgttttaagttttagtcacgggggtaattaattcatagattttttttcactctgtcgcccaggctggaatgcagtgatgcaatcatagctcagtgcagcctcgattttctgggctcaagtgatccttcgtccacagtctttggcatggctaagactacaggtgtgcaccaccacacccagcctatttatttttattttttatttttagtagagacaaggtctctctgtgttgccaaggctggtctcaagctccttagctcgcgggcgggcgcggttc

SEQ ID NO: 481038 - DNA, 754 bp, Homo sapiens
  misc_feature (420)..(420): n is a, c, g, or t
agcggagggatttacccgagcgtgtgcggcagcggctgggcttggcaaggcgcgatccaagagggatatataggcagcccagagctccagagaaaaagagagacgacgagagaaccgacagacgagagacggcttaagcgtttacacgaattaaagtatatatcttttaatgaagaactgttgagatattatcatgttgtcgcttagaggtgaccgtgcgcagggctgctaacgtgcgagggatggcggaagcaagaagtagctaaactgggccccgtgaaacgtagatgtgagcgactctggatgaaagatgcacatgaagtttagatgcagcattgaagctctaagcgagttggtacagaaggatttctcagagggacatgtaccacatggctgaggacgagcttataactcttcagnagcgacactattcgaagcaacgtcgttctactcgtggaaagtctccttatcgcgtgtactggagatcgtcctgccaagttatgcccagtcatgaccttccgaaggcttcgacaagaatggggacggcaccattgacttccgagagttcatctgagctctgtaccatcaccgtccaggggcgagcttctgatgcacgaagctgtaactggagccttcaatatgtatgacctggatggtgatgtgcatgatgacccgagtggagatgctggagatcatcgaggatatctacaaaatggtaggaactgtgatcatgatgaacatgaatgaggatggc

SEQ ID NO: 481039 - DNA, 234 bp, Homo sapiens
ccgggatatcgccactgcactccagcctgggtgacagagcgagactccatctcaaaaaaaaaaaaaaaggattttttggcgggaaaaatagagggggggttggagggacccagcattgaaagggccagaaaaagaaagagctgaaaagggaaaaggcccaagagttaaaacagtgggatacaggaaaaaaaacaggggttcaattacagacccagcccagggttaaaggccctc

SEQ ID NO: 481040 - DNA, 1270 bp, Homo sapiens
cacccccgctgggggggccccccacacagcagatgactcgctcctttttgttgggcctgatgaaggatgcctctgccttcttcctctcacgtgttggttcacatgcgcgctggcgctgatgtgtgtcgcgcacgcgctgctgtgctgcgccagccgggggatatttcttctcgatggcgcgccccccctctcttctgggcggtgagcatagtggatgagcgggtcccccctccgctttttccccacacgctcagcggccctcctctttgtgtgtgggtcgtcggcccccccccgcttcgctgcgtgttgtttttcgaactctcatggtgtgccccctccgaaggagagatttgcccacgagacgagtgtctgaagagaatcccccccgcggctgtgtgagagaagatgtgcgccgcgcgacgctgtggtgagagatatcgcccgcgcgcgcgcgtttcttcactagagagaggtttttttttgccccccgcgcgccccgcgagatcttcccgcgcgcgagatttttctccgcacaaggcgcctcgcgtatgacacacgctctctctcccgcgcgcttacccacacgttggtggacatcttttctcctccgcgcgagagacactccgcgctgtccggcgcgtgagactctcttctcgctcgtgataccgccgcggtcgctccccccgcgcgcgtctcgcctcacacatctcctctcatcagagagcgcccccaccccccctccgggtgtgtcccacaaaacgcacccgtgtgtctctggagagacacacacagagtgtttcaccacacacacccgcggggcgcgggctctctctctcgagaggggcgccacctctcgcgcgcgcgcgcccgcgcgcccctctctccccgccctcttctctctccgcgcttcgcgctctccaccctctcgcgcaggctcttttcatccccacccccccccgcggggtataaccccccgcgcctctcgcgcgggcctattccccgcgaccccctctctttttggccccacccccccggttcccccccccccccccccccccggcgcggggccccttccctcctctctccccccccccccggcccccccccgcccccccccccctcgggcccctcctccgcgctttccccctcggggcccccccccccccctccccccccccccccccccgcccccccccgacccctgggtttgggcctccccccccccccccggttcctccccccctttgtaaattaaattttttccccctta

SEQ ID NO: 481041 - DNA, 1589 bp, Homo sapiens
ggatccctccttctcccggcgccatcaagcggaagaacattcctcacgaatattgtatccaaggcccaacagtttgttacaccaagatgatgaatgctgacatggatgcagttgatgctgaaaatcaagtggaactggaggacaaaacaagacttatgaatcaagtgttggcacactccaaccacacacttgcaagcatctcgtctgcacaagcagtcaggatgccagtctcaaggcacagcacacacatctgcacagctcacaccatccagcacaagacccaagtacttaggaaccaatcatatcagcaacatcatcatgttcacgccttactagatgctctattctcacacaccaacatgcaacacaaaacagcaaaacagacaaagtcaagggcattgcaccacccattcgtgttataatggacatgcgcatgctgaatccatcaagaaatcttctataaaaaaacatgtggggattacgaacatacacacacaacagctataacgatgatcagccctcttggatgggaacttaccagttggcaaactcattatagacttgcacaccgcacttcaccttgcttcacagaaatggttaagcaacaacaaaacactaaacacaccaaatacacacgtgacgacattgcccacactacacggctttccgcatcggctaacttcaactcgggtttcaaggtccctcaattgaacaacaacacgattggcaccacaactggtacttaggataacaacccaacctttcacatggactctctcggaacattggccatcattcattctccactaggaagcaaccttaaacagaagaacagcacctcggtcatgaccgttcggcacacataaggcacagagataaaaacgagacacaagggaacatttctaagacagtaaacttaaggaacattacagaacaaaggaaatagttaacaaagcacacaacaccagcaccagccagaagcaaaggcaggaaaaacgcgaggaaccacacaaagtaccgaggaacacacaagacaggcccgacaggacgagaacaaagaaacagccacggaagcaagcacaagaaaagacataggagtgcaacacgacacacacagacacgaaggaagcctccacacacaatacacacaatatctacacgcaaatcgccgcgccacagggacaaacacacacacatgggacggacccacgatggacaacaaaggccaacaacaaacagaaccaaaaaacaaccgacgcggacagacgaaaccggcaatagaatgagaggaagaacagtagacagaaacagcaagaacagctactcctgagactcggcccatggctgatagtgaggtacacaaaatccaggaaagcggtgacatcacataccctgcgcacacatagaacatcacaacaacatcaatacacacagaacctcgcgagcacagggcgcacacaaccaagatgcgcacgagcagcaacgaaagacacgagctggcaggagaatagaacacagcgaacacactgacgccaccacactagaacatgcagcagacaaatgacgaaccgaagcgtctcaccgcgcag

SEQ ID NO: 481042 - DNA, 159 bp, Homo sapiens
gctatactgggtgtacgtcatccagcgtatggtaaatgcatccggttgaatgcagtggattccatccagacatgattgaatgcagttgattccatggagcgtggccattgcatcccgattaaatgcagtggattttatgcagcatggcccaaagcatcc

SEQ ID NO: 481043 - DNA, 353 bp, Homo sapiens
ccggtgtatcctttgtctctactaaaatacaaaaattagcctggcatggttgcatgggcctgtaatcccagctactcgggaggctgagacacgagaatcgcttgaacctgggaggcggaggttgcagtgagcggagatcacgccattgcacactccagcctgggcgacaagagcaggactccatctaaaaaaaaaaaaagaaccaagcttgtccaaaagtactagctaataagttgtttgaacagaatttttaaagcttggcctctttctattataccacgtttgtgattctctcactcacattatagtgtcaaaggacaacagggaaaccacccgggaattccctctagagt

SEQ ID NO: 481044 - DNA, 305 bp, Homo sapiens
cggccggaattccgggaatatcgctgaaaagcaaattattctttcgaagatttcatttaaatctctgtactatgccattttgtttcagtttgtaaatgtgtcacatttaatagttcaaataggacaaagcacggccctatgactatgttttcaaaaaattaatatataaataaattcataggggtttttcatttacttttcgaaaagaaatttctttaacaggattgcacctatcaacttttcttgtacgaataaaaaagaatctttcatcaaactgataataatcgagatgacaaagaaatgag

SEQ ID NO: 481045 - DNA, 112 bp, Homo sapiens
cctttcttaatcgattctttatatcgagcaaacttgactcttcgaacaggatctcgataagtctcgttggaatgtcttttgctggttcttcctgaggctccaacactgggac

SEQ ID NO: 481046 - DNA, 271 bp, Homo sapiens
ggtcaaagctgatgagcatgtcatttgaccaaagggagattgatgggagacaacctttttattgtcatagaaccgggggaacttatgacattttaagtaacactagataatcaaacccgctctgttgggcaatatgacaaccgttggcagtttttggagactagctctgatgtacaacaccccgaggagctgctaccattgttgctacctcaagagggctccctttgggactggaccgggtgacttttagaggatcatagtaaaatatgca

SEQ ID NO: 481047 - DNA, 225 bp, Homo sapiens
atatgatctgtaggaaggggaagagaatcttgctggagggatgtctttgagagaggtaaagaggaacagactcacgtggttcagcggtcagtcctcagggcactagtggacaattcatccatactagaatgctgagcctgttgggtacaggatgccagcaggtaggtgaatgagccttccttctggtctgactcgcgagacggtcggcgtcccgaaactgagaca

SEQ ID NO: 481048 - DNA, 284 bp, Homo sapiens
acagtacaaaaaagtgatggttttaaacaagtgggaaaaagtgggaatgaaaacaggtacttgtgggatactgaatggatcctatcaaacaatacagggtcacgagcgcgcacacacacacagcacacacacacacacacacagcgcgcgctctgaggctgacacacagcacacacacacacagcgcgctctgaggcagacacacacatacacatacacacacacacacacacagcgtcgctctctctgagggcggccatattgctatctgctctctatttgag

SEQ ID NO: 481049 - DNA, 384 bp, Homo sapiens
  misc_feature (35)..(35): n is a, c, g, or t
  misc_feature (44)..(44): n is a, c, g, or t
  misc_feature (47)..(47): n is a, c, g, or t
  misc_feature (50)..(51): n is a, c, g, or t
  misc_feature (60)..(60): n is a, c, g, or t
  misc_feature (118)..(118): n is a, c, g, or t
  misc_feature (147)..(147): n is a, c, g, or t
  misc_feature (170)..(170): n is a, c, g, or t
  misc_feature (255)..(255): n is a, c, g, or t
ggcggtgggcagcgacgaccggatggttcatgctngaccccttnatnggnnacagccatntgcttgaagtccgccagaagtcgtcgggcagcgcctgatcctgcaggtgggaagcccnttgctgtcccaccagtcgccggcctcaangtagtgctggcgcatgtagccgnccagctcatgcagatccttgggcatgacttcgtccggatcgggcgccggcaaaggcatgcgcaccttccacaggtggccgccctngatcagtgcgaagcactgccccttgggcaggccgacgacgtgtgcgggttcgatcagcggaacgctggtgctgctgacgcggtcttgtgtgttcgacgtgaatgcggtggttcccgtcgggtccgagct

SEQ ID NO: 481050 - DNA, 736 bp, Homo sapiens
agctggtacggtctggaatttaaggatgcgagcccgcgggttgcgcgcgtgctgacattgatggcgtgctcctttcgtgagcgcagccgaacctctgacccggactccgttacccctgcccggcgtcgccccggaggacggctggaggcagaaacagacagaagcgttaacagcagcagctggcggcggctgctccgggcgtcgtctccgcgggagcttggaagtgcgccctggacgcacagagtcctgatcagcatctcccatgctgcagatccacagggtccgcgaacccagcgcggcggcatcacgctgcacaagaacctccttgatgtcctaagttggcttcggaatggcgcggcacagcctttaccttgagcgagcgctatcgccggagctcatacccgtgcgcctagagaagcagacaagtcaatacagtcagcctagccgtcccctctattcaatccgaggcatcctagtcacccttagacgtacctgcataggctgccgtgggcctatgccgtgccatgttcagcggggcgctgaactttacagggctgcctgtattcctacgctttgggacgtgggtgatattgttgcaacagcggaaaatgacgaccgccaagatcgggcccagcacaaggtgccaaacaagagttgcatcacacgtcaccacacagatgcttcctaacctagatttgacatctttgaaagaagtcatgctgcatccagtagccaa

SEQ ID NO: 481051 - DNA, 430 bp, Homo sapiens
agcggggaacaatcacttagggttgttttttggttttggaaacaagttctttggcccctcacagcagcttggacctcccaggctaaggtgatcctcctacctcagcctccagaagaaatgagttggtcggggctggcgtaaaaattttatgcattaatatcttggacatttaaatggcgtaatatggggatatggatatgtgcaattaaataagagcacggttatgaaggtgaaagtctaaatttcagataaaaatatcggcggggagcaggctttaaaaaacaatactaggtatgaactttgggtggggctttttaaacatattatccctttaaaggaaactacccaattagagggaataattaaggagagtagtcagaattcaaatactttcacaactctaccctttatcacaagattttgggttccc

SEQ ID NO: 481052 - DNA, 170 bp, Homo sapiens
ccgaggattccctggctgtacatagttcgatcagaacaggctttggtcgatggacctgcacttcacagtaggagacaggccatcgctttcaagtgcatgcagctcactgatttcatcctctagtttccgcacagtgcccaccagaagtatgtccgacaagcctggcagaa

SEQ ID NO: 481053 - DNA, 750 bp, Homo sapiens
  misc_feature (269)..(269): n is a, c, g, or t
  misc_feature (409)..(409): n is a, c, g, or t
  misc_feature (626)..(626): n is a, c, g, or t
  misc_feature (641)..(641): n is a, c, g, or t
  misc_feature (654)..(654): n is a, c, g, or t
  misc_feature (702)..(702): n is a, c, g, or t
  misc_feature (707)..(707): n is a, c, g, or t
tcccacagctttctttaacatctcttgtggctcctcgcgtgggtctctcctatcaccaccgtagtgtgtaggtctccagggtgtgttctccaccgctcttacggctcatttacccacccgtgtggtgtgttacgaagttgggactctgtgtctgctctattatacgccgcgagtatatccctgttctgatgagcctccgcgagcctctccgctatttatagacgatgtgaggcgccttagcattgagaggttgctaaacagcgccctcnagaacattgtcatgttgtgagacaaaacactcttcgcgattgctatttaacatgggttctcatctcccgtttgccaggagccccttcctttatccaccaatttatgtatgtcgcagggcgcgccatatcgcctactagangctctttcctctgttgtaatacgcgtctgcgcgcaccgctcatagagggttctcgcgcatttagagtctcttcgagtctagaggcgcgcccgagttttcgaccgacgtccttagaaagtagtacaacactacatagtccgcgcttccctccaacaatatctcgtggcaccccccgagtgtgttcctctattgtgtcttcaacgtgccggcagtgccntggcgcagatgggtnttctccgaaggtnttctcctattttgcgcagcgtagtcgcgcagcgctgcatcacatcatngatcncgccctcgggtgaggagttgatagcgcaagagtcagacatgtc

SEQ ID NO: 481054 - DNA, 404 bp, Homo sapiens
aatccaggacctatcaagtttcatatcttcattgaaatggtgacaaatggtgtatcagtgtgaaaaccagaaaggctaattgtttgtatacctcacagggcagtgtgtgatcatccaggagggacatgtgaaggaggttaagatttaaatgttggaaacaccaacattctaattattcttgagtttcaacaccagtcattcaagtaacagttgtaaggaattttcttttggaattttccttttcctttaggttctcccctttctttcaggatggtggggagcaagaatccctaggaatattgtaaaaatatttcaccaagaactgctaattagcagaggtcttttcttgtatcccttttgataattcccacaaatgaacttaagattcagaagcaaaaaaaaaa

SEQ ID NO: 481055 - DNA, 427 bp, Homo sapiens
cggggggaggtataaaggcagatttaaagtgccgaggcacatactttctgaaagccaacattgctgaaggttgtcagtgggagtccttttacaaataggtgggaaactagagactcaggagagaacttgggagttttgttgctgttcttcctctgtggcgcactcagccagcaaaaactggcaccaagcggagggcactcaaaatgcctttcaaaaggatcccttgcttcctttctccctcctccctggcaaaattatctttaaaaaaagacgaatgttattattgattaacagattgattgatttaatgtattaaaacattagtttgggacacacatttcagggagaatcttatcttgtgaggagcgaagcttttgaaatggtaaaatattcatttcctggacctgatctttagaaaaacaaagga

SEQ ID NO: 481056 - DNA, 109 bp, Homo sapiens
tacacgggcatatgggagtgcgagcctgtggcctcatccgcggggaccacaaagagtttcaccgtggatgtcagagtgggtatggttgtcagctgcagcggccagccta

SEQ ID NO: 481057 - DNA, 867 bp, Homo sapiens
gggtaacagagtgagactgtctcaaaaaaaaaaaaaaaagtagtaagtgggacatgctaaatggttaacagctcaattccccgggggtttaaccataagctatagtcctttggattattccactcataactgaaccctttaaaaaaacgggtggtttcattatacaatttattgtaacacattttaacggggtaaagctacacttaatttacatatgtaagggtatttaaagatcccaaattgattaacattggcaatcctaatgagtgggttttggagacaagtggctcccgcgaagtatgccccaaaatggtctggtacacaccccagagaattaagcaatctggtcaaaatgacgtatctggggcatcggaagtacatgggaagtgtgtttatcacccttacactgttggcctgcgcccaaggttcactaagctcaaccccagaaattctcattagcaccgtgctttcccaggtcttcaggaccgagtgtcgtgggtgacccacgggtgctatccccagtgttatttccacagtgactggaactccattgacacactcgttctccttaacgggattcagctttacacagatcttttcacatctgtggcccccgaaaatcttattcacaaccgtcaatccctggttgggctaaggggtcgatcactccatctacttacacttcgccattgggccctgatttggctacaggcactgggactgctggttcaactaacatttccttgtcgcccattggccttcctgctggacctgtaaaccccgggtttgacggggcggttccatcaatgtggattcctccaccatttgtggcacactctgcgcttgcccattcggacagtctaggtg

SEQ ID NO: 481058 - DNA, 310 bp, Homo sapiens
tccgttctatatagaacccagaattcatcattttacttttattagacactccacatcttaacttcagatttgttttttttttttgaaatggagtctcactgtcgcccaggctgaagtgaagtgttgctatctcgggtcactgccacctccacctcctgggttcaagcaattctcctgcctcagcctcccaagtagctggaactacaggcacccaccgccacgccgtggctgattttggtatttttagtagagacaggccttcaccatattggccaggctgatctttttttttttttttttttttttttat

SEQ ID NO: 481059 - DNA, 143 bp, Homo sapiens
tcagccacggcggcggcggcggtagcgtcggcagcggtggcgacgactccgccgcatcctcggcgcccgacacccgggccggcccggcggcggcggcggcggcgcgtctccacgagtccgtcttgctgctgctgctgcggccg

SEQ ID NO: 481060 - DNA, 501 bp, Homo sapiens
  misc_feature (56)..(56): n is a, c, g, or t
  misc_feature (321)..(321): n is a, c, g, or t
  misc_feature (480)..(480): n is a, c, g, or t
gtaaaactgtgtcttggccgggcgcagtggctcatgcctataatcccagcactttnggaggccgaggcaggcggatcacaaggtcaggagttcaagaccagtctggccaatatggtgaaacctgtctctactaaaaatacaaaaattagctgggtgtggtggtgggcgcctgtggtcccagctactcgggaggctgaggcgggagtatgacttggacctgggaggcggaggttgcagtgagctggagtgcagtgacggatcatagctcactgctgccttgagctcctgagctgaaggaatcctcccgcctcagcctgcgangtagctgggactgcaggcatgtgccactgcatccagctaattgttaagattttttgtagcgatgaggtctcactatgttgcccagactggtcttgatctcctggcctcaagcaagtcttcccgctttgatctctgaaagtgctgggaattacagatgtnagccaccatgcccagctaaat

SEQ ID NO: 481061 - DNA, 125 bp, Homo sapiens
taaacggaagataaacatggctactggtctagaggtaaaaggacatctttggaagagaaagtagaggaagaggggaaggtagccagggttccagatatgggggacggtggggggcgatgatggga

SEQ ID NO: 481062 - DNA, 120 bp, Homo sapiens
gagcttatcacgcgcactgattgcatcaacgctgcacatacattcaccaacatcccccagctgcaccccctctccctagactgcagcagccttcccctcgcaggccccaaaagacctccc

SEQ ID NO: 481063 - DNA, 670 bp, Homo sapiens
ggagagagagaactaagtctcgagctattgtatatttctctttgggtaaaaacttttaataaaaaaaaaattttttaaaaagtaccagtgctctgaggctcagggtgtaggatcgggggcacacctggtcccgggaggccccttgtgcacggttggtgcgcccagggccaaaggttgctcgctctgtgggggacgcccggccggggaacaggcggcctgtgtcacggcccggggctcccggggggcctccggcggcagggacaatggcaaggccgctaaccatcttgaggaagaccatcccggccaggacggtgtacccagcaccaggaagaggacctttgagcaaacggtcactcttctcctcaagctccttggccaggatctccaggaaggtgatgaagaggaaggtgccgcccgccagtgcccctgaacgtcagcacggacgccacgtgtgcccggtagcgccctgggcgctctatatttgcccaggcccaaggcctgatgcccagggggaatcatggggcttacggtgaccgcagaggtttggccgcgtcccgcaggggtcatgtcacactccgggccatgcttgatcgcccagggcccacggccaccagtgtcttcgtggacggccacccccaaataaagggttcaccactttctcccattcgtc

SEQ ID NO: 481064 - DNA, 361 bp, Homo sapiens
tataccttcccaaatcatataaaattggcacatccctatctcccttcgctggctctcttttcggactcagcctgactgcacccaggtgaaataaacatgccatgttgctcacacaaagcctgatatggcggtctcttcacacggacgcgcatgaaataaataaagaaaatgacagaaaaacaggacaggcacagagggtcacgcactgtaatcccagacactagggtttacgagacagatggatcacttgaggtcaggagtctgagaccggacatggaccagcatggtgaacacccgtctctactacaaatataaaactaagctgggcgtgatggcatgtgccataaacccagataaaagg

SEQ ID NO: 481065 - DNA, 714 bp, Homo sapiens
atgtcggtggttagtcagctggggatttgtgtagggactgctgataggaagatgtcttcagagaaatgctacaattgggtccgccctgtcccccaacttcaaagccacagctgttatgccagatggtcagttgaaatgatatcagcctgtctgactacaaaggaaaatatgtgtgttctatctttctaccctacttgactgtcacctttgtgtgctcccagcggtagaatcatggcttgtcagtggatagggcgagaagtaatgtacagaacatctacaagcgtgccaagtgatgggtgtcatgtctagtgggacttctacaccttctcgtcatactagacatggagtcatagtactacctaagtaaactacacggaggaggtgggacccatgaacattccttcggtgatcagacccgaagcgcaccatggctcaggagtatatggggtcttaccaggctgatgaaggcatctcgttcagggcctcttaatcattgatgatgaggcgtattcttcggcagatcactgtagatgacgctccctgtgggacgtctgtggatgggacttagagactagttcaggccttccagttcacggacaaacatgtggaagtgtgccagtgctggaagctggcagtgatacgtcaagctgatgtcaaaagagcgggaatattctcaagtcgaagtggcggctgggtgtaagtgcaggtgcggtg

SEQ ID NO: 481066 - DNA, 150 bp, Homo sapiens
aagaaccgagcgccaagcaaaatggacccacctcctggaatgaccttaaatgagaagagtgtccaaaatccaattacccagtggatggtggacatggaaggtccaccaggtcccatatatgaaggggaaaaatttcaacttctatttaaa

SEQ ID NO: 481067 - DNA, 188 bp, Homo sapiens
  misc_feature (101)..(101): n is a, c, g, or t
gtgggcatgttcactttcagatgccaaagatgtcatatatacccccacaagtgtggtacagcagcagcaaattttgggaccgatctgctatgtaacgttgncgccaagggttcattttatactggagtcacagaaatgctgagatgtaccaccttctggaacaatggaatgtcgggacgttcacggca

SEQ ID NO: 481068 - DNA, 358 bp, Homo sapiens
aattggttggtcttcaagtatatgtatgtcatagagcaaatacacttactgtcttcctcctgcactgtcactatcattcattccccgtaaaatgcaccttgcttgctcggcttttgcagtactggaagttgaactaaggaccacgcataccaggcaaatgctctaccattgagctataatccctacctcaacagtgtcttttaattggacattaagctgtggatggataaacaaatgcactatttatccacacaacatagtagattcagccactaaaactctcacataacaggcaaacacacctaccaacaaagcaatgccacaacagtttaacaggggtagaaaggcgggtcgacac

SEQ ID NO: 481069 - DNA, 136 bp, Homo sapiens
  misc_feature (100)..(100): n is a, c, g, or t
cgactctaaggatccccacattgcggacactcaagcagtgcttcgagctataagtaatgtaacatttctggcagataattggtgagcttgtctaaagganctgggatcgatagaaaggaatgtcaggtaaaataag

SEQ ID NO: 481070 - DNA, 147 bp, Homo sapiens
tggcagactagcatttgagtttcataaatgccactagcggaccaatgtagcgcacccattatgatgacatcatggtcgctgtagttcagacttacggttacaaacaccttacaaagatagcagcaccattgagagcccagagaggcg

SEQ ID NO: 481071 - DNA, 170 bp, Homo sapiens
aaggagcttacctgttatcccacccaacaggacattttaccccagcctgggacaagagcaaactccatctaaaagtaaaaataaaaaatgccatttaatagccagagagtgtaaactggtgagctcttgcttgcgggagataaggagggagcagggcattcgcagtggac

SEQ ID NO: 481072 - DNA, 134 bp, Homo sapiens
  misc_feature (15)..(15): n is a, c, g, or t
  misc_feature (22)..(22): n is a, c, g, or t
  misc_feature (60)..(60): n is a, c, g, or t
cctgactcctcaggntacttcntgtctcttcactgcactactccccccattttatgccanggtagcatcaagtatctctcccgtgtggcacttcacatggcaagatttggtatttacttatgtattttttgtag

SEQ ID NO: 481073 - DNA, 987 bp, Homo sapiens
  misc_feature (197)..(197): n is a, c, g, or t
  misc_feature (364)..(364): n is a, c, g, or t
tcgagtctttgttttgtttgttaaccctttccttatgagccatgccgggtgtggggtcgacagggagggtaataaggactggggggtggattggtagatatggggctggttaatggtcagttcagggtttctaatctgagcgcaggcttatgcaggagtgagaagtggttttaagtggttagcattagtacctaacnattagtttcgttcatagataggggtgaatagagtgggtccaattgggggtggtggaggagatcagtatactagttgtgggggagtttatgtaggtaggtggggtgttgagcggtgaacgtctttcttaactgggggggcgtgcgtgttaagggccctagcatagtgngggtggtcaagagtgttgtatataacctcgtctcgtagcgagaggggtattgtatagcgcatagtgtggtccaagagagtcgggtgttccctcgttggggagcataacagtcttgaaaactttctacagagggggactgttaggaggggcttcgtggggggccaagagtgttagaagcgttgcaccctaaggaatgccatatcggggaacgaaccaagctatacaccaggggctcggaagagtgtctaggtgcggccctcgacactataaaagactctcccccagcgaattgatagcgcgaagataaaacgggggggttgcgccattgcaagacatgggtcaccttaagggtgcagcccgccgtacttgggtagacagggggtcccaaagcgtggaggggccccccctatggaagaaggacacttgactacaggaaaaatcccatagattggcacaaggggcgaagcggggacaagcccgttggccaaaaacaagcgcagcgagaaaacgaacacaacgtgcacccttggaggacaaaacccatggggccagggacaaaacaaacagccaaaaccaagtggggaacggcaagggaacaagagccgcacataaacgcaaccaca

SEQ ID NO: 481074 - DNA, 224 bp, Homo sapiens
ctgatctagaggatctggtgagaagctggagcaaagaaggactttctgaatacatggtggagtttctggaagaagaaggcggagaggctggagactatttctcttgggaaatggatgaggaagggaaccggatgggattacccctttctggatggacaactatcgtgcccccgttgggaagggactgccttatcttcagttcttcgacctagccactggaggtg

SEQ ID NO: 481075 - DNA, 323 bp, Homo sapiens
  misc_feature (4)..(4): n is a, c, g, or t
ccantgttgggcacactggtctcaaactcccaacctcaggtgattcacccgcctggcctcccaaagagctgggaccacaggcgtgagccaccgtgcccggccatgcttatgtttttaacaatacacttctgaactatcaaaaagaatataaatcaaaatcacatgatcatctcaatagacgcagaaaaagcatttgacaaaatccagcatccctttgaaagtaaaactctcagcttggccgggcacatggtggctcatgcctgtaatcccagcactttgggaggctaagtcaggcagatcacctgaggtcaggagttcaagac

SEQ ID NO: 481076 - DNA, 855 bp, Homo sapiens
  misc_feature (756)..(756): n is a, c, g, or t
agcaggctgtcggccggaattttttggatggctccctcgtgagctgtgcctgtgccatgctgccgccgggatgccgtgggccgtgggccggcggtgggcgtgggccgcgctgctcctggctgtcgcagcggtgctgacccaggtcgtctggctctggctgggtacgcagagcttcgtcttccatgcgcgaagatgataggcgcagttggcgcggcagtacgcttgggcgtgtgaccacttagctgtgccttctctcgtctgatctgtggagctgcggcggctgcacccaggccacgtgctgcccgacgaggagctgcgtgggtgtcgtgaatgcgggtggctggatgggcgccatgtgccttctgcacgcctcgctgtccgagtatgtgcttgctcttcggcaccgccttgggctcccgcggccactcgggtcgctactgtgctgaagatctcggataccatcatctctggcaccttccaccatgtggagagagggcaccatcaaaagtgaggtcttctacccaggcgacgacggtacgtaccacgtggcctggtgaggcaaccagctgtggagtgggggccaaacacaatggactcgtggagtacgggcggggcgtcagtcccatccaccctggctttcgctgctgggcctgatcattgtcttcagcgacccaggacttccgtcaccctcttctatactcttcgctccgtatgctcggggcctccggcttgagcgtcacatcgtacctctttggncaggacccttgacagccaggcctgaaggaagactgcggatgacaggagcgggagggccgccatatcattgctggagccctgttaccgaccgggcttcac

SEQ ID NO: 481077 - DNA, 1325 bp, Homo sapiens
  misc_feature (214)..(214): n is a, c, g, or t
  misc_feature (252)..(252): n is a, c, g, or t
  misc_feature (258)..(258): n is a, c, g, or t
  misc_feature (683)..(683): n is a, c, g, or t
  misc_feature (826)..(826): n is a, c, g, or t
gcggaggcgcaccgtggagctgctctgggcgcggccggtgtgtggggcttggtcgagtggcactccaactagccaacgagacatcctgcttgcgatgctgtggcgtaccattagcaagggtcctcactgctggacaccctggatggtgggctgacgcccggatgacagcactggagtgggatgctgggcaacagcggtactgttgcatgcactnctgacaatgtggcttacaacgtactcggacggtgcagnccatgntgtgcatgcagacacatcggtgtgcatacgggactgcaacgtaatgggctgagcgtgttgtatatgaaggccccgtgatctggccacgcatgtgtctgacacgtgacgggccaacctgcacaagaagatgctgcacgacgttgacacccgggggtgggatggttaacccggggggagaaacccagttgagatgccgggttctcttcaaagggaacagggtgggtcgtcgcatgtggtggatagcagcgacaggactaggaatttgctccatcgtgggcgatcccagcgaagggagcgcctcttgcgcatttggacctcccatgaattactgatagggaagaggaagagatatggatagtggggggccggtcctcgtgagagcacgtcccctggtattaacactccccatattcgataggtgcacntggacgtggaacgagtctcgcacacctaattgggcgatctataaacaaagtggggcgattgtgggcacaacagggggagctgaagtgtggtaacaacacccaattcccggaggttgagcctataaccgacaagaaaaattccnaaagaaccagacgcgtaaggtaacgcacaaacgggacacctctttaaagcaacgatttggagaaaggcgcgtataaaccactttttccagagattatgggcgacacaggtttgtcccactagaaggtaccacctctccagacagttctcaccacctagggcacaccgcgaacaacatattggggcaccccttaacgaggggcggcgagataccagagttgggcacacaccaaatatggacccaagcccgcaggaggcccatggggacgaacctggtttgagcatcagaaaggacaaccatttgcacaagggaacgctggctttgtgtttataccccccgcgaagtgtttttccgattaatccaaaaatagcggcctagtgggactttggaaacctttcagtttccaaaaaggggggggccgccgtatggaaagttccctgtacaggacgaccgcaaatttcattctcgagattgtgaagctcacgggtattgacgccca

SEQ ID NO: 481078 - DNA, 300 bp, Homo sapiens
cggccgccacaagtttctcgcattgttctctgccacaatctgtgcagtttgaatttaagttgtcggtcatgaaggaaaagccatagtttttccaagtacctgacagagtatactttcatctagaacgtccccttagaggatcgagcttcgaggagcaccggggcctgacgagaacaaagattgtgaggttgtgatgatgatcggcttgtcctcgagcctggtattgactacctgtgttactaccacatgcagcagaatatcctgggactgctcacattcttggcacaaattctattatgc

SEQ ID NO: 481079 - DNA, 201 bp, Homo sapiens
aggatccaagtgagtcgtgctggtgctgctgcggatgctgttgctgcgtctgctgctgctaaagttccagcaaaaaagatcaccgccgcgagataagaggctccagcccagaaggttcctgcccagaaagccacaggccagagaagcagcgcattgctctaaatagctcacgtaagggtcaaagaagctccagcaccagaa

SEQ ID NO: 481080 - DNA, 354 bp, Homo sapiens
  misc_feature (348)..(348): n is a, c, g, or t
gcctgcaggcgagggcacagcagctgcgcagggaggagcggactggggagcagaggctggaaggagatccgcaaaaagggggaggagtttcccctggaccgtggcacacgttaagaaaaagagggtttaaagaagggcatatgggtaatttcccacccccccgagaggggacggggggggttctcagggggggttggggggcagcagacacacaagcccttgggggaaatatgacgagaaacagatcaagcactgtggtgagtggctcttgtggtttatgggcaaacaaggtcgaggcaccccttttccctccggcccctccaaccacttccccaatatctccaacanggcatt

SEQ ID NO: 481081 - DNA, 349 bp, Homo sapiens
tgagatcatgccactgcactccagcctgggtgacaagagcaagactccatctaaaaaacaaacaaagaaaaaaattatccaggcttggtggtgcatgcctgtaataccagctactcaggaggctgaggcacgagaatcacttgaacctgggaggcagaagttacagtgagccgagatcatgccactgcactccagcctgggacacagagtaagactctgtctcaaaaaagacccaaaaaaaactggggagaaccaggggtctgcttcatagggtctttctagtatgtagatacaagcccttgcactcgcactcgtactcttctagcagctgacagggtaagctccagac

SEQ ID NO: 481082 - DNA, 447 bp, Homo sapiens
gatcgtatcagctcatggtgtattcttgagtatcactaagttatctgcgagaccaggacactacagtaatgaagaggccgcaggtggagggctgaccagctgctacatccgccctaggtagcttgcttcatctgtaaagatgggtggggcaggatttcccaccgtcatggggtcctggcaagtcctgcagtatcccacgagtggcaccagcgctgcttctgggtgcagacgcagtttgtgccccctagaggtaccactgtatcctctttccctagctatcaggatattgcgtctcttcctccggttgtttgccgttttcacgctcatacgaagtaatatgctgttccccatatttgggcgtctctcatggagctcaaggaatgtacttggctcgagtagaacatgtccattgctggcaaaaatggcaacaactatggattccatggt

SEQ ID NO: 481083 - DNA, 443 bp, Homo sapiens
ccagcataagctgtgaatatgtattatcagatatatacattgctatacctataatccatacagatatgcctgttctaaataacatacatattaacaatatctatcaagaaaaccctcaagacagcttctagttaaaacctttgttgctgcactctcagactatatttataaaaatctgctaaggccaaatccatacttgcagaataattcatcacattttatttttaactgaaaagtaacctttgacgcatttcagcagcatacattgacaatctatggtatatatgtatggatgtatattattgtatgtgtatatatgtatgtgacgaggacaggactgaatgttcacacactcatgttgcgtactcaactaaattgaagaatggttctgacgtcggatgcttgctggaagatctactgactgtagtcatcaccagcacttg

SEQ ID NO: 481084 - DNA, 868 bp, Homo sapiens
ggtgtgtcaagaccaacaggatttactaaggttgcctcacccactgggggcccccatgggccttttcttttggtgtctcaccgtgcccccagcggtgtgtcacgtgtccaacggccgcgaaatggttgtaccaatgagtcagacaccttgtgagaatgtgcgagatgattagctgggacgcgcgatcagcccgccatttgaccagggatccataggattgcaaggggactcggtgttcggcagacacggctcctgcgaaattcttcattcgatgctggatgttgatgattggccatagcagctgttaggcttactccataagcgtgatatccccgcaactagtgaataggaacgctgcccctatggtataagggtcaccaagccttgcaccctgtccccagtcagaagaggatctggctgctctgtttgaagcttaaatgaagactgtattaattgtcattttaactgaaagaattaccgctggccattgtagtgctgagagcaagagctgatctagctagggctttgtgcttttcatctttgcgcataacttacctgttaccagtataggtgggatatacaattgatctgtgcagggaattcccgaaagctcagagtccagttcgttccagaaaacaggctggacaaatgaccactatgtcagaccccgaggctcgacttcaggggtgcagtgttccgtgtcccaaaccccatcacagaatagctctgcctctgtttcatgtagcaaatgagcaaacactacagtatctatcaaaagtgtaaatgtatatttcatatgcctagtaattcacttcatgtgctaaaaagtttatctgatagaaacactataaaccgtagagtacagaag

SEQ ID NO: 481085 - DNA, 1275 bp, Homo sapiens
  misc_feature (985)..(985): n is a, c, g, or t
ttgtatagtatgatgatattgtttttagtgggaaggaagatgatggtgtgtataaagtaattgctgtgtgttttgtaaataaaaaagatgttgttggttgtacaaaaaatggttgttgttttctaagaatattgtgttgttgttttttttgtactaatttagatggaaaacatattgttggggggatttatttattacgaataatatatgtggtgggggacaaagagggggttactctctattttgggatgggtctctcatttgcccgattttgtttaatagctccctttgtttagtccgttgggcatatcacactgagtccacagatgtgtggggctgcacaggaagagccacacacagatgtgtctccctataaggttttttggtggggaggattttttactgtttttggtgtcatcacaaaacacaatagtttgtgggccatgtatagagagaggttgtggcgcgaccactactaggtccgcctcatcgataagtgtctcctaaacacactgtggggcgacccatttataatgtaggtgtgggtaaacacacttgttatatgtctttggcgcgaaaacacggggccgcaccactaccacacacccctttctataacccagggagccatcctcagttcgcaaagatagatattggccattttgtttgtctactcaaaaagtatctccaaaatttatggtgtgtctgagtctctgttgtggggaattctgtggacacaatttggtccgcccacattctttccgctcaagagaacacttataggatggtcacaatgtcgcgctgttgtgttgagaaaagtgagattttttttggaatgtgtgtgcgcattgcgccatcccacacaccgggccacaaaatatcccactctggggaaatgtggcagcatctctctctgtccaacgagcacacacgggcaccacgtggacaccaacacacgtctctcgcctggaaaatataaaatctntgtgagtcacactacacacacaccacggtctggaaccactttttgagacatatataggtggaaacactgtggcacatatgttcacacacacaacacacaacgttggcgcaaacaactacgttctcacactctcacactttagaattctgggggggtcaaaaaagaccaacacacacaacagggagagtaatttccaccacagacacacacacacacccagattgtctccacacacaccggacacactttgtttggaatttaaagtttgtgaaagataaatgtggttttta

SEQ ID NO: 481086 - DNA, 795 bp, Homo sapiens
  misc_feature (485)..(485): n is a, c, g, or t
  misc_feature (605)..(605): n is a, c, g, or t
cgggtggggtggttcaggcctgtaattacagcgcctcgtttttcaaaatcctaagcagtacagccgtgtgctcactttgatccacagtagaatagcccatcctacacgacgccgtttaatccattctctgtaactcaaaaagatgactgacagggagaccaacttgccgacgtaattaaaaatggttattggggggagtgacccgcttaatagtcccgaacgccgcttcgtggagcgacgcaagacttttatcttagttggagccagtttatgaccagaatacccactaacaccatgcaaaggaacctgttcttcatatgaaacataactacagtagatacgtctatatcgtaaggtgccgcgacttgaaacaggtctttcataaaagtaccagtgtatggcaattcgaacaaaaacaactttgatccttgcaaatgaaaggggagtcctgcttaactcccctacatatgacccattgccgagancacgcaaaatgctctcatcctacaaattgcaatactgcctcctaaaaatacacggtttattgacacgcaagcctttccaaaagagccccctcatcttctaccggtgactctctccacccngggcatttctaaaacaaccgttcctaggttatttttaataggtagtggatccccaaccactacccatcacgacaagtgaaacacgttcctaacccaaagctatgattctaaaagtgacttactttgcttttctcaacactgtcacaagcctatttattctaggtggagcttcacggcttggggcctgaat

SEQ ID NO: 481087 - DNA, 677 bp, Homo sapiens
  misc_feature (43)..(43): n is a, c, g, or t
  misc_feature (72)..(72): n is a, c, g, or t
  misc_feature (97)..(97): n is a, c, g, or t
  misc_feature (146)..(146): n is a, c, g, or t
  misc_feature (168)..(168): n is a, c, g, or t
  misc_feature (177)..(177): n is a, c, g, or t
  misc_feature (181)..(181): n is a, c, g, or t
  misc_feature (184)..(184): n is a, c, g, or t
  misc_feature (289)..(289): n is a, c, g, or t
  misc_feature (293)..(294): n is a, c, g, or t
  misc_feature (302)..(302): n is a, c, g, or t
  misc_feature (367)..(367): n is a, c, g, or t
  misc_feature (409)..(409): n is a, c, g, or t
  misc_feature (426)..(426): n is a, c, g, or t
  misc_feature (428)..(428): n is a, c, g, or t
  misc_feature (431)..(431): n is a, c, g, or t
  misc_feature (437)..(437): n is a, c, g, or t
  misc_feature (442)..(442): n is a, c, g, or t
  misc_feature (643)..(643): n is a, c, g, or t
atcagctagatgtgctcactgtttgctccgttttttttttgcnagggccgggtgactgggagtgcagttgtnaggcattttaataaactggacagcnatttgtttctgcacgacaaggcatctttacacaggagcgatcgggaganaacaggaaacagccaagcactntgcactgcnacangcnaccttaacagctaaccagcattactcaactgctacacaactgcgcctagtgcacaaaaatacataagagaagagattagaattgtgtttgttaaacattcctttnaaannatcaagtnttttcacctgagaagtctttatacaaatttgggttcagattaccatttaggtctgaaggttattnagatatttgggtttgaccatcttttgttggtttttgattttntggtttgtgggcgttgngngtnattctnttgtnagctttaggctgtgtgtaatggctgcacacgttttccttaaaagtcaggaggccacaaattaggttaccaatctgtttaatttcaaacaaaaaaagtcagcactatataacaaaatgaaattttacctcaaatatccaaatccaataatgaaatctgaagtcgttcacctcactaaattacaagaaatttgaattacagcnacaaaatggcacataacatgcagtttgccaactg

SEQ ID NO: 481088 - DNA, 131 bp, Homo sapiens
aggacccccgcagtctgctcccatcagtcttctcccatcaaccagcgtcatgttgacacgtcgtgggactgctgtttttgataaccaacaagaggtcaatgtataaaatcccctgatgggacgcaggatgg

SEQ ID NO: 481089 - DNA, 335 bp, Homo sapiens
  misc_feature (281)..(281): n is a, c, g, or t
  misc_feature (289)..(289): n is a, c, g, or t
  misc_feature (325)..(325): n is a, c, g, or t
gcacgaggctggtttaatttggcactgtgcagggaatgcttgtaacatatgcagattttgtaaactaaggtagttaaagtggaactgctatatttctctgttgtccctctaagagctgagcaggacatctgtagacacagagaggagcaccccattgccaccaattactagcggaagcagtaaggtatagggatagatcccacagaagagctttggatggttttctggaagttttgtttcagaaaatactctttcatttagctttcatgataggcagtttntcttgtgnggtgtgtgtgtgtgtgtgtgtgtgttttcttttagnagaaacttga

SEQ ID NO: 481090 - DNA, 469 bp, Homo sapiens
tggggcccataaattttccggttggtcagggaaatgtaaaaggggaatattaatactttccagttaagtcctgctaacgtgctcagagaattatttcaaaaaacaattaaaaagagtggactgggacgcagtttaccctgttgggtgaatctagaccacggtggatgtgccacatgtgaaaacaacaaacaaccaccaaaacaaaaacgggcggcccgcccgcctctaaagcaactcctcccgagaggggcgcaccacatgtcacgcacctaccccaaacctttcttgtgcgacaccaagcggcggccccccaataacgacggacgacgctgctctctataatacaacaccaacgacgcgagtcaggagcgccagcctcatcactaacaccacgccgtcgctgcacggcgtacgaaccaacgcggcgctaccccatcgatcgcgcaacctatcggagcgacaagaaaac

SEQ ID NO: 481091 - DNA, 575 bp, Homo sapiens
gtggacattttaagaaagtgtaggcttgtcgcaaaggagtatttagatgaaaataacccagaagaatcaattggtgatcttcaattcaatttgaatatctcagaaatagaaaataatatagtatcacttcttgaacgctcagacaggaaagttgtcatattaatggataagctagatgaggcgtatgaaccggataatataggaattggaatcattgcaggtctagcatatgcatctattgaattaaatcaaaaagcaaaatgcattcgtccaataatttttttaagggataatatatttaggtcgctatcaaaggaagatcctgattactcgagaaatatagagggtcaagtcataaggttgcattgggactgggcacaactcctaatgctgtcagctaaaagaatgaaagtagcatttaagctagatattgagaaagatcaacgagtttgggatagatgcacagcggatgatccttaaaagggagggaatggttttaagcgatgtttgcaatttaccctttaccggcccagggatttactatcattgttgaatgaagcttggcacgagggcgg

SEQ ID NO: 481092 - DNA, 1196 bp, Homo sapiens
  misc_feature (245)..(245): n is a, c, g, or t
cagttattgatgtcgatggatgatcattagaaaagagttgctgcgttcgcaaagatggtgtcgcgacgagatttgcatggcctctgcataaactgcacgagaagccaaggcagtcgctaggccattgggtgcagagatgctttgcgcgcctaagggaatgagctcctggtgctctacaggctcgcggtgccgcagcggtcccacgagtgcattccatggagagtatggagggcttggtcgatganactgctaggatcgtgacggatagacgtcggacgaggtgccggtcattcggacacgtgaagaacgaaagataggaaggaggttgggaacagcgtgatgaccgattgtgtagtagaaacggcaatccgatggatgcgctatgtgggtgcaatctagatggtgcgtacggtggggtaaagccctctcgaaaggcactccgtaaccgtgtccagagatctcggtcattatcgccttgtaggctaccaatctatggtggcactgacaatgcacaaggcaagtgcggtgatccttagtcaatgaaacttttggctagtcaaccgtcctataccgaagggaaatttgcgggtatgaaacacacaccgtatcatagcacatagaccaccttgggcagagaattcgatggaagattcggcgatatcaaatgcgatgggaatgagattgagacgagtagcttccaagtcgagggattagaattgaaaggctaccattcggcgaaggtttaaatttccggtgggctcgagtattgcttcgaacattgcctactgaaatgcttgcgcctaggcgcttcgccgtctgtgcgggcccaaataagaccgaaaaggggtgcgctaaggctgtggcatttaggaatgtaattcccgaagtgcttgaccccgggggaagggcactccttaggaagggctcgggggaacatactttgagtatctggggagccgggggtgaaggaacgtgcttatgaagctagggcatggtgtaacgttgtggatagggcacacgtggttgaaggggctaggggactggaaggaaattcattgtgataagattgttacgaaggaggtttgacccgatagggtgggacagatttgcgtagggataaaagagggttatgagaataggttatgggaacaaggcaagggaaaggataggcccaggattagaagagagcaattcgg

SEQ ID NO: 481093 - DNA, 485 bp, Homo sapiens
tgtcagcgatctggaatgtgtggtgtatgttctgtaatgaaggaatgacagtcgacagtgatgattcagatgccattattttaatggcttcattgctctggtaccatgatagaaggtaagattttttatattaacttactaacaaacaaagttatcaaatggtaactttggcacaactaatctactaataacaaccttaggatagtgaatgactaaaaggtcattagtctaacctactaacaaacaagtaagacagtaaatagcaagaagtaaaaaggaaaaattttactttctaacaagtaaacacatgaagattgaagataaaagaaaaaaaaaaaaacccctaatgtggcattaatttatgggaatttggccaaactttttcccatttttttattaaaggaagaaaaaacggtcatataacaccaacaaaatttccggggataccgaggttcaaattccgaaaatcagtggtcattggttgg

SEQ ID NO: 481094 - DNA, 1496 bp, Homo sapiens
ggggagagaacaaaacagaaactcttggaagcaggaaaggtgcatgactcaaagagggaaattcctgtgccataaaaggattgctggtgtataaaatgctctatatatgccaattaccaatttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccaacaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacacttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaa

SEQ ID NO: 481095 - DNA, 112 bp, Homo sapiens
gaaattgaaggatcatcatagagaaactgaactatccccaagaaaagatcattagacactgatacatggaggttctcaggtaaatatataagcctggatgccaccttgaatt

SEQ ID NO: 481096 - DNA, 478 bp, Homo sapiens
agaaggcacaagggtagggttctgtgcagcccgatgaggacgctgctgaccatcttgactgtgggatccctggctgctcgcgccgctgaggacccctcggatctgctccagcacgtgaaattccagtccagcaacttggaaaaaaatcttgacgtgggacagcgggccggagggcaaccccagacacggtctacagcatcgagtataagaggtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagcccttctgcagcacactaccctcaagccacctgatgtgacctgtatctccaaagtgagatcgattcagatgatggttcatcctacccccacgcccatccgtg

SEQ ID NO: 481097 - DNA, 1614 bp, Homo sapiens
ggggagagaacaaaacagaaactcttggaagcaggaaaggtgcatgactcaaagagggaaattcctgtgccataaaaggattgctggtgtataaaatgctctatatatgccaattaccaatttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccaacaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacacttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaaaaaa

SEQ ID NO: 481098 - DNA, 187 bp, Homo sapiens
actcactgtgtcccctcattcactctctgcgtgtcccctcactgccttctgatgtcccctcaccaccttctgatgtcccctccttcctctctggtgtcccctcaccgccttctgatgtcccctcaccaccttctgatgtctcctcattcctctctggtgtcccctcaccgccttctgatgtccccat

SEQ ID NO: 481099 - DNA, 1487 bp, Homo sapiens
gaattcggccaaagaggcctacttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccaacaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacacttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaaaaaa

SEQ ID NO: 481100 - DNA, 153 bp, Homo sapiens
cgaggtgcctctgaggatccagaaggactggagactgaaagtgctatgtacggtaaatggctttatgtactatgtgctgttaaagatgggtaggtttgttggtatcctagtgggtgaggggtgctttcagtctcagtccgttctggaccggcc

SEQ ID NO: 481101 - DNA, 128 bp, Homo sapiens
agtttcagcgtgtccacatcacagctccctccaggagctgcaagggcttcttaggagttcctggtctgaaccctctcccagtccgcatcttccaccctaaaactagagtgatcttccgaaaacttcac

SEQ ID NO: 481102 - DNA, 1779 bp, Homo sapiens
aagacatcaagacttaaacgaaggaaaggattcacaagaggagaggaaagtgcattttcatgctagaaaaaccatattatacaaatataaaaaatagggatctctcaggctcaccagatgagaggatgctgtgaaagaaggtaatcttcctcatgtgatgtcagagagtatagagccagaacaagtcacaatcctgaagacacgtctgaccccacacatctacaaagccagcagaaatcaggcagactaacttctacaataaggcagaaagtttgaaatttggaacacacggaaaggacttgcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccaacaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacacttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaaaaaa

SEQ ID NO: 481103 - DNA, 127 bp, Homo sapiens
accttttacacaggaaaccggtattaccttgtgaatgggaaaaaccctgggggcctttttaacacaaaaacccgtaacccctcgtatcggaaaaaccacatggacacttttaaacgaaaacaacgtt

SEQ ID NO: 481104 - DNA, 541 bp, Homo sapiens
  misc_feature (291)..(291): n is a, c, g, or t
  misc_feature (314)..(314): n is a, c, g, or t
  misc_feature (425)..(425): n is a, c, g, or t
  misc_feature (457)..(457): n is a, c, g, or t
  misc_feature (487)..(487): n is a, c, g, or t
  misc_feature (516)..(516): n is a, c, g, or t
ggggagagaacaaaacagaaactcttggaagcaggaaaggtgcatgactcaaagagggaaattcctgtgccataaaaggattgctggtgtataaaatgctctatatatgccaattaccaatttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggtatgcagtaattttnatttctcaacctataagttcctnttctaatgtttcaaatgtcttttcttccacttttatcctaaaagacatgataaagttttatttaatctcacagattagaagttactacagctttagcacagaaatggtggncatgtttaagatactagagatgattattgaanctagaaattatggacttcatggaatttttnggatttggctagaattatctggcaaaagncttttaggcaaccagttttaaatgt

SEQ ID NO: 481105 - DNA, 200 bp, Homo sapiens
  misc_feature (65)..(65): n is a, c, g, or t
  misc_feature (159)..(159): n is a, c, g, or t
aggtagggagagaaaagatctaaaagaaggaggaacaaagggcggacgcagtgactcatgcttgntatcccatgcactttgggagtgcaaggcgggcggatcacctgaggtcaggagttcaaaaccagcctgaccaacatggagaaaccctgtgtctanctaaaaatacaaatattagcctgggcgttggtgggtacact

SEQ ID NO: 481106 - DNA, 185 bp, Homo sapiens
aaaggccatataccactccaaatagtctagtggtttcactggtaggcattaatcatttcaaggcaaacaagattggaacagaacatatgggctttacgataccatcaattaatcaactatgatgtagcaataaatactttacttaatctctaccaatcaacatagggggtcccgagctcgaatcc

SEQ ID NO: 481107 - DNA, 337 bp, Homo sapiens
caggccaacgatatcacccagcattctgtgatgactctagcggtcgcctgacatagggaacagagctcacatcaacattcacggttaccagtgcctcagcaatgtccaggagtgtcattccatctgcccccaggattcagaagagagaaagctcatcccttgtcagcatgatctctggcacgtactcccaatgtgagagcaacttttgtaagtacactcagcactcctacaagttccctcctgacgaccttcccagcaacatattcattttcatcttccatgtctgccagcagtgctgggaccactcacacagagagtatctcctcacctccggccc

SEQ ID NO: 481108 - DNA, 265 bp, Homo sapiens
atggaaaaaaaattttggtagtgggggcccatgggtttttggaagctgctttacaaagcctgttccaaaaaaaagggtccatgacaatgagcatccagtggaaaacacgccagttttaaagcaagagggagttttgttttgtccccagggtggagggcaggggggtgatttaggctccctgcaagttttgcctcccaggttgaagtgattttcctgtgaaagggaattatttttgatgagtcattaaagtaaatccattcccaga

SEQ ID NO: 481109 - DNA, 574 bp, Homo sapiens
cacgcgtcgcccacgcgtccgtcgccatctccttctcggcatcatggccgtcgctcagaccccttgatgatgcccaagatcgtcaagaagagaatcaggaagtacatccggcaccattgcagaccgatatgtcaaaaggaagcgtacctggcggatagccagaggcattgacaacagggttcggaagacgattcaaagggccagactcttgagtgctccaagcattggttatggaaagcaacaaaaaagaacgcacgcgctagtgcttgccgcagtgtgcttgcgggaacgttccgtggtccgacgaaggtcagatggagctggaaggtgctgctgatgtgcaagcgcatcttacctgtgccgagatcgcctcacaaggtctcgctccaaagaaccggcaagccaatcgtggaaagagctgcccaacgtggccatccaccagtcaccaagggcccgaagtgccagggctagcagctaggtgagagaatgcatggagtaggcagcttcaatgtggcacagttacatgtataacataagatgtaacaaaactgccaaccgaaaagacaagacaacg

SEQ ID NO: 481110 - DNA, 376 bp, Homo sapiens
ccctctcagtcctcttaacagttgccataggttaaaggcggcactaaaatccgtatggtcctatgaacgataagtagatattagaagaactgattaatgtcctgggtctgagtttatatatcacagtgagaatactatgatggcccatgtaacgaacaatgctacagggatgacatcattatgaagcacagtagtctagtatgaagctaagaggagagctgggttgtacgggtatgtggcacagtgtcagttcgggataataacttcttggtctaggcacatgactattgttgtaggggaagagactgatcataaaggtggaatgcgacaatagatattacataatgggagtatgagttctacatagtaagggtta

SEQ ID NO: 481111 - DNA, 827 bp, Homo sapiens
ggtacattaccattgtttgtgacacgcgtcacaagtacaaacacaagcacaagccatttttgactccacaaactctgtgaacatcagaagactttccagacaagaacagtcactgtcaaactcagctgccactctcccccaaactatgacacatgtggtcactggcaggtggtcagtaagcacatggatgtaaccacaaccctccaccaggattggcaagtttgaggcaaggttcattccatttggcactttgaagaagagtttggaagagtcaagggtcactttggacactatcaacagtgttgcacttcaatcatgatggcaagagctacagcagcaggcggcagaagatggttacagtcacagtatccattacttcgacccacagtacttcgaatttgagtttgaggcttaagaagactggatctcactgcacgggcatggtggctcatgcactgtaatcaccacacactttttttttaaggcaggcggatcacactgaggtcaggagtttaagaccagcactgacacaacataggagaaacaatcagtctcatacataaaatatacaaaaaattagcaaggcatggtggcacacgcacatatagtcaccagctactcaggaggctgaggcagagaatcacttaaccaagagcaacgttgcagtagctaatacgtcataatcatcatagcaacaacacccgtgggctgggggtttgcggtgtcgtggctgtgctggtttgcggggtggttggggggggtgtgggtcgtgggcggttgtggtggtgctggtgggcggtgtgtgggcatggtgggggggttggtgg

SEQ ID NO: 481112 - DNA, 201 bp, Homo sapiens
taggagtacctgaggaatataccctttctgcctgttcagctaacactttttccctattctttaagcctcaaccatctctataagtcaatctttgacaagagctttagaaaattgcaaagggaagaatattcctactgtataccaggtattgtacttagagctttacatttactgttttatttaattcttttttttttttaa

SEQ ID NO: 481113 - DNA, 396 bp, Homo sapiens
  misc_feature (55)..(55): n is a, c, g, or t
cccggaggcattggcttcccgggcccacgaggaacttttgggcttttttttcccncagattggggcccccgggtccctccagcggccaaaaagtttggagtggtgggggggtttcttcccccccccctttcgagagctccccccctcctccaaaaccggacggctctccagaccttccctcccagccgggggttcgggccttgggaccccccggctggcccggcggcggggaagggaggcgggggcgcctccggcggcgaaattcaaaggttacccttggacccccttccgtttgcgaaccctaacaaaggactcaacccccccccaggggagggttaggcggccgggggcattaacttaccttttagtacagcaattaaataacctgggggtcca

SEQ ID NO: 481114 - DNA, 211 bp, Homo sapiens
tgggacacggaggcgcacagcaatgccggctgatttttctatttttatgtagagacgatgttacaccgtgtgagccagtatggtctcgatctcgtgagcttgtgatcatgcctgcctcggcctcccagagtgctgcgattacaggcatgagccaccttgcccagcctctttcattcctttttatgtgatcgctcccttccccgtgttccca

SEQ ID NO: 481115 - DNA, 432 bp, Homo sapiens
caggttcggcactaggatatatatatatagtgtgtgtgtgtgagtgtgtgtgagtgtgtgtgtgtgagtgagtcatagctagatcgactcatattcatacccgccgcttctcttctcttccgccttcctccacctctcttctctcctctttttctctctctccctctcttactccccttccttccttgccttttctttcctcttcttctccgtccttctttctcttccttttttcctctctcctcctctcttccttctctttcccattctgctttcctttctcttctcctcccttctttccctctcccactcctgtttctcccctctttcctctccctttccttcctccttttctcccttcctcttttccctctctttctatcctttttctctcctctctttcttcctcttttttttcccttccttcccccc

SEQ ID NO: 481116 - DNA, 413 bp, Homo sapiens
  misc_feature (73)..(73): n is a, c, g, or t
ctgcacctgtaatccccagcactttgggagtccaagcgtgaaaccacccatgcccagccatatttattttatntatttttttatggtgacagaatttcaccaatgttgcctgtactggactcaaacatttggcttcaagagatcttcctgccttggcctccccaaatgttgggaggctgaggcaggcagatcacctgaggtcaggagttccagaccagcctggccaacatggtgaaacccagtctctactgaaaatacaaaaaattagctgggtgtggtggtgggggcttataatcccagctacttgggaggctaaggcaggagaattgcttgaacccaggaggcggagtttgcagtgagccaagattgtgccactgcactccagcctgggcaatggagtgagactccatctc

SEQ ID NO: 481117 - DNA, 993 bp, Homo sapiens
ctccccccttctgttgccctgtctcaaccgttcctctgaatgactggtagcaagaaaatctggggtcaccaattgcaaagcaatgcctggcctctgcgtggatatgccctagtgcaaaagttggtatgcttcaaggcatccttggacagcaaacgtttcggatgtcccacctccgagaccaagcatttgattcagaataactatcccttgcaaaagggtatccactaacccaatctccctccttcgaatcaccagggctccaagaccaaactcatgggctgtagcgtgcgagcctctaggtcccatcatgcttagaaggtgggctacctttttgaccatgacactgtggagtgacaatcgggatctgaaatgatacagtcttgggggaaaacggtagaaactaccactatttgttcgaaggctcggagtaatctaggtggattattcgggcgtattccactctgttgaagttccttgttcgaaacaatctaatagcagtatggcgatcttccccgcttttacttactagaccttcctagtccatctccccaagtctccaattcttgactacttgtggggtgatcaatgcagagttgcattcatatgcactcgtgatgcgtactatatccctctccactcttgactgaatatcaagacgtagaatagcttatgttgcgttggtatatctacttcatgatagttcggtctcacctcttcatggcctgggtgtgataaaggatcgttggagctccagaccaacatagccaacctcattgttccaatactgcattttgcctcggtgtggggaagggattgggtcttgtcccccgacacagctttctgtggctgactgtaatactgtacaactgtttctgaccattaaatgctgttgtactctgtgtggcctctactgtggtttacctggggaggaagcagcagtaggatataaatacatcagttccgtcataaacaggcaatctaagccactcataa

SEQ ID NO: 481118 - DNA, 256 bp, Homo sapiens
cggtactcgatcactggatctaaatgactagcatacggagagctgaggctgtcatgttatttattaaattacttttacagccttaagttcgctcgggagcccactctgtgtgcctctttttcttcaacttcagcaatggccggaccaaggtacacatcctatttttattacacacgtttgagcccacagatctctgccgggcccatgggcttgtggcaagatcaagcagaccttcaggtaggatacagtagggaga

SEQ ID NO: 481119 - DNA, 157 bp, Homo sapiens
ccccgacggtgaagaagagcaccccactccccgcccgtgggtcagaagagcaccctcacgcggggcccgcaggaagaagagcacccccacgcacggcccgagcatcccgctggcttccgggccacctctcctcacccatcttagaggcatggccggg

SEQ ID NO: 481120 - DNA, 127 bp, Homo sapiens
atccagattattatgaacagtacgggagcagagtggtataggactttcaggaacttaactatatctggcaataaggaatgaatcaactgacctatggagccagcaaggtattattaactaaaatatg

SEQ ID NO: 481121 - DNA, 271 bp, Homo sapiens
ttttttggggcccccccccccgtttttggggtttttttttgggggccccccaaagccaaagggggggggggccaaaacccccccaaaatccccccccggggggttctttcccgggcccttttttgcccggggtttttttccaaattcccttttcccccccccccctgggccaaaagggggggggggggccccccggggtttttttttttttttccccccggttggggggggtttttggggggggaaaaatgtcccccttttttttttttta

SEQ ID NO: 481122 - DNA, 522 bp, Homo sapiens
actgacgtactgctgtctgtcacaggagaacagtacggacgacccataagtggacaaaaagaggtacatggtatggcccagccaagtcagaacaactactggaaggccatggaaggcatcttcatgaagcccagtgagttgctgagggcagaggtccatcatgcagagctgtgactctaaatactctgagccactgtcgccacacagtgtttgtagacatctgctgctgctttactgcgggatccctgctccaggtcctctgagcgtgctgccttgggacctgcagcccttcacacttgaattggttgctctcccaggcttagtcagttctctcgggaaaggactcactcgtctgtgaaggtggagatagctttcttcatgctggtaaaagaagttgaggagcttgcctgtcttagctgggaagtgtaactccgcaggaactgggcatcatggattcttaatttgtgatttctcctgttttgtctttctccaaaataatgaataaataaataaataaaaaga

SEQ ID NO: 481123 - DNA, 321 bp, Homo sapiens
ctgtgcagaggaaaataggccagcccctccttgttccttagctccagatggcttgttaaaagggtgtgggacctcacatgcccatgtgtcctaggccatctgagtgtgacaagagaaatcactttgtttttgttttattttgttttttagagaccatctgcagtgtcagcactgacctgggcactagcagagcattagccagataacccaaagtcccaagactgcagtgcaccttgagctttggagcaggcattgttctttccttatctatcttctgctactgtttaaaaatgttaaaaaaagataatcatgaataagcta

SEQ ID NO: 481124 - DNA, 150 bp, Homo sapiens
tctatgctgtgtcgtgagtcatggatgctggttcctacaggccctccccgggatcgccaccaggcctagactatcttggcctctcagctcctgctgttccgtaagctgtcatgtcctttatctcctgtggctatgaactggttatataac

SEQ ID NO: 481125 - DNA, 275 bp, Homo sapiens
  misc_feature (87)..(87): n is a, c, g, or t
  misc_feature (216)..(216): n is a, c, g, or t
cctacttttattattaacccattttcagagttgagaacactcaaataacctactcaaagtcacgcaaattaggaagcagcacagttnggactggtcctcagtaaagtctcctgtaaagactgttattttaagcacttctatctgtgtggaaaggctgttaattctgtatcctccacacgatgtggctaatgcttagaactggcaaggaacccccanactactgagtcccttaattttggccgagaaaggcagggttccaaaagtagcattgaaga

SEQ ID NO: 481126 - DNA, 296 bp, Homo sapiens
tggcctgagagcagatctctggtgtgagcagtacacttgtggtgtccgaatcttggagccgcaggatgtcgctccggtgcggagtctgtcctctatccgtttggactgcgtctgctgcgcgtttgcctctgcgtacctgtcgcctctgaagctggagccacttgggtcttatctacttgggcaggcctgtctggctcctttctctacacaggaggaattggattcaagtacgtggctctgggagacctcatcatcctcatcacttttggcccgctggctgtgatgttcgcctacgc

SEQ ID NO: 481127 - DNA, 679 bp, Homo sapiens
tctggtctccaaaaaaagtgggggatgactttggccaaggcaagggggggctggggaagggcctgaggattacagtgaaatcggaccattcaaaacagacgggcccagatatggggggggggccttctggcctcggcccgggaatcatcaaagccctcagggacacccaccaagagacagaaagaaacagaaaaactattcaaacgacggggggaatatcactttggatgagtatggtgcaactatggctcgacagatgcggcaccgatccttagccagagaactctcgggacaccattaaaagagatcctgggggactggcccagtcagggggctggtaatgtgagatgggccgccatcctcatgacatcatcgatgactatcaacagtgggtggctggtgggattggcccagccagttaagcacaagggaaaacttttcaataaagggatcatggacaaggggaaaaaaaaaaaaaacaaaaaaaacaaacaaaaaaaaaaaaaccccgggggggacatatatgtgggggaggggagaaaaaggagggaacagataggcggccgatggcaatagagggtcactggccccagtgtatgtggcacagggggatactcgagaggacccaaagagagagcaataaacgaaaaaccggggtcccgggtagatcacgcaagag

SEQ ID NO: 481128 - DNA, 146 bp, Homo sapiens
agacccttaacaccgcaatctacattcatttctgattttatgctggtagcaatcccatgcaatggaatactattattattattaattttttttgagatggagtctcgctgtgtcatccaggctggagtgcagtggcaaaaccctga

SEQ ID NO: 481129 - DNA, 674 bp, Homo sapiens
  misc_feature (40)..(40): n is a, c, g, or t
  misc_feature (131)..(131): n is a, c, g, or t
  misc_feature (239)..(239): n is a, c, g, or t
  misc_feature (359)..(359): n is a, c, g, or t
tcggccagggggttgtttggccccaacaccgggcttctcnaattgtttcatcccccccctatcccaatgggcggaggcgggtcgggggggtcttttaacccagctcgttagttaccgtccattgctggagnacccctccccccgtttttttccccattaaaaacccggggccgtcacgcctccgggtttatgccttgggcgcggggggggtaaccattttcccccaggaaccacttttnccctttggccctttttggggcccctattaaaccagtttgtcccaaaaaaccgggtggggcccggccgggatttcccggatttttttcacccccccggccccgggcgcgtgggttttcccnctggctttccggggggaaaaatttttccaaggcctttattttttgggggggggaatagggcccaaaactcttaaaaggtttctttccccccttttaaagcctttttaaagtgtgaggggaacccttttttttttgggggggcccccttggccccggttttttgttcccaagggggggcccctgttcccccggattaaaaaaaccccatggccgttaacctttcccctaacttaaaagccccgttggttgttcccccccaaaaaatggggttagccgaattttggattttttccccaattaaaatttttctgggtt

SEQ ID NO: 481130 - DNA, 194 bp, Homo sapiens
tttttttttttggggccccccccccttctgtttaccggggggggcccttttggggttaaaaatgtcctttaggggtcttttttttttcccctgggggggggggggggggggcccggcggctccccttttttccccccggggtttttttttttttccccgggtttgttttggggttttacccgctttttttttta

SEQ ID NO: 481131 - DNA, 157 bp, Homo sapiens
acgagttcatgtaatcgtcgaggccagtctttaccagcatacgttatttacgtcgccctcggccgtcggccccaactggagggtaccaccccaccagagcccccgattagtacgcgcatcgttatctgcctgactggctaacctgtaccgttgcatc

SEQ ID NO: 481132 - DNA, 140 bp, Homo sapiens
  misc_feature (140)..(140): n is a, c, g, or t
ctcaaaaaaaaaaaaaaaatttacttgcatctcttatctactgaaaagctggttaacctaaatctaatagatggtgtaaaatagtccagtaggagtttattaaatggttccaggccttggccattatccttcaaccacan

SEQ ID NO: 481133 - DNA, 989 bp, Homo sapiens
  misc_feature (451)..(452): n is a, c, g, or t
gagtgacgcgaggtctgggaagaccaggagtcagactgtaggacgactcggtcccacgtgtccccggaactcgccggtcgtagcctccggttcccggggccggggggaccttttagcggcacccaacacacagcctaactttccaaggcggaggccatttgttttgtctaaccgggacaatgcggcttgaacggggggaaagaaacaacacgccccaagggatgagcaggtgcatcggggtgggttacccggaaagaagccagttttggttcgattacaggagcgggacctggttgtgtgtgccacacattggaaaaaaggcctcgtacccttggcctggcagttgtgacaacctcattggccttattgtccaccacggggggcaccaacgactttcttggactaccgtggcaactcctcataaagatttggcgacgacacgcgccttgtnnttttttcacccaaggtgaggctttgaaacattgccctccgtggacagacacgcaacatttgaactggttggcacacccacattgggttttgggatacccacaatattcaccaatttgtgtgtgcaacaagggggggaccgctttttgggccaccaaaaatttttttgtggattggggatatttataacgccaataatataaccaccagagaaggtatgtgtggggaggagaggaaaatatttgaataaaaacacaaacacgaaaacgaaggagcaacacacgcgaggcaaagatagattgtatatatagagccagcgaggcaggagagggaaagaacaacgaaaacaaaagaaagagtgcgaagcagaccaacccacaaacaacgacggactagacgagagtagtttgattcacacttcacgaagtttggtcacggggtgaggacaaacacacaccacagcagaaaagacaaagaaagagaagagacggaagaaagacagaaacgaaaagaggaggtcagaagacgagaggaagaga

SEQ ID NO: 481134 - DNA, 192 bp, Homo sapiens
ttttttgtaaccttcccttgaagacagaattttggtgttggtgcttgtaagcattttcattaataatatgagaaatgatacctggagagagagattatagcaatgtattgcttcttttgaggaggagcatcatcttttgtttaatttgttattatgtcaagatgctctagtttcattgtaccaatacccaaa

SEQ ID NO: 481135 - DNA, 1239 bp, Homo sapiens
ggaagttacttccgaatgtatgtggagtagcgagtggtgtgtcaggggctaaagaggaggactaacgcatagagcagagctatgggaacccggggacaacatgggagtagttcatctccgatgagtaggtccagttcactacgaagaaccactccggcgcgacagtcattgaagccaccgaccccctggtggttgctctgtagacggggcggcggatcctgtgagagaggctggatctcgtgacaccctacctattgtcctcgtccctacctacgcagttctcctggcattccccctctgcccttcggacatatgtgctccctccttcagcacattggctgcctcctacttgctttcatccctacgagtatcgcgaggcagcgcgtccgtgccccgctgtcccggggggcgtcccgtactctggtatgtctcatggctgctgagtagaggcacagaatacagactgcaggcacaagacgtgggtcaatcccagtatcccgaagagggaaccaggagcgcaaggcgaaagaagggcccagcccgaagatgctgggcacgagcttgccggtgtctgatggggacaaggctccggcttccactaaaacgtgctcagtgcgaacgcgtgaagaggctcctcgcggcgcaggaggcccgggaggggccaggggaatcctggcgggtgggggaaccctgcagagtgcgctcaggcgagcagtcaccgcgagcggtgggacaataaagacagagataagggagggccttctaaaaccggaaaaatctgacacaggaaaaatgcacgtgcccgaaaaactgcgggtcagtaaaaccgcgaggaacgtacaagggccccctgctccgatagcacattccaaagaacaaacacagaagaataaaatagcaaaaaaacgataaaaagcaagacaaaaaaacagaaaaagaaaaaacaaaaaaggacaaggcacacaaacaaaacagacagagaagaaaggacgcaagcagaagagaggagggagggagaaagagagagagaagaaaggacggaaggaagcgggagagaaaggaaagcgaaaaaaaggaaagagaaagcaggaaaagaggaagaaaaagcgaaagggaaggggaagagagcagcgaacgagaaaagggaacagaagaggaaggagagagacggaaacgagagagcaaaagaggaggaagaaggggagaaaggagagggagaaaagagaaggaggaacaaaa

SEQ ID NO: 481136 - DNA, 1147 bp, Homo sapiens
gagggatcggaagccggttggggtgtgagacggttttctcgctcatagggagacttcttcaagcaagtcactactgtcaacagaccacaggtgtttcccttccttcatatgaggaagatcagggatcaaatatcatgcgaagaagctaaagaggcaccattcgtacccgttggaatagcgggttactgcagcaatgtgtggcatatggattatataaacttgaagagcaggggaaatagtaaaatgtccattcatctgatccacatgcgtgtggcagcccaagggcttggttgtaggagcaattgactgtgggctatgggctattccactgtactcgggaattctgggcaaaacctacagccttagaagaagacgactgctgtcttgagcttgttgggaggagcttgctatagttaagatgtcttattattaaagttacctatacttgttggcacctaaactaaattgtatgggtaacactggtacatggcattggatattggcttcctttcttgcaggcttgatttgctggtgaccgaattatagtgatagcttataataggtcatcagggagtcagttaacttaaccatgtacctaaagtcaagggagggggtggaacagtccacctcctaacaataacagaactgacgtaggccaaagacacacaaaggccaacctaaggaaaacacgggtgaacgacacagtcacacaaaggggggtggcgaaagagccacatgtgccacaaaatacactggtcagcagaagcgtgcgaggcacgatgcacaactgctcacacaggggtgaacaacaaggatacaaccagaatagacacatatggtgaagaactcacatatcatcgggtcatatacacgaaggcaataacatactacaattgtaaaacagagaatcatacgaagacataaggaagtagaaggtgtgtgtgttgtggctggctgtatttttaggagagaaggcagagtaagtgaagaaagagaatgagtgatatgaacgtgaggagagagttaagagagagatgtaggaaaaggaagatagagacgtagagcagaagaagtaaaagtaagtgacatgaaatgcaaaaagaagaaggagggacggccgacatgaaggagaagaagagtaaggagg

SEQ ID NO: 481137 - DNA, 133 bp, Homo sapiens
  misc_feature (89)..(89): n is a, c, g, or t
taccgcattctcccatcagtcatcataagcaataatgccatcctcagcctcttctctgtgcctttattggggctagtggttttaggatnggaaaaagtggcttctttttctaccgtgcccagaaaacggtgat

SEQ ID NO: 481138 - DNA, 141 bp, Homo sapiens
ctttaggggggggggttcccctcgtgtggttctatttttttaaaaaccgacctttttaaaaatggtcccgtttggggcttttccgattttttaggaaaatgctttgtattggatattaccatgatcccccccttagaatat

SEQ ID NO: 481139 - DNA, 527 bp, Homo sapiens
catactgtcaactaaaaattctatatctggcaaaactgcccttcaaaaatgagggagatgttaagaaattcccataccaacaaaagctgagggagttctttaacactatacctttcccacaaaaattgttaaagggagtttttcaagctgaaatgaaagcacactagacagtatctcaaatccacataaggaaaaacagagcaccagtaaagaaatctgtataggaaaacataaaacacagcataaatgtatgtttttctatgcaactccttcattctaccatctgctttaaatgacagttgcataaagcagtaattataaatctttgttaaaggatatacaatgtgtaaacgtgtactttatagtcagcaatagaacaaacaggtgagaggaaatagagttatgtaggagcaaaggttctgtatagagctgaaattaagttggcactagttctaaatagattgttttaagatgataattgtaatcctctcagcaatcacaagaaaataactaaaataacatatagt

SEQ ID NO: 481140 - DNA, 174 bp, Homo sapiens
  misc_feature (78)..(78): n is a, c, g, or t
ctgtctgttagaaaaaaattttaaaaggtgaatgagatcatgtcaatgcctctgttcagagccttccagttgctttcnatctcactcagagggaaagccaaagtccttaccttgtccctgcaaagcctggtttaacccggcccatcctattctctttatttaccactgcttgca

SEQ ID NO: 481141 - DNA, 506 bp, Homo sapiens
agcgggactggagaggagtgagtggcgggctgggcggcggcggccgtagccgcgggtgcctccccgcctcaccgcttcgcaggcagcaccgcctcccgggccgcggacgaccaggacgggtcctcatgcgcagattcccagggccacggaaccgagcacacagatgcaccctggcatgcgttcatgatcgcacgcacgcgccatcaggactcatgacgacgatgatccccccatgagcagccgaaggcagcagctgcagccgccgtcgacagccaccgagcgaaccatgtggatgaccaccagtcgagaaccatgacggccgagggcagcggcggcaggagggagccatgtccgcacatccatcccgggctggcgtgcgccagaggatccgccaaaagtgctgaacagaggagatgttaatctctgatgagacctaggaccagagtgtaatcacctccttattatgagagaaattggacttgactagacaagatatctgtcaaaag

SEQ ID NO: 481142 - DNA, 950 bp, Homo sapiens
ggaccttaattgaggacgagtggttctatgttggtcacaaagagcagttgcaccctctctgcccttgcttcatgtggctggagcccaggcaaggagagcaggagccagcgtgagactgaggccccctggtgcctatcaaggaccagagtgaaggggactacatctacccagcccttcacctttaaagtatgagtggtttaacaaggaaaatcaatgaaaccaggcaaacagcaacaatatgctgtaatggaaaataggggacaagactgttgtcacttattcagacattgtatcccattccttttggactctgacaatattttggggctgtagctcctatccaagcgccatggtagtccctccccgagtctcacccagtagaatgcagcctcccatccctggccccttccctctcagtgacggtgactccctggtgagccttctcgtaggaacccagagggggctgaggactgtgtgcctggtctgagagggccaggagtggtgctcctcaggattgcagcactgagatggaacctggcctcaggttaaagaacagagtgccacaacagggcaggaactcagcaccctcgacataaggaatacaacagtgggggcacatcatgtgaggcatcagacccacatctgtaagccagcaggccgggctgtgtacttcaagaccaatgctgccctagacactgactcggggatcagctatgcaagtgggctctccccaccttgaatgtactctggattggcaggtgtgctggatatactggctagacaccatctggacctgtagccgagactgactgaaatttgccgcatctgctaaaggataagtaaaacttcaggagatcagaggcaactgcagaggaaggaaggatcatgccgaacgaaagagagcatcaaacagggacatcgaaggacaaacaaagaacgagaacctgact

SEQ ID NO: 481143 - DNA, 914 bp, Homo sapiens
gagaagcaaaggagtagtgcatttgttaagaagaagacgcctgaatcttttagtggacctgctttcagcaaacttgttttttagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccactgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaacgaagaagcacgagctgaagattactcagcagggcacggacccgcttgttctcgccgtccagagcaaggaacaggccgagcagtggcctgaaggtgatcaaagaagcctacagtggatgtagtggccccgtggatccagagtgtcctcctccagcaagctcaccggtgcacaaggccagcaactggaggaaga

SEQ ID NO: 481144 - DNA, 905 bp, Homo sapiens
gagcggggctccgctgtggggcgggacggcgggcggcgggcggggccgtgtgcgcctgcgtggtgtctgtccctggcctgcagccccatcgcctggctgcatgctccgctgacgcctgatgccggatctcgagcgtgggtacactggcgctgatggcggcgcgcggcgtgcccctgcccctggggctccatttgttaatgtgctggctgcgtgctctgtcggcttgttcacgctagctgcatccatgtcggcgcgatggcgcctgcgtgcgaggagcgagcgctgcgaggtggcggcctgagcctcctgacagtgggcctccaccattgccaacatcctccctcccagaaggttattatgaggaagctgtgccactgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaacgaagaagcacgagctgaagattactcagcagggcacggacccgcttgttctcgccgtccagagcaaggaacaggccgagcagtggcctgaaggtgatcaaagaagcctacagtggatgtagtggccccgtggatccagagtgtcctcctccagcaagctcaccggtgcacaaggccagcaactggaggaaga

SEQ ID NO: 481145 - DNA, 779 bp, Homo sapiens
tggtgtccaccaagcctgaggagagctggcagtgtgtacagctctgcccaggacagcgagggcagagatgtatctgcacagtggtcagccccacagcagaccatgtgttcacggggatgcccgcacaaaacagctgaggcagctactgtgagaaggtgcagaacatgttcaatccatagaggtcttggaagtgcggaccagagagacttgcagtacagtggagaacgatggagaaccaaatgaaaggacctggaggtccaaagttcaaacaggtggaggagaggtcataaggcaacactggacaggccagatattaccgggactaaccttacaaaggagtctactacaaatgctgcacgcggactgaacgaagccagatccaagtccacatgtaaccagtgaaacgacgagccaggagagccttagtgcaacacatgcattattacacgtaattatataccacatacatatagccaacaatacatcaacctcaaagagcaacacctcttggcaatttcacaaacgggaacgggatacactatccgctattttgcacaattccacaacactgtaaaggcactcgacactttttccaattgcacaactaacttaattggaaaacacccctctctggatccacacattagcacatttattatctttcgaacacggaagaccaaccacaacaacacaacaaacaaaaaccacaaaaatatataatcaacaaagataccaaacaatagaactcatacactctacacacacaacacaacgatcaa

SEQ ID NO: 481146 - DNA, 123 bp, Homo sapiens
aatataggaatgctggcatagagcagcactaaatgacaccacttaaaaaaaggacaacgatcagacagatctggaatgtggaagcgttatagaagataactgacctcatttcttcaaaatatc

SEQ ID NO: 481147 - DNA, 895 bp, Homo sapiens
tcagatcccaccaagcagcactatgccattacgcccatgaaacgcccaatggaggaggagacccattctatacgaacacctatctgattggttcggtcaccctgaagttaatattcttatcctaccaggcttcggaataatctcccatatgtaacgttactactccggaaaaaaaagaaccattgtggatacataggtatggtctgagctatgatatcaatgggttcctagggttaatcgtgtgagcacaccatatattaacaagtaggaatagacgtagacacacgagcatatttcacctccgtaccataatcatcgctatcccccaccggcgtcaaagtatttaagctgactcgccacactccacggaaagcaactatgaaatgatctgctgcagtgctctgaagccctaggatcatctttcttttcaccgtaagtggctgaagtggcatggtattagccaacctcatcactagacaatcggatacaccgacacgtactacgttgtagctcacttccactatgtcctatcaataggagctgtattgccatcaatagggaggcctcattcacctggattccccctatttctcaggggtaacacgtagaccaaaagctagccaaaatcatttagtatcatattattggggtagtttaatttttccagaagattttgggcaatcgaatgccggagtactcggataccgatgttagcgaatggaaatcatattgaggcataatcttaaggagaattgaaattcaggtgaaagctggtcaggaaaggattgaagactcaaggggtatggcgccgtgatgagaaaaaaaaatggggcagaaaggggaaggagatagagaggtaagggaataacaacgaagaaagaagaaagaagtgggg

SEQ ID NO: 481148 - DNA, 243 bp, Homo sapiens
ctgatgaggtggtgtctcccaaaactgcctgcttcagggacctgagctgaatgctgcacattgcctcctgaggaaatggatgccttggcgaagctcctccacctacccctcccagatgctgctacatcctgcccctctaggccagagctgaagcaatgccaggcatcctgggaaaacagtgcattaaccatccagagcagtcacacccctctgtacctgagctgaagcagtaccttgtctcct

SEQ ID NO: 481149 - DNA, 456 bp, Homo sapiens
  misc_feature (114)..(114): n is a, c, g, or t
gagctcaccccgcacggaccgggccatcctggaagcatgagcaatacatccgggagcgcgtaccccgacgcggtgaacatctgcaatatctcgtcacaccctcctcatcccggntccatacttttacccttgttaaaacaggatgcacttaccctgcgtggccaagtacttccagtcgaatgctgaaccgcgctgcccccactgcaacgactactggccccacgagatcccaaaagtcctcgatcctgagaaggagagggagtctggtgtcttgaaatcgaacaagaagtccctgcggtccaggcagcattagccatcgtgccctgcagaggggctggctgccttgagtggcctgatcgccacagcccttcttggaagaaaggcgtccgtgtttcaggttccacgcgagtcacctctttcgtcttaatgttcaccgtccacagctttggaataaac

SEQ ID NO: 481150 - DNA, 1128 bp, Homo sapiens
agctttcttttgtggcctctgtgtgtggcacatcctcgttttgtttcgctgtgtgtgggctgctaccctcttccccgtcacatcggtggtttatggctagatgatctttgctcctcccggggttttcttagtgatggtatgctagtccccgcttgtgtgtctcccccggggtgtggcccctccactagccccttcttggctcaatgtcccggtttttcatcttttgtggtacaatttcttataggacatttcgtgctcaagtgtaatgtggccaatagtgggcccacattcggggggggcacaaagacgaaggttccctgtgccaccaagggttgccccccttcgaattgtgttgctaagtctcaatcccgtgccccctggggtcttgttcgtagtccacacaagtggtaagccggttatatcatttttttgtgggggccctgggggcgctccaaagttctaaacctcgggttggcacccccagattgcacaccttcacctattgtgtaattgtctgggccagcatacccctttttcctgtggtgtgtggccacggcacacaccacgcagccgccccatgcacctaaaggccctgtcttttgaaggaccgttcacatcgcgaggcgtgggcccctgtggatatgtggatccacgggaattggggaatgggccacacggtttaacccacactgggaacacaaaggagccacaggtttaaaatttggtatattgtgtaataagttgttccaaatgcacttttgggggtttttaaatctttgggaacacggaatgccctcccccttccccttttgggtcaccacgtttcttggtggagctgtccccccgggggcctccccctcacgatgagtcctttgccccggtatgcaccttgagcccttttgaacgctttacctcttccgctgttgccccacggcccttcctgagcttccctgtgggggtggcacactaccctgggccccttcaacgcctcctggccacagaacgcttccgctgccgctgcatccaccggggtttttttacacaacacattccacgttagtatttttactattataaaataatatgggaccttccctcccaatttttccaataaaagttgcttttcca

SEQ ID NO: 481151 - DNA, 477 bp, Homo sapiens
  misc_feature (9)..(9): n is a, c, g, or t
  misc_feature (140)..(140): n is a, c, g, or t
  misc_feature (181)..(181): n is a, c, g, or t
  misc_feature (193)..(193): n is a, c, g, or t
  misc_feature (219)..(219): n is a, c, g, or t
  misc_feature (256)..(256): n is a, c, g, or t
  misc_feature (267)..(267): n is a, c, g, or t
  misc_feature (289)..(289): n is a, c, g, or t
  misc_feature (298)..(299): n is a, c, g, or t
  misc_feature (302)..(302): n is a, c, g, or t
  misc_feature (330)..(330): n is a, c, g, or t
  misc_feature (334)..(334): n is a, c, g, or t
  misc_feature (363)..(363): n is a, c, g, or t
  misc_feature (386)..(386): n is a, c, g, or t
  misc_feature (392)..(392): n is a, c, g, or t
  misc_feature (398)..(398): n is a, c, g, or t
  misc_feature (411)..(411): n is a, c, g, or t
  misc_feature (414)..(414): n is a, c, g, or t
  misc_feature (437)..(437): n is a, c, g, or t
gggagcggngattattccaacaatgaaaattgcattaaaaagccaacagggagtgtggagaccgaaatgacatgtagagaaactaaatacccctttccttgggtttacctatatttatcttttaggcaagagagaaagtngtgataaatttactttatcaaaaagacaagaattataaccngtgccaaatgtnttacaatgggtgaaaggaatcattcnatgagagcaagagaggtggaagagaagatcaaagaantatgatgatgnctgagggagtgaagaagaaganaataatagnnggntcacagaaccacaattataccataaatnaccngaaggagtggagggaggggtactgtaatnctccttaataaaatctgaggtanttaaanactctnccaacatggaaantcncttctaccttcctcaaaggaaanagcagaggatgagaaggctgttgtggaagaacatacctcc

SEQ ID NO: 481152 - DNA, 210 bp, Homo sapiens
taccgtctcttgaaacaaatcctgtaaaatactcttctatatttcttcttcctgtgatttttcatctttctctggtattgtacccttccaaagttcagattcctgaagcactttcttcctcatcagagtttctaagcttgagaatcttcagatttctttgaagattaatttcctttatcttttttcttggaggcctcttctaagacacgg

SEQ ID NO: 481153 - DNA, 232 bp, Homo sapiens
tggggtgggacagagctggctctatcaccaagctcaaggacacctcctccaaggtcatccagtctgtcgcgtgagtgagtgtgaggctccagacgccctggagctgcctgcagctcgttccaggctgcagccctgtgaccttgattcctggcttgcggtggaaccatgctggtcatcacggccccacatggggcccctgacggcatgtgctggatcctctactgacgtcgac

SEQ ID NO: 481154 - DNA, 210 bp, Homo sapiens
ctgggctgcggacccacgagattgcccgtgtccgtaagcctgggtgatcttaaacctttcttagatggcttcactgctccagccgtcagggagtccacagcaggtcgcgtgcctcctctccaggtcaagagtcatagtctgtcctttgtacatattaaccaaattgtttaaaaaagccttcctcctcacaagccagcgtctcctgctcag

SEQ ID NO: 481155 - DNA, 281 bp, Homo sapiens
actgagagacgtgttgatgttgccaggtggagtgagtagcgcatgtcggctcactgcaatctttgctcctggttcaagaaattctcctgccccagcctcccgagcagctgggactacaggtgcctaccaccatgcccagctaatttttgtactctcagtaagatgaggcttcaccatgctggccaggctgctctcaaactcctgacctcaagtgatctgcctgtctcggcctcccaaagtgctaagataacaggcatgacccattgcaacacggtctctca

SEQ ID NO: 481156 - DNA, 102 bp, Homo sapiens
agcccttaaaagggctaggaatttctttttcagggaggtgggctcttaaaacacgagtctgccgagggtccgggccgaaaaaaaaaacctcttccttcttta

SEQ ID NO: 481157 - DNA, 785 bp, Homo sapiens
  misc_feature (29)..(29): n is a, c, g, or t
  misc_feature (117)..(117): n is a, c, g, or t
  misc_feature (119)..(119): n is a, c, g, or t
  misc_feature (174)..(174): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (196)..(196): n is a, c, g, or t
  misc_feature (198)..(198): n is a, c, g, or t
  misc_feature (205)..(206): n is a, c, g, or t
  misc_feature (210)..(210): n is a, c, g, or t
  misc_feature (219)..(219): n is a, c, g, or t
  misc_feature (226)..(226): n is a, c, g, or t
  misc_feature (233)..(233): n is a, c, g, or t
  misc_feature (239)..(240): n is a, c, g, or t
  misc_feature (242)..(242): n is a, c, g, or t
  misc_feature (244)..(244): n is a, c, g, or t
  misc_feature (250)..(250): n is a, c, g, or t
  misc_feature (254)..(254): n is a, c, g, or t
  misc_feature (258)..(258): n is a, c, g, or t
  misc_feature (262)..(262): n is a, c, g, or t
  misc_feature (267)..(267): n is a, c, g, or t
  misc_feature (270)..(270): n is a, c, g, or t
  misc_feature (275)..(276): n is a, c, g, or t
  misc_feature (279)..(280): n is a, c, g, or t
tggaagcatacatgtacaactcctgttanggctggagtcttggggttcaggaggaggttagaagttacaggcatctcttcaggcttgcttggtacttggcacacacaggatggtgtntnaaagagtgggctgcaccccccacacgccatttacatcagcttcataaacactttncttcctcccngnaacntaaccntntttcccnnttangaagttganaggcttnatgaaanaagttnncntngcacanccgngcanaaanctttntgnctttnnaannttttaggacgtcagctgtcagatacgaaacggtagactatcagcgtaacgaatctggcacttcacggaaatagtcacaaaactgtcataggttcgtcaatctctatcaacagtctcgcttctagctcaccacactccccagtcaattaagaacatacgaacttgaggtcaaacagttctgttacaaacgcttcataatccgtcccgaagcatactgcgtggacgcattctgagaaactttgctctctcgtgtgtacgacattcctaatttgggagtccttcgagctgaacttactatccttttagaacgttgagacagcaggtaagcaaaggacctagttcatgtacaacatggacatcatgatggctattgtaaaaaatatcgttctacagcttctccccctgaggcttggggagctgtgtcagacgctgccctttctctgctcatggacggtcttgtacggatctgtgcttggaggctgagcattaagtgtgagccagtgacc

SEQ ID NO: 481158 - DNA, 100 bp, Homo sapiens
  misc_feature (92)..(92): n is a, c, g, or t
ccgttcacacatgcacagcgctcacaacatgcacaggtccattcaggacgggctggcggagtgtgtgtggcaataaagcctgaaggcaccgngggagcat

SEQ ID NO: 481159 - DNA, 932 bp, Homo sapiens
caagtgtccccttagatctagaactgctccttgagtggccattagatcgagtcagtttgatctgcatcacttacgttatcggcgaattgtctttgtatggaaacaggaaaattccatttctaagattgatttggtgtacggtttcgctcacaacgaataggtcgggaagttgctagtgcaggtctgtggttctggatggcttgtgtgctaggtcgcaacattgcggcttggtgaaatgcctctctcctatcagcctctattattgtatttgtgtataacctaaggcagaggaaggtccttcagaaggacctcgcgtgttatggagcaaattccgtgcaatacgactgctagtaggtcatttttgcaagcgtccaagccatttatcacttttgttgtcttacgatgtgtacgtgtatgtgtagttttacttgtgaaagatggccactctttaagcagtattcattttactgccagctttactttacataggcaagcaaggattttcttgagtcataaacgtactttcgtaatgaaagtacttcctctcttgccagggctgttgtagtgcagcttggtaactaattaccttgatggcagctgtacgagtctgagtcccagtctgtagactaacttttttggaacacactggacacttttatggcttgaaggtgtggatatgggggggttacctaatccgggggtaggggacagtccttgagaactttacaggtgtccatgaagtgctggccaaatgttgatttgtatattgatgcaacgagtacgagatccccgacactgtagtaagggactgcgcgtggaagacgtaggtgaaggacttgcttaagcggatcaacgggggacaaaccggtaatcccgctgcacgaaccgtttataggctccaaaaaaaatgcccgcataaagggcaaaaaaca

SEQ ID NO: 481160 - DNA, 420 bp, Homo sapiens
  misc_feature (29)..(29): n is a, c, g, or t
  misc_feature (117)..(117): n is a, c, g, or t
  misc_feature (119)..(119): n is a, c, g, or t
  misc_feature (174)..(174): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (196)..(196): n is a, c, g, or t
  misc_feature (198)..(198): n is a, c, g, or t
  misc_feature (205)..(206): n is a, c, g, or t
  misc_feature (210)..(210): n is a, c, g, or t
  misc_feature (219)..(219): n is a, c, g, or t
  misc_feature (226)..(226): n is a, c, g, or t
  misc_feature (233)..(233): n is a, c, g, or t
  misc_feature (239)..(240): n is a, c, g, or t
  misc_feature (242)..(242): n is a, c, g, or t
  misc_feature (244)..(244): n is a, c, g, or t
  misc_feature (250)..(250): n is a, c, g, or t
  misc_feature (254)..(254): n is a, c, g, or t
  misc_feature (258)..(258): n is a, c, g, or t
  misc_feature (262)..(262): n is a, c, g, or t
  misc_feature (267)..(267): n is a, c, g, or t
  misc_feature (270)..(270): n is a, c, g, or t
  misc_feature (275)..(276): n is a, c, g, or t
  misc_feature (279)..(280): n is a, c, g, or t
tggaagcatacatgtacaactcctgttanggctggagtcttggggttcaggaggaggttagaagttacaggcatctcttcaggcttgcttggtacttggcacacacaggatggtgtntnaaagagtgggctgcaccccccacacgccatttacatcagcttcataaacactttncttcctcccngnaacntaaccntntttcccnnttangaagttganaggcttnatgaaanaagttnncntngcacanccgngcanaaanctttntgnctttnnaannttttagggcccccccgccgccaaaccaaaggaaaaatccgggaagaatctggacttaggaaaaagtcacaaaactgtcataggttgtaattttatcaacattcgcttctagtaaaattaaagtcaattaagaaatagaaa

SEQ ID NO: 481161 - DNA, 106 bp, Homo sapiens
ttgcattggcaaggccaaggggcacaactccataggtagttttttctatttcgcctcgtctcttcaactccaccttacacaactccttggcccttgccatatgcaa

SEQ ID NO: 481162 - DNA, 140 bp, Homo sapiens
agtgagtagattctctctgtaatacagtgtgagggactgctgtgcaaccaagcaatccaactgtgctaggtcatttcacttttctgaaaaactcacatcaggctgcatcctcttctgtcctggcaccaggctttgtttac

SEQ ID NO: 481163 - DNA, 160 bp, Homo sapiens
ccggtcattcgctacacacacacacacacagacacacccacacacaaattgctaatctttattttgcttttcaaatgtaagtaagaatttctgtaatggtactgactttgcttgctttgaagtagctcttttttttttttttttttttttttttgggaaa

SEQ ID NO: 481164 - DNA, 282 bp, Homo sapiens
acacgcctcccaggtcctcctgggaggctttttcttgcagggcgcgccgaaacctcggagggtgcggggatgacgcgtatccaagcttttctcgcctgtgtttccgtttcggttaatgagcgcatgcgccgccgcgccggacgcgcggatcccgctgagaggagcggtcgggcagaacgtgcggctgttcgacacccgcaccgcctatggccagttcctggcgggccaggcggcgttgcgggacggcaagtcgaaggaggcggccagcctcttcgaggcggc

SEQ ID NO: 481165 - DNA, 410 bp, Homo sapiens
cctgtttttttgtgtttcgttgtgttgtgttgtgttgtgtatgagacagggtctcactgtgctgcccaggccgaagtccagtggcacaatctcggctcactgtagcattcacctcccaggttcaagcaattctcctgtctcagcctcccgcgtagctgggattacaggcatgtgccaccacacgcggctaattatttgttgttgttgtatttttagtagagacaggattccaccatgctggcccagctggtctcgaactcctgacctcaagtgatccacccgccttggcctcccaaagtgctggaattacaggcgtgagccaccacacccagccattttactgttcttaatacagactctggtttccaaatccattccaaggggccactacagtgtagagtgtggagagg

SEQ ID NO: 481166 - DNA, 336 bp, Homo sapiens
  misc_feature (14)..(14): n is a, c, g, or t
  misc_feature (26)..(26): n is a, c, g, or t
  misc_feature (48)..(50): n is a, c, g, or t
  misc_feature (53)..(53): n is a, c, g, or t
  misc_feature (57)..(58): n is a, c, g, or t
  misc_feature (65)..(65): n is a, c, g, or t
  misc_feature (138)..(139): n is a, c, g, or t
  misc_feature (148)..(148): n is a, c, g, or t
  misc_feature (158)..(158): n is a, c, g, or t
  misc_feature (186)..(186): n is a, c, g, or t
  misc_feature (188)..(188): n is a, c, g, or t
cacgaggctctccncgacgacgtggnccagaccgtgctcaccgatcannncgncganntcgacgntcttctcgcccaggcacagaaggacgcccaggagaagctcgacggctgagaagacggatgccgcggggcaggnnagatcgtcngtcccgcggnatccaccatcggtccctgagcttgtcgnanggccgcccgacaatcccgacgagtcgacaagctcagcgaccggtgatcgaccatgaccaccacgctccagcagcggcccgccccgccggacacgcctccgccggcggtacccgctcgccgcagggcgcgtcgttccccgctcacctgg

SEQ ID NO: 481167 - DNA, 652 bp, Homo sapiens
tttgcagaaatatggtaagtggatcataaataggagggagaggatctttctggttaggagaataattcatgtgttgaggcaaagagcatgagaagaccttaaatgaacccaagttcccttccagatggaaaatacagaactctaggaagatttgcttgccttgcatggaggtggagacgggagttagggaggaaggaggagataggtgggaggactaatggagaaagtccttgaagctcaaactggggctggatctgccgtgacagacaaaaaggagcgaattacgcttcttttttttttttttttttggaaaccatggttcctcactcctggtttgcctaggtctgggagttgtagtgggcgtggtcccggctcattggcggcctctgcctcccggggttcaaccggtttttggtggcctcagccttcctgagtgggtctgggactgcaggctgtgagccaccaggccgggttcattttggtattgggtaggggggagggagttccaccgtgctgggccaggcgggtctcttaacacctggacctcgggtgatcttgcgccggttgggctcccaaaagtctgggccccggtgtgagccatggcccggcgaaatcttgaacctccttgcgactcctcctatgaaggtgcccc

SEQ ID NO: 481168 - DNA, 710 bp, Homo sapiens
gatcgagtctttggacgcagacatgccggctgtgctgaaaattaaccactggactcgggggtagtaggctgtgtgccaataactcctcatcgactaggactaagatatatatgtacatcaataaattcttgatgtactggatgaatttcgtgacagtggtgtgtatagaaagtatacgaagaactatgattacaagtgtagaagacgtgggttagggctctaaatgggaatcagatgttagtcatttaaatgaccaatcgtctaaggcagtgggtaatcagaagtaggtgattctctcagtgctgaaacatgaactaaatctggacatgtgtgttgagggattggaatctgatgggagacctgtcaggggaagaggctccctggccgggtcagtggcaagactggtcagagtataaattattaaggtgactttggtgtgttcatgggaaactgatgtaattaaatattctgttatattaagagcgtgttcttatgactgacatttgtaaatcaagaaaagtgatatagaaaatatgtaggagactgttaacaatggtgattatggtaatatggtcatgtgaatcaatgttgatttataaagtactcacaccagtgtttcaagatgatatttctgtgaacagagaggccatgggaagatttggaaattttaacgaaaattcctacgatttaatgggagacataatcaaaaa

SEQ ID NO: 481169 - DNA, 188 bp, Homo sapiens
ccccaatcccgactgagcccatactgtttcccacaagggctcaccacatagtcagtatcccgtgcttccagtgtgtgttcagattctcctcttactgtttttcttagactgtatttgttctataagcaaattgcccattttgtgattttttaaaacgtgctggggaaaaattaaattcaccaccaaat

SEQ ID NO: 481170 - DNA, 973 bp, Homo sapiens
  misc_feature (243)..(243): n is a, c, g, or t
  misc_feature (313)..(313): n is a, c, g, or t
  misc_feature (686)..(686): n is a, c, g, or t
  misc_feature (722)..(722): n is a, c, g, or t
agtgcaacaaaaatgggggcctccttaaatacacaccagcagtcaagtggaggaaaacttgaacaataatgagtcgcttcttgggtctctataatcaataaacctgtctgcagatatctatctatataagctatatatataatataattacatatatatgcacatgtatatatagtgtgtacatatatgtgtgtatatatatacttaaatgtaatatttaacaaataaaagtgtgatctcgtntagaagaaaatgtatcatattacaaactgctcttccatatttatgtaccatattatacctttttattatngttataattattatgggtatttctaattaatatgatgttgaaacctgtttggcaccttctggaagctaccaaaaaaatgacactccattgaagtgcttaaaagctgttctcataagaattctactggcctattgtaaaaaagaaaaaaaaaaaggaaaaagaagaaagacacaaagaaaataatctaaacaccaaaaactaaacacaattccaatcctttttctggtacctcacgcgcataaatttggtggctcctattttttttcctggttaatgtgttttaatgggatctaagttaaatctttgggcaatatttacaaaatgtaaatagtaaactttaatctattaaagaagtgtcatctttttcaaattntatatttacacaatggtccatctaattaatttttgnctatacaggttttaaatactcagacatatttggctgtccaggatatttttatccgtggtctcatggattggttttcccatactgtgtctcggatctcaattacaggttgggatctcacaaataataatggtcagagacagaactatttggccactgtggaattactatacttaaagttctatattatgaacgtttttaatagctggtacgctcgaagaaagcagaaaagagaaaagcaaaaaaaaaaacag

SEQ ID NO: 481171 - DNA, 698 bp, Homo sapiens
ggagatctagtcctcgtgttaatgcatgtgttgaatgatctttgatagttgatgaaattatgcaccagttcctcacaagttggttcatgatgctatggcttggagaatcccgtgagtatgagatgtgcctatataggagtcaatagagcgcaagcgaagagggttggtggaggagacgggcgtggtagttgagatggcgtgctggctgtggacctctcaagataaacatactagccagcaaagctctgctatatcagcgagacacattcctacaagacagcaggacaggaacgcgctgccacactgcgagatggcaaatggcgctggagacctgcggcgaaggatagaacaaaatggaagcaaaggagcgaccacacagaaaacatacacagcgcggcgaggagcagaggctcacgcagggcgagccgaaccctctcatgaagcatagcgaggtgcgccgacactgctggaagcaaggagagcaagaaccacacacaccaaaggccgacgaaccgaagagtgcatcccaacacgcgaagccaacacaaaaacgaaagacacgacaagagacgaagagacggacaacactataataccaaagccaccgcaccaaataagaggggcacacgagaaaaagcacacaacaagcacagagcgaagatagaacacaaggtagcacgagcgagcagtagacaacc

SEQ ID NO: 481172 - DNA, 1753 bp, Homo sapiens
gaaaccgagtccgagcctttacgtaccgaggacacagacttagccaagacgcgattatactcgcaaatgagagtgataggcagataggaagatgtactagccgtggccgcaagtacgtatatagggtaccgccacgggtgcagacaggatggagacagagagtgtataagccaaggcagtaagtactagctaggagctaagccccgtagtagcgcttctgccatagactggaagttgaccgtagagaagtaacgtctcgcgaacggagtacgccaagagggcgtaacgaacgcgcgccgaacaagcgacgacgcagcctacgctacagtacacacgctcagaagagtagcagcgccgcgctcatagtggtagccagaagtaggggggaccgagttcatagcgtagagcgcgacagaaccatgacgctgagcgcttgggtggatgcagctaggtatgtcacacaggatcaagaaatctgtaaggtatcgaacttgtggaatagtgttgcgccaacggagtaagccctcgtgaaattacccactgtgtgaaatattaaaccttgttaagtcccaaagaggcacggaaagcacgcgggctttgaggcaacacgcgtacggggacaaaaaggaggccctgtggtgggcacgacggacgctaaacaggacagttcacaggcaagccccaagtaacggtacgggacgcgtagaagaagacaggtccacacacgaaaggtgtacaggaaccaacgcgcatagcgaacggcttcacaagagaaaccccccaagcggtaacctcggtgagcacacaggacacatgcccagacagagacgcggatctcaggtgaacagccggtgcacaaagcataccgcggtcacaagcaagcgcgcacaaaaacaggggggaacccaacagatcacgtaattcaggcacaccataagtcaggacaaagaaaaccttaaggaaggtacacgatcacatacgaggcgtacaacacattgtcgccaacagcaagtatcgtatccgatcccggagacatataggggccccgtgtaatcgtgcagcgcaactattaaaccacaagcgacacgtatgaaaaccgtggaaaccaacagtatcaacaccgacagccgccaacaagtaaatgcctacacaccaacgccaaacatccctacaagccaaagggctcgaggattacataggaacccaatgccagaatgaggaactaagacgcagaaagggcacaagagcgcactgtctgtccacttacaagcgagaaaggggagtaaacacaaggaaaagggatcagaaagggaacatctcgggcagaagaatctctgtacccacggccgggtgtacacaccagatagacaatatgaccgactctccaagccaatcgggccagcaattcacgagggggtaccacgctcgggcaccagcgggacaacagcgtgatacagaccagagaaaaccaaaccgggcagaaggtggtcaaaaacactgtccatacaatagggcaccgctagaagtcccacaaaggtaacacggcgactacacaagaacgagataaagaatatgcgacacacggacggagacaaacaaagaaagacagcaaacacagtaagacagaacaaacaaggcgtaaaacacacagaagaacgggcgaacacgacagcagcacggaacaacaaacacaaacaacacagacgacaatgaacaacagaacgcgacgacgacagacaatgcagcgagcgaa

SEQ ID NO: 481173 - DNA, 302 bp, Homo sapiens
acagcaagagaagattatagagaaagtgggtgtgacttagccatgacgccatgtgtgagcaatagtatggcaatgcagcccactgtgtacgcatccaatggccatgtggctgcccggtaccccttcatccctatgccactggacatacaatcctgccggagctgcacaagaatgccatgagagccacaatggagagtcaactaagacgctccctacaatgtcccagatgtggtcattcaaccatcgccaacaaatgctgtcgatcttgatcatacaggatctcagaccgtgatgaaggaatc

SEQ ID NO: 481174 - DNA, 559 bp, Homo sapiens
ggaaagtttcgactgttctagaagcctctgttgtatttgcacagtggtgatttgctctagagactgagagccatttaggcgatgggggatagattactgtccgcgggaaattacccacttttttgaaacctaaagtgactgccatgggcactctgtgtcttgacagggattgctgaatattgagtcttggatgggatgcatagagtgcggcagcgtctacaggatccacctatatgggtgatactactagaagtatgcctctatacatctgtcaatacactgacacaggtattgtgtagcatgagctactgagccgcaagttatcactgatgcagaaactttagtacagatattctgcggcaacgtgttagtgtccattgaacccaataatcgttccacttgagttagaacaaggttgaaattcacgtcttgactgtccgaccacacaagtaggtcacgtctagaacagatttaatataacttggggccgacatgccattccgtgacctacacttgggttactgaagtgtgaacaacaggaatactgtctgtgttctgg

SEQ ID NO: 481175 - DNA, 151 bp, Homo sapiens
ctttggcacggcgttcttttatgcccggcgggcaaaacctgtcgttaaaccctagatgttggtcgagtttataagggagggttctatgtttgaatgcgaaattccatgccaaaattaatggaaacctttcctcggggaaggcattgggcgg

SEQ ID NO: 481176 - DNA, 394 bp, Homo sapiens
  misc_feature (394)..(394): n is a, c, g, or t
cgcagcatacacactgtagagagaccctatgaatgtgacgaatgtggaaaagccttctctcagagaacataacttatatgtgcatgtgaggattcatatcacgtgataaaccttaccaatgcaatgtgttgtggaaaagccttctctctagagctcatctctcactgtgcatgtgagaagccatacacggggagaagccctatgggtgtaatgagatgtgggaaagctttctctcaggtctcaacccttgcgtctgcatttgagaatacacacaggtaagaagccttatcagtgcaatgaatgtgggaaagctttcagccacaagtcacaccacattagacaccagttcatactcacttcatcatgccccagaaataatccttttggcgcaccn

SEQ ID NO: 481177 - DNA, 340 bp, Homo sapiens
ggcacctataggagagaggaggtgctgcaagactctctgtgagaaaaatgaagagggtcctgggactactgcttgctgtggcatttggacatgctttagagagaggccgggattatggagtaaagtctgcaaggaattctcccatctgggaaaggaggacttcacatctctgtgactaggcctgtgcacgggcttcttgaccgaagcctgctgtgccgaaggggctgaccctgactggtatgacaccaggaccttagcactgtctgccaagtgctgtgaaagtgattctccattccccgtgtcacccaggcactgttgagtgctgtaccggggcctggcg

SEQ ID NO: 481178 - DNA, 607 bp, Homo sapiens
gcggtagatacaccacaaagatctccttggcacatgatagtcaaactgtcagaagtaaagacaaaaagaattctaaacacagcaagagaaaagcatctgttcacatctaaaggaatcctgatcagactaacagcagatttctcagcagaaaccttgcaagccaggagagaatgagatgatatattcaaagtgctgaagggaaaaaacaaacctgccagttaaggatactgtacctagtgaagttatctttcataaataaaggagaagtgaagactttcccagacagggaaaaacagataattcataaccactaaacaaccagaaaacaaataacaaagtggcaggcataagtccttacttaccaataataacactgaatgtaaatggactaaactctctgatgaaaagacataaagtggctgaatggatgaaaaaacaagacctggtgatctgttgcatacaagaaacttacttataaagacacaaataggggtgcggtggctcatgcctgtaatcccagtacttgggaggctagggcaggagaattgcttgaaccctgggggctgacgctacagtaaggcatgatcgcaccatgtcctctagactg

SEQ ID NO: 481179 - DNA, 508 bp, Homo sapiens
catgctcacccagcacagcgtgccctgagctcggagcgttgagactagtccctgggcacgatatatactttacataaattattatataaatacacagcgaaatagaaactctcaactctgaggggtaggggaagaaacgtgagggactcagcaggaagccagagctgtagaggtccattcaggccaagttgacctcctccttgacccctttggcttctggcttctcctccttggtttgctcctcttcggtgagttcttccttctcctcggggtctttctctttttcatcctctgtttggactctcttggcttttttgcagttggaagagtacttgcggcccccctctccctcctcttcagaatcggagaactcttcctcacaggcaattcgttggtcagaggagcagatcgagatgcgcttgtcagggtcgtcttcgtcctcatcgccactctcctcaggtatggcgtcctcaggaatcgcctgcatttgacacgggggtgcggagtg

SEQ ID NO: 481180 - DNA, 274 bp, Homo sapiens
gggggctcccggaatcccaaaaaaaaaaccatacccaatttaggtgggttccagcccccaatggggggcttttttacattacaggcgggagttttgttccccttttaaaaaaaacccaaagcctctgtcccccttttgtttcctatgatcatcctttaaaaacccaaaaaaggccccttcctgccttttaaataggggtggaaaataggactttaaattatgaaagggtttgctttgtgtttgggatttaacaagtaaaattaaaagttttcca

SEQ ID NO: 481181 - DNA, 565 bp, Homo sapiens
  misc_feature (520)..(520): n is a, c, g, or t
atctagaggatccctgtggacacgggtctcatagatttactgagaaacaaacatctgcatcctcccactggtgtgtctggttggctatgactggcgttcttacaataaattccccagcatgggatttctggaatccaaatgaagaaacgtctccatgggtctggcttccacttttgccttttggcttttccaaaaaggtttttcccatgtacgtgatgctggggctgtaacagtctgtccatttcaccacaattgtgccagcaacatatgttatctttttaggtgggggggctgacctagcaggtataaaagggtacgggggggggggttgaaattttaccttttatgtaaattttaaaaaattattttgaatggcagtaaaatgcacataaaattggccatcttggccatttctaagtgcccagttctgggatataaagtacatccacagggaggtgcattctaaaagacgactttcggcggggggtggtggctcaggcctgtaatcccagtactttgngagggcgaggcgggcggatcacaaggccaggagatcgagaccatc

SEQ ID NO: 481182 - DNA, 264 bp, Homo sapiens
gattttgtcagggtttttttacgggtaggggtgaatagggggccccccttcaaaactggacaaaaaaaacggctgttttccctttccatttaaacatttttagccccttcatttctatttattgaacagggcaaatttgtcttgttatttgggaggccaggacatttaaaaaacacccctatcggttatttttttttcagtcggagtttgacggaaaaattgtttaagcttttgggggaatcttttaaaaaacgggtttttcca

SEQ ID NO: 481183 - DNA, 644 bp, Homo sapiens
  misc_feature (48)..(48): n is a, c, g, or t
  misc_feature (63)..(63): n is a, c, g, or t
  misc_feature (109)..(109): n is a, c, g, or t
  misc_feature (111)..(111): n is a, c, g, or t
  misc_feature (128)..(128): n is a, c, g, or t
  misc_feature (155)..(155): n is a, c, g, or t
  misc_feature (162)..(162): n is a, c, g, or t
  misc_feature (170)..(171): n is a, c, g, or t
  misc_feature (190)..(190): n is a, c, g, or t
  misc_feature (204)..(204): n is a, c, g, or t
  misc_feature (218)..(218): n is a, c, g, or t
  misc_feature (624)..(624): n is a, c, g, or t
cccaagaaccaggcccgtctccactcataaacgccacctacatgtgangtcagcactgaaaangtaacaggaaagttcatgaacaaaaacaaaatctcaaaatttaaantnttacgtgtagcagattnatattggaaattttatatacacaggtngtgattnttcccttnnttgtttccgggttatttanggggcactgcagangtccctgtggccanagctgcggggcctcagtacacggagctgttccggatgccacagcacagcaccatgctcaggatcatctcgaagatcatgatcacagcgaccacgatggcagcaatgccgatgaggtacagcttcccggagaagaggtcatcgatcttctggtggcagtcctccttgaagaggttgctgatgatgttgctgcccgagggacacaaattgttcttgagcactgaggtggtcaaagcagtcagtgtgctggagccacagcagtcaagcgtctcgtggaaggtcttcaccacagccttggcgttgttggcgtcatcatccaccacggcctgctgtagggcctggtcatagaactgcttcacatccttggcgatctggtccttgttgacaaagcccagatgccggcggcanctcacaggcaacaggatgac

SEQ ID NO: 481184 - DNA, 132 bp, Homo sapiens
tttttttttccccccaaaaaagggaaatcccgaaaaaaggggggttttaaaaagccccccgggggatttaattttttacccaatgaaaatggggaaaaaacctgttttccccccccaaaaaaggggggtttt

SEQ ID NO: 481185 - DNA, 362 bp, Homo sapiens
ccgcgaaaccgcagcgtcatacacaaaatcccggaaatcctgcgtcccatcctgcgaacagatccctccattcgcacaaaaactgttgaccagcacactgtcggccccacacggtagaccgagttcgcaggccgcaagccgccatgccagttcactgagctgctccccggccaccagcccatcaagtgcgcggtcccccgccgcgcgcgcgcccatgcccggcgcgatcgccatgaaggcttccggatcacgcgaagtgcgcacccgctcgaccaggtcacggcggtactcggggctgtcctgcagcggctcgccttcggcgaacaaggatgcttccgcggccaggttgccctgcgcggccg

SEQ ID NO: 481186 - DNA, 101 bp, Homo sapiens
aacattaacatctattaactatttatattatccgtaactactacgctgcattcctactactcaagttaaactccgagcaccacaaccctactactatctcg

SEQ ID NO: 481187 - DNA, 160 bp, Homo sapiens
ctgatcttgaattcctgggcccaagtgatccactgcctctgccttccaaagtgctgtgattacaggtgtgagctactgctcgtggcctcatctgggcattcttaacccatagggaaaatgtctaactcaatagctcctcccttacatgacagggtgtgtg

SEQ ID NO: 481188 - DNA, 1593 bp, Homo sapiens
  misc_feature (1)..(1): n is a, c, g, or t
  misc_feature (10)..(10): n is a, c, g, or t
  misc_feature (19)..(19): n is a, c, g, or t
  misc_feature (1035)..(1035): n is a, c, g, or t
ngctcctctncccgccccnccccttgcattgtatacctgaagaagaaacagacagcaggtgagaggacgtcggtccctgtcagttcgtcactcaaccaggcatggtatgttcgtgtgtcggtagcgggatgtctctgtcgagctgttcgtggatcatctatctatgatctctatattgtgttgctggaagtagtactcgtcccgagggggtttgttaatatcggcgctgttcttctttgttatcgcgcgtagtgtgcgcggcccatatattcgcttgtgtggctcccccactcactattcgtcgattttttctctccaaagaattttttttgtacctgctgtcgtaagtttttctactccttataagtggtagtataaacaaattggtgagaacaagttattatgtttctctcaccagggggcaccctttgggcgccatcattaccccgtggtgaaagattttatctctccctcttgggaagaatccctttatatatcacaacgtggggtttcacaacaaaagtgggggcaacactctttagaagagctatttggccacacaccactgtggggggatggagaaataacccttagttgggccctttgggaaaaaatgtttgggctttttccctcgacgaggaagaagatatattggtgtgaagaccattgggccacaaactaccacccaaagagaagtttcgggtgtttttcccaacacagggagcccacctacagatagaggaggggtggcgctatagatgacagacatatttttgcttctctcaccacggaggagttatccacgaagtgtgccacattatttgttccctttgaatggtctctctctcgagtaggttttataaagggcccctcgagtgggcgctgcacaaatacacaaaatgtttggcccacgctgtatggtatatacacacacctcggaggctgtatataccatctggcgctcacgctcacgagctgtgaataagtctcttcacgcccctctctctccgagaggttttatctctgtttgtgctnataagggcacgcgaatctcacccacgcgtgaaatataatgaggggagaaaaatgtaaaatttataggctcccacgctgttgtgtggaacacacaccaaaaccatacacttgggggggttatacccgcgataattgggaaaaactctcccaggtttcacagagatgaaaggggagagtgtggaggattaatccctccttaatatggaccccacggggcctccggttagtttttttataaggagaataataataacaaagccccacacactcccacattgtttatattatattaccacacaataagggtgttttgttaactggtttatatggtaaataatggaggaaaggaaaactaatatattggctgagattttttttgagtttttaagcacgagaagccctttttttttttggttcacgttgtaaaaaaagagagggagaaaacacatgagataaaagtaaactgggttgtatttttctgctttcttgtgacaccgtcctttgtgacatataattggtttttttgttgtttttaaaaaaaagcccttttataaccca

SEQ ID NO: 481189 - DNA, 355 bp, Homo sapiens
ctagcaggatcccccagcaagaatggcatatcaggacataaatccatgcaacatttaaaacatatatatatgtcaaatgctatataggactagggatttttctttacatcattatgaatataacgagtacacattttaagattctgcaaagttagcaatatgaagatgcttgtccttctgtacatatactactaacacacatacaaaaatacaatataatttatctttacaaaaattacagcctatctatagaaaagaaggatgtttatgatgaagattgcaacacatatttttagtacatatatcttacacattgaaatgctacatcttataccctgatatgccattcttgctg

SEQ ID NO: 481190 - DNA, 162 bp, Homo sapiens
agttcagacggcttccattttccttatctgcttcctagtcccgtatgccctgggcctaacactcacaacaaaactaactaatactaacatctcatacgctcaggaaatggaaaccgtctgaactatcctgcccgccatcatcctagtactcatcgacctccc

SEQ ID NO: 481191 - DNA, 228 bp, Homo sapiens
tataaaatagcgatgcctctcccttgcagcccgtgtatagtttcgtcatatgtttcacttttagcgagatagctaagttaggtctaactgaggcgttgattatctgtgttacttcagataatgcaaatgtgtggcttaaatattagttgtattaaagcaaatgccaagaaccagcaaagaggaaatgctagaatggaaaaggtctctcataacaatatagaaaatagt

SEQ ID NO: 481192 - DNA, 649 bp, Homo sapiens
  misc_feature (474)..(474): n is a, c, g, or t
tgggtgactttagaggatcccgtcgacggtaccaacagctttctccatctaccgtgtagtcagcactcagacacatttacccaaagtatctaacaggcacactataaaagatttagctttcagtcagacaaatagctttcagtcaaaacggttagactgaggtggtaaaaggttaaccaaagggggaaagggagtttcccaataacatgtacgtttgctggccctagcagtctcagaggcctgtcagcctgcaggtcccgttccaagcacagggcatgccaagagcagcccactgagagcagaggaagagggctcaaacatttgggacccagacaatatatttaggaggtatggctccaatagggagggaggaggaaaaccacgttccgggcatctccctgtctatccaaatacacttgcataatgtgcacttggaggaaccaagcagatgggcttcagcacagacttcactgncacaacagaccagggagaataagttagacagaaacaggcagcattcccaaagagagaaggtgacgcagaaaagttccagatgagactatgtacactgggtaacacaggaaagactaacttagctgtgtcaagacgagaggattcaaggcaaagtgtatgacagattaagagtaga

SEQ ID NO: 481193 - DNA, 891 bp, Homo sapiens
  misc_feature (10)..(10): n is a, c, g, or t
  misc_feature (103)..(103): n is a, c, g, or t
  misc_feature (107)..(107): n is a, c, g, or t
  misc_feature (109)..(109): n is a, c, g, or t
  misc_feature (120)..(120): n is a, c, g, or t
  misc_feature (136)..(136): n is a, c, g, or t
  misc_feature (179)..(179): n is a, c, g, or t
  misc_feature (185)..(185): n is a, c, g, or t
  misc_feature (188)..(188): n is a, c, g, or t
  misc_feature (194)..(194): n is a, c, g, or t
  misc_feature (199)..(200): n is a, c, g, or t
  misc_feature (207)..(207): n is a, c, g, or t
  misc_feature (209)..(209): n is a, c, g, or t
  misc_feature (213)..(215): n is a, c, g, or t
  misc_feature (225)..(228): n is a, c, g, or t
  misc_feature (232)..(233): n is a, c, g, or t
  misc_feature (241)..(241): n is a, c, g, or t
  misc_feature (243)..(243): n is a, c, g, or t
  misc_feature (249)..(253): n is a, c, g, or t
  misc_feature (258)..(258): n is a, c, g, or t
  misc_feature (260)..(265): n is a, c, g, or t
  misc_feature (268)..(270): n is a, c, g, or t
  misc_feature (274)..(275): n is a, c, g, or t
  misc_feature (286)..(286): n is a, c, g, or t
  misc_feature (295)..(296): n is a, c, g, or t
  misc_feature (298)..(298): n is a, c, g, or t
  misc_feature (305)..(306): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (324)..(324): n is a, c, g, or t
  misc_feature (333)..(333): n is a, c, g, or t
  misc_feature (371)..(371): n is a, c, g, or t
  misc_feature (401)..(401): n is a, c, g, or t
  misc_feature (407)..(407): n is a, c, g, or t
  misc_feature (411)..(411): n is a, c, g, or t
  misc_feature (416)..(416): n is a, c, g, or t
  misc_feature (456)..(456): n is a, c, g, or t
  misc_feature (471)..(472): n is a, c, g, or t
  misc_feature (475)..(475): n is a, c, g, or t
  misc_feature (488)..(489): n is a, c, g, or t
  misc_feature (597)..(597): n is a, c, g, or t
  misc_feature (734)..(734): n is a, c, g, or t
  misc_feature (873)..(873): n is a, c, g, or t
tgtataaaanccgtgcccttgttcactgccaacacaacatctgggtggacatgaactcattacaacaaattcttatgtggatgttgtaagaagtcactcaatntctntngatttaataantcacttcacaccacanaaaatatttaataaatccaaaaaaaggaaagaagaatataacnacagangancttctntctcnnttctctnanactnnntcccccatannnnaccnnccccacantnctcttnnnnngattntnnnnnnttnnntttnntaatttttttnatccttttnntnttcaaannttctanaaanantcctcnctgttttcngtttttaaacagtcaaatctccatctcccccagaaggnaacagtctggtgcagatccataaaaacgtnggaggnaggngcgcnggggagaggcctgtccctcttggaaggggccccacccccncatccgcagaagagnnggnaccaaacagggcnncggggggtctcgtcctgcaacgggtgcgctttcaatgccaaatccagtcacacggcagttccttaaacacaggtacatttctgagtaccaggccagctctaagagganacaaaccatgagttgagagaaaaggactatgacggccatctggtcactttccacgtgatccatcatacttccaggtatcgggagctgctggacttggagtggaaaggctcagaccacatccgccggagatcgccctntaaataggacatcgtgaggagtggcaataaagtaataggcacaaatagagaggggcgggctgggcggcgcggtgtatgcgagacgccacagtagcagtgagcaggcatacacagtatcgatgagggtgcagtgaagtangagacctctgcatgcgcc

SEQ ID NO: 481194 - DNA, 290 bp, Homo sapiens
ctcagtggaccatcttccctctctcacgatgtactctctatgggagttctcttccacagactagacaatcctttccatagagtaccaagtgtaatgccttacagttctttatgaacccctggatttagaggctgaattagagacattctgtctggggacaagtagaccacttccacagcttcgatgttgaactcatggggttctgggtggccaggggcatagtccacgtatcaacacacgacattttaaacggcaactccctgctggcgtgacgacgacgggaacggact

SEQ ID NO: 481195 - DNA, 322 bp, Homo sapiens
  misc_feature (322)..(322): n is a, c, g, or t
atcttcatactgttgagtatatatcatatactattctgatttaaaggtcccgagatgtaacaattctattctttaaaaagggtgactgacactgcagactccaagggtacaaagggaaagtattgtaacatttgtctctaactcttaggcactaatctcctaaaaccagttcacttgataagggaaaagacttgagattcactccattataacttagttagcaaatgtcattgatcattacagatatggcagaataactggaaaactgggattttttccactaaattgccaaaaattaaccaaacaaataaccttcggaacn

SEQ ID NO: 481196 - DNA, 142 bp, Homo sapiens
aatacaacaattagctgggtatggtggtgcgtgcctgtagtccaggctactcaggaggctgaggtgggagggtcacttgtggccaggagttcgagaccagtctgggtgacatagtgggacccctctctaaaaataaaatgaa

SEQ ID NO: 481197 - DNA, 659 bp, Homo sapiens
cggtacgcggtattgagtggcatgtgatgatgagcatttttcatgtgtttttggctgcataaatgtctaccatttgacccagccatcccattactgggtatatacccaaatgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataagaaatgatgagttcatgtcctttgtagggacatggatgaaattggaaaccatcattctcagtaaactatcgcaagaacaaaaaaccaaacaccgcatattctcacttataggtgggaattgaacaatgagatcacatggccactcaataccggtattgagtggccatgtgaatattctgggacttttaccattttaaagggttacataaattataaagtgaggtatttttcatgctatttactgctggggtctgagtaggaacatgaccagtatttcttcagttgggagtcaaaaacctcaggtataccaggtgaaggaggaaaattgaattcagaagagaaatgtgttcctggtgaaaaggggacttcttgtacgggatgttatgat

SEQ ID NO: 481198 - DNA, 410 bp, Homo sapiens
ccgcagtctggggcttggctcattagaaagcaggcggtttcgctcaagttggctgtgagactgctctgcatcagccacggagaggagttgggaacactagagatggagaggaaaaagaggaggagaaagagaaaaagggaaagtgaaatcaccagcgactgggtgacatggtgcatcctggaggatggagaataggatgagtgttcggagtctgccctttgtgactgtcatgttccccgcccatgaagctgcccagttgaacgctgtgtgctcgtctgtggaatagtgccgggctcagccttcgtcgtgttgggtttgaattctccttgtgtacctcggtgtgcggagcttacccctgcactcccagggtgaccgctgcgctaatcacagcctgcttgcccctgctgcgg

SEQ ID NO: 481199 - DNA, 153 bp, Homo sapiens
ccaacggaactttggatatagtataattcaggccccaccctatattgatactgatcagctctggagcagaggcagtgagtttgcaatgtgatgcactagccaacattgagaataagtgaactagatccctatgcaaccgtctagctaggtaga

SEQ ID NO: 481200 - DNA, 352 bp, Homo sapiens
tcatccgaaaccctattgttaagctgtgggatacaagaagttgtaaggctcctctctatgatctggctgtagagggtttgatgagggtttgatgagggtttgatgacccgcatcggcgtaacacaaatggccgaggctctaatcgccactggatgacagttcagtggcaggtcagcaggtcagaggcacttggcgtcaagtgaatgtcctgtgaccgcaccgaaagaaagggaattatggaaccaataaactccgcacatccgcctcctcttcagttctgctatgatgtaggctgctaaggactgcacgacattctcagccaaccaagcattacgccgatgcgggatcctct

SEQ ID NO: 481201 - DNA, 153 bp, Homo sapiens
gtgaagatcctggtgtcgccatgggccgccgcccggccagttgttaccgacattgtatgaacaagccgtacccaaagtctcgcttctgccgaggtgtccctattgcaacgattacgaattttgacctgggcggaaagggcaaaagtggtagag

SEQ ID NO: 481202 - DNA, 446 bp, Homo sapiens
tctccggatcttgtctagtgcgatatgagtaatcatatacgggttgttctccccacattattctataaatggacaccgatgggtagtgaagcaactggtttgctgtccaactttcagaggctgctgtggggggggtctagtttctgcattcttgtcaaagaacttgtaggttggattttcgtagccgttcctgttgcatcttgggacagggtggcgctccctctgggggtgacagcggcgttcaactccaccaaaccatgatgaatggatgtgtactgttttcttctttcagcatcaccaaggtgatgacgatcactgtcgctatgacaacaccgcccaccatgagtccaatgattgcacctttgtttgaacccacatcttctgcaaagaacaccaatttttgatgatgaacttcatatcctgagtcatgtcggaattctgcatcc

SEQ ID NO: 481203 - DNA, 827 bp, Homo sapiens
agcgcgaaacatggcggggcaggacgctggctgcgggcgtggcggcgacgactactcagaaggacgagggcgacagcagcgtgtccaggccggtgtgtggaggtgttcgggaagctgaaggacctagactgccccttcctcgagggtctgtatatcacaggagtccaggatagacaattcaggaactgctgtggcaggcccctcagagtaccgcttggtactatcctagagtggatgtgtacccgggtctggacccctacactgacaggacgaggttgcagcctcactgaaaggtggtcccaatcgagaggtgaagatccaagaaaatgagcagaaagctgggccacgaggctgatgactgtgtgcagctcgagagtgacccgaggagctcctcaagggtcgtgttgcctgggcccagaagcagctacagcattacactggagcagttgctcgataccattccggaggcctgaccattggggtgctccagttgctcgatgcctgtaagtggaggcgacttgcgaggacaagctaagggtagaagaacgagggcttgtctgggggagcgcttctgctagcccccatcgtgggagtatgcttcctgaatcatgagtgcgaacggtggacccgtggacatgcatcccctcctcaacaagcagagtgatgactggcagtggggcagtgtctctgccaagtccgaggagaggagaaggtgggggagatgccaagcaggtgcaggagagtgttgcagagttggcaggcgcttagaacgggtattgcagagcatgagcatgggtgctgtggcgcagcgaatagaccgtagacaa

SEQ ID NO: 481204 - DNA, 399 bp, Homo sapiens
cggcatgcggctattggcgatgcgggcgagcgacacctcgatgggcacctgaaaataaaacgcaccgtcggggcgcaccgaaaagccataaagatttctcacccactccctgtccacacccctggccacgtcgcgggcaaacgccgtaaagcaataacggtcggcgagcaccacaagaccggctttgagggcggggatgatgatgttttcgagccgatcggcaaagtcagtggcatgcagcaggctaaaagtattgggaatgagcgagttggagcgcttggcctgcttgatagtcttgctgatcaggcgggagctattccactcggtaaagatcacgctctggccgcgcgagatgagccagttgcgcaatagatcgagctgggtcgatttgcctgggcc

SEQ ID NO: 481205 - DNA, 384 bp, Homo sapiens
  misc_feature (148)..(150): n is a, c, g, or t
aggtaggggccgttattacaggttgagtatccttaatccagaaatcctaaatcctccaaaatttaaaactttttgagccctgacaggatggtcaaaggaaatgctaattggagcattttgaattttagattttcggatttgagaggcnnnatcattaagtataatgcaaatatcccaaaacctgaaaaaaaaatccgaaatccagaatacttccaagtcccaagcatttcggatgaagggtactcaacctgtttcccattttgcagataagacaactaaggaacaaaaagatcccggagggggaggcggaggttgcagtgagccaagatcgtgccattgcactctagcctgggcaacaagagtgaaactctgtctcaaaaaaaa

SEQ ID NO: 481206 - DNA, 249 bp, Homo sapiens
ttacagatgcttagaggcaggacactggcatagacgcagtaatggtctcaagctgaggggtggaactgtagctgggcagggcccgggcctccgaggtgcccagtgtccactgacccaaggacaagatggccagtggagaaaggtgcagattacgatgtccgtcccggtaccagccgaatgatgctcgctggaacgaaagccgccctattcccttcagcgcttcgactccatcgacaccaccttgccctg

SEQ ID NO: 481207 - DNA, 145 bp, Homo sapiens
ggcgtcttgtaagtcgaaccatcatgacttttgcctccgtagctcctcgatcagctcacgcatcgtctcgcgagctatgaataatgcacgacgtcgcggatcaatgcaatcgtccaggacctgacacgtaggtccctggttcgag

SEQ ID NO: 481208 - DNA, 225 bp, Homo sapiens
  misc_feature (63)..(63): n is a, c, g, or t
  misc_feature (79)..(79): n is a, c, g, or t
  misc_feature (111)..(111): n is a, c, g, or t
  misc_feature (117)..(117): n is a, c, g, or t
  misc_feature (151)..(151): n is a, c, g, or t
  misc_feature (184)..(184): n is a, c, g, or t
  misc_feature (190)..(190): n is a, c, g, or t
gtactgtattatgaggtgtacggtgatgtaaaatattagacagatataaaagtatctatatantatctataactgttantgctgaggtatagtctgtgaattatgtgtttngtattnttattcattgtgtaatttagtggtggtgaagtcncactcaatccttaaagagtggcagtaccctttntcaatntaacatggtctgcatcaatctgtttgcctctaaca

SEQ ID NO: 481209 - DNA, 895 bp, Homo sapiens
ggtcctggtccgggcaccctcgcctggctttcgtcgtccgcccgcgctggctgctcactctgccgctcacactgctgcctccatcgttcaatgcctcgctttcccctttcctcatccgctccccgtcgtacctcacgattgcgccaggcctctgtcgcgtgctttctcgtggcgcgtcccgtgcattgtctcccgctgcactcctcaagtggtcctctttcctcctcggtcccatccacgtagtcgctggcctacggtcgtcctggtctctcgtttgtcggctcatggcgtcgtcctattacacgtttgcgcacgcaattcttgccccgggcaccgggtctctcgtgcacactcacgaggtatctctccggagccagccccctgtgggccatgtccccctgccaattccgccctgttccttcccgcttgtcgttctgctgcccccccggtagtgttccccctctttgtaccgcgatcagggcctcgacacgtgggctggcctgtatttcccactgccttgtgggttctcgcctgcccagcgttcgcggtttgccgtctgtgatagctgatggggagctctgtgcgctagggcatatacagacggatccgctgggactgcgtctgctgacgggaagcatgtgcccggacctgctgctatccccgtcgctcctccattaggaagcaagttaatcctacgttgtgttttttttggtaaattttctttctaggtagagtagctctttgtacatataagaatacttgaaaaagttaattgtatgatgtatgagaagacagagtctcctagtatttgtatcttgttgtatgactgcaagtgaggttcgcaccagtaagccacttattacgtccgagggggggatcacatctttttataatt

SEQ ID NO: 481210 - DNA, 132 bp, Homo sapiens
cttagagatccgtctagcctccctctggaataccagagactttgcacaggggcttgtgtcactccaggcacaggaccaccttcccaaggtgcagcggcagttgccagggcctcctcagtgctgtcttctcca

SEQ ID NO: 481211 - DNA, 1299 bp, Homo sapiens
aagaagcccaagttacaaaatgctactcctacaaactttacaacaaagactatacatctgcctgcagcaactcaaagaggatggaacacttccaacaaacaactagagaaacttaacactaaaggatttgctgtcactagagtgcatcactacaatgctggggttaaacaagagctgctcttctgtggacttaaacgacctattgcgtctcagatacccagtttactaacttgatgcacaccatttcaaatcatacttaacgtgaagctgacctgctgctgatttactagatacacagactgctaactgtacgattagcagcagttcaagcttcttcaatacctggcccccaaatatacgagctgaacaaatatctccatttattcgctttggtaagtgcccatctctctagtgccatgcactcaccattactgacaggaattcaggacggactctcttcaacaagcttcaggcacacttctgctggaaacagctacccagcctctaatccactggccgacagccagcactatctgctctcaacacattccgtcagaactacattctctcatcacgcacactgtcctacataggcactgactacactagacgacaagatccccacgtccctgcgactacctaatactgtcacacaatcctcaactcgagagcacttcactatcctcagccgcactgggacgcgcctggacaaggtcttcccgctgaagcactcaagaaaacaatcccccgttccaggcgcctctgcgcccggacttgagactcccaagtaaaggctacgcaacgcaggcatcagtgacatcgcactctcaccgaaccagaaaccgcaaacataccaacatgaccacctaagacatcctcccaatctcctaagtccaacctcgtgaccccggcactaccatttcccacaccgcacacccacgctccacaatctcaatccacgggctctcacttcacaacacagtgccgggcatcactcccatcctacacgagttcacatcaccctcatcataccccaggcctacgggcccactatcggctacagcacaccacggcaaccacaccacaacagcaactgaccaccgcacccactcatcatcccataccgggaaccaactctgccatcactccattcaattcccacacataccacaatccccttcgctccacacctcctaagaccaccgtcaactctccacactgaaccttcacgaccactacagacacctcgaccggaagcaacactgctcacacgacagcgctacgccctccggacctcac

SEQ ID NO: 481212 - DNA, 203 bp, Homo sapiens
catgggtcgcatgcaatgcctcccggggaaggggccttgtcccaggtcggctttaccctatcgacgcagcgtccccacttggttgaagttgacatcttgacgacgtgaagggagcagatttacaaacttggccaagaagggccttacttccttcacagatccgggtgtaatcctcgagagattcacatggtgttgcacaagtt

SEQ ID NO: 481213 - DNA, 120 bp, Homo sapiens
tgaagttgtttaatcacatgtatcttatctgaagaaaaagactgatgtagtagatgtctgtcattaaaggtgatcctttggtgaaaaaaataaaaacaaataaaacgtgatttgcggccg

SEQ ID NO: 481214 - DNA, 403 bp, Homo sapiens
  misc_feature (208)..(208): n is a, c, g, or t
ggttgggggggggggttgggttgtggcccccgggccccccctcccccctggtcccttgaaattggggcatttcacttttgagaacgaaatttcgcttcagtccttttgccgaagggggtgagggcattggggccggaccctttgggcccggcccctcccagggcccccgctccgtgggaaaaaacagctcccccctttccttgaaaantggacggtttttaaaaaaagattaaacttcgcgggaaatgagtagccaggaagttcaggggggggggccgggcccttcccgggccgggggggtgggacccccccaggtcccccagctgccgttgaaaaaaagcaaaaatttgttgggccaaaaatcccaaacattttctttaaaaaaagttcccttttttggtca

SEQ ID NO: 481215 - DNA, 263 bp, Homo sapiens
cgaacccgagctgcatcgagcacgtcgctcgccggcaaggctcgttcaaggctgtctcaatgcgcctgcgtcgcaggtcctcgtcgatcagcttgtctcggttcagtgcaagcgggcgacgaactgtagtgagtccaggtgaacgacgttgacctgatccaccgaccagtcagggcggatgcatgacgcaaaagccttgcacaaacgccaggatgtggtggctgtgcttgccatcgtgcgcacccgccaggtacaccggcccg

SEQ ID NO: 481216 - DNA, 875 bp, Homo sapiens
  misc_feature (203)..(203): n is a, c, g, or t
ggcctgtagccaggaggtggaggaggaggcggctcgggagagcgacagcgagctggtggatcgccgagcgcgagtgagggcgagccgatgccggccagcgcgccagcaagatatccgaccttcctctctaccgcggaagcagggaagccacggggccggggggcgccccgggacaggggccgggcccaaaggaccgcggtccncctacgaggggttaaggcgcccggcggagggcgttaggcaggagcagacgaaccacgactcaaaagaggcgccgacaggcacacaagcctgagcagaagccgccatgaaggaagaagacggagtgagcccggtgaacctaagacgctgagtagctaccctaggaatcaagtttgtcgccacgttatgacgcgaggtaaactccttagttgggggaccaggggaacaattatataccatacagacacagtagtgaaagcgagcacagctataacacctgacggagcctcacatctaacttgcatatacaagacacaagcagcaaccctatactattacaactagcaaggagcagagccggctaaacaaataagccagatgagcagcaaggaggacggaagaaactcatccagcagacacccgccagcaactacggatgcatcacaccaagcaaaaccgagacgaaggagcgagacaccacaagaagcacacaacacacgacaggcacgacccgcgactgcacgcataatagccgtaggacggtgcgaactagaccaatagtcacacgccgacaacgcacgagggtgcacgattgagcaggggcgatggtacagatacgacagccgggttatagtgtaacggagtcagctcaaggcgctgaaagtctcatacac

SEQ ID NO: 481217 - DNA, 428 bp, Homo sapiens
agccgtacgtggagtacggatagatgactttttctctgctctgatgtagttgatcttgtctctaacttgcatgattcgtgcttcgtattgccgttgcgcttctgtttggtctctgtctgtctctgtgtctctctctgtctctctctctcactctatctgtgtctttggaggctaggctaagagtgccccatgtaacctccttcccccctctctgtggggtgtctctctgtctctttgtttaccccgttattctgcttcatacagaggtcgctgcccaagtcattcaagaggaagatctccgttgtctgtaaggtccaggcccaagatcgctgataaaagtcaggaataccataaaaaccagcattcattgagaaccagaatttcattctcaatggcattcttgggtcataccgtaatccccaaccgga

SEQ ID NO: 481218 - DNA, 476 bp, Homo sapiens
  misc_feature (11)..(11): n is a, c, g, or t
  misc_feature (112)..(112): n is a, c, g, or t
  misc_feature (116)..(116): n is a, c, g, or t
  misc_feature (132)..(132): n is a, c, g, or t
  misc_feature (139)..(139): n is a, c, g, or t
  misc_feature (144)..(144): n is a, c, g, or t
  misc_feature (146)..(146): n is a, c, g, or t
  misc_feature (149)..(149): n is a, c, g, or t
  misc_feature (192)..(193): n is a, c, g, or t
  misc_feature (254)..(254): n is a, c, g, or t
  misc_feature (275)..(275): n is a, c, g, or t
  misc_feature (294)..(294): n is a, c, g, or t
  misc_feature (309)..(309): n is a, c, g, or t
  misc_feature (336)..(336): n is a, c, g, or t
  misc_feature (341)..(343): n is a, c, g, or t
  misc_feature (355)..(355): n is a, c, g, or t
  misc_feature (405)..(405): n is a, c, g, or t
  misc_feature (420)..(420): n is a, c, g, or t
  misc_feature (439)..(439): n is a, c, g, or t
  misc_feature (456)..(456): n is a, c, g, or t
acgaaaaaaanaagtatcagaatgagcatcagaaaaatagcaactcatcttacacataataactagaaaatattattctgtctgatcatttaagtgttacaaatcctgagantgtnataccttgcacaaatncggcccnccctnancantccatctcgcttggccagcctcctttaaaaaatgctctgaggnncaaatcacctatgtcttaaacatgagtctctgacattatactaagagtttaaacaaatatntcaaacaatttcaggccagtngctcttaaaacagctttcngtcaggttctaggtnacactgttccacaatttcccgtgggtnggggnnntccattgcagcngccactcgctctttgtcatttgtctgcttgttggtgtcttcttctgttgngtgggttccttcagnaatgttgatttccaacttntgtttaaatggtaaacntcgctggagttttactctta

SEQ ID NO: 481219 - DNA, 474 bp, Homo sapiens
cgtcttaatgtataataataaaacgtcaatcacatttaagcacgaacactaacaactcggctcatttctcatctttatgccgtttctcctcactgccttcttccatatacaaaataaattcttctctgtcatcccccattagatcgatatagtctccacggtctggacagagcactcgattcactaacaccgctttcgctttagcatagaatgtgctacatacatgtctagcatctggaatcttcacatcactctggtgaaacactgtactcgtttctgaaagcatagcattgtaggtaatggtcttataagtgtctgttgtcggctcatggcacaatcgaatgagatagcgttttgtaataaagtgaagcagcactggggtgatcagcgtccagctccacatgaatgaatagaatatgactcgaataggcagaggcacactttcagaaatagcattattttgtgtaaaaagtc

SEQ ID NO: 481220 - DNA, 598 bp, Homo sapiens
cagataggcaagaagtgcagaaaaagattgtgtggaggaaaaccgtgtgcctgcgagtcctgtgttaaattcaaaaccaaagtggaggggctgctgcaggcccttaccaggaaactggaaactgtgagtaaacggctggccatcctggaaaacacagttgtttaaggctgcctgtcacccctgtggcctctccaagggtcctgcacaagtcccccggagctttacccttttaatgaaggaaaccaaccccggggtgggaaggggtgtgtctgggtgtgcctatttaaagcgtgtaaaggcgtttgggaactcgtgtgtgtatgtgtgcgtgtgtgtaaccgcgcaaaagtgtgtggtgtgtgtgtgtgcaccgtgcccctaagggtgggcattaatctttccaaaatgtgagtgttaaagttataaaccaggggggagtgttaaaggggctgggtttgcctttttaaaatcaaaagcttaaaaaattcccctcttttttaggtaacccctttttggctctgagggctgggaaattctttactgatttctctattttccggggagaaacaattaaatgtggttttacgttagccgtgga

SEQ ID NO: 481221 - DNA, 457 bp, Homo sapiens
  misc_feature (24)..(24): n is a, c, g, or t
  misc_feature (31)..(31): n is a, c, g, or t
  misc_feature (77)..(77): n is a, c, g, or t
  misc_feature (87)..(87): n is a, c, g, or t
  misc_feature (102)..(102): n is a, c, g, or t
  misc_feature (139)..(139): n is a, c, g, or t
  misc_feature (238)..(238): n is a, c, g, or t
aatacatcaaccatttaaggccangctaatngtaccaggttggggaaccccatggtaacttctcactcccaatgggngtttgggagnttccccattccttgngaacattctcccaaaggggcctttcttttcaattctnttcccccctgccttctgggacctactcccccattccgggaccaatgctgatttactatctctacagattagttttgtcttgctagcatttcatataaanggaatcatatgatatgtgtcttttcatgtctgggtctttcactttgcacatctgtgagattcgaccaataccatcgagagtattagtaatgcattcctgcttattgctgatgactattccatttcacaaatataccataattattcattcacctgttgaacattttggtttttcccattttgggatattatgaataaacttgctatgaacttccgaaaa

SEQ ID NO: 481222 - DNA, 800 bp, Homo sapiens
cccacggcgtccggaagcagctctgggggaataatgggcaaactatgcttgtgatgaactacactgaaatctaccagagttaatgttatacttcgtgtagcatccatattgtctatcttcactctcatattatcccagtgacaagtgtatatgatagagaactttgcattctatacaatacactatgagcttcactaaaatatccatggcattatgtttattcctcgtagaactataagttacatcagttaacactggtacatatgacgatggcttatgttaagaaatacccagtgcgtcaggttttgaaagatcaggcaaaaaaaacaacagtataggacaaccttgaagaattgtactacttttgtcagcagggcacattctgtgctgtaatatctggcaaacttatggatcagacttgatctggtcgttctgtgaaaatctgacgcactctgaatagggtgtctggaatatggactacctttgcttgccatgtctaaggtcttctgagacgtaaatatgtgaggtgtgcgggttgtgctggggtaaacagcttccttccctttctgtgtagcaagcccttgactactgtctggtttaaaatccacgtaggctttcaaggggtccggagctattcaatctccttggtgttttcaaatatatgttagattgcgcattacgcaccaggaattagcatttctgtaaaccccttaatctagccttgtgaggcattcgcttattaccgtgtgctcacttccctccaatggaccggagagacggtctgctgacactgaagggct

SEQ ID NO: 481223 - DNA, 135 bp, Homo sapiens
tcagctgatgttaccacactaacatctgttacttgggcagcctgctgtcagtgtgtgtcactgacctctggactggcctgcacagagcagccctattatcacagatcacccttcgtgcacagatcacccttcgtg

SEQ ID NO: 481224 - DNA, 138 bp, Homo sapiens
ttcaaatcagtcaattttacttcatgcatttcatgtgtttaaattggtatcatggcatgtccatggcagcaaagtttactgagttttcaagatgtttcacagttatctggcagtggccataattggtttggacagtga

SEQ ID NO: 481225 - DNA, 795 bp, Homo sapiens
ctagccagtcaagctgacccccgcagagagccaacaacaggggacctgcgcacggcacagttctttatgcctgtcttgcgcctctcaccagccgggaggcacccaatatcgagctctcacaggccggaactcacccagcaggtgcttcagaagccaagaacatgaggccgccttgtgacaccccgccacggcgcgataacactcaccgggctgctgtcttccgctggtcggaagtgccaagaaggaggtcgatgagcagaagcttaacgggcagaacaaggacagcagctactttgtgggaaggatcccccacaatggtcaagacaaccgtctgtgacatcccacctcgtggcctcaagatggcagtcaccatcagtggcaatagcacagccatccaggagctcttcaagcagcatcatcggagacagatcactgccaagttccgccggaaggccttcctaccaatggtacacaggcgagggcatggacgagatggagcttcaccgaggctgagagcaacatggacgacctcgtctgctgagtatcagcagtaccaggatgcccccgcagaagaggaggaggatttcggtgaggaggccgaagaggaggcctaaaggcagagcccccatcacctcaggcttctcagttcccctagccgtccttactcaactgcccctttcctctccctcagaatttgtgtttctgcctctatcttgttttttggttttttttttgggggggggtctagacagtgcctggcacatagtaggcgctccaataatacttgtttgttga

SEQ ID NO: 481226 - DNA, 1026 bp, Homo sapiens
  misc_feature (781)..(781): n is a, c, g, or t
  misc_feature (952)..(952): n is a, c, g, or t
tggaaacggatttatcatctcccggtggtccaggatggatgtgcaagggggcaatactcggctcaccaaaacctccgcctcccaaggttacaagacaattctccggtcttaagcctccccgagatagcttgggtagactaacaggtgcccttgaaccaccactgcccgggtataaatttgtggtatttattagtaagaagacgggggttctacttccatgtgttaagagtgctgtgtctctgaaactccttaggacctccatgtgtagactccggccctgtcatcaggccatcccaaatggtgcttggtgaaataatacacggctgtgagtcaaccggtgtcgccttggtgctcttagaagggtgtaatccatactctcatataatgtatatcaaagaaagggtgtcagcctcaaacatttatcaccagagatgtggcgcctttagaccgcgcaacttggttccatacttatttagatcgcatgaggcttatgggttcggtgtgcgaaacaatatatttatgtgtggcgacccgtggtgtatcttctcccaccgggggcacaacacaaacagtgtatatgttgagaccagtttcattagaaaatagaattggcctcctgggtgatcatcctcgaaaggccttttatctgggatgtgagcagcggcacaaaaatacgacgagcgagacaaaattggtgcgctataaaggaaaccctctctaaaaaagccatcgcgcggtgagtatctcttggactgttgtgtaacacacccatagtaacgtngggtcattacaaattttcaaaatggttccaccatatgatttgacattgtgtccaacaaaatggcacgcaaagctatcaaaggcacgatctttgggtggatagggatcacaaccctgtggggtcatcggagattactcttatcacatcgaggaaattaacaacgtccctttnaggagagttcaactatccaaatcaaaaatttatcgagtgcacaatctaaaagtaagataacacctggggtggtg
